(12) United States Patent
Spector et al.

(10) Patent No.: US 11,058,709 B1
(45) Date of Patent: Jul. 13, 2021

(54) METHODS OF TREATING BREAST CANCER

(71) Applicants: Cold Spring Harbor Laboratory, Cold Spring Harbor, NY (US); Ionis Pharmaceuticals, Inc., Carlsbad, CA (US)

(72) Inventors: David L. Spector, Cold Spring Harbor, NY (US); Sarah Daniela Diermeier, Centerport, NY (US); Frank Rigo, Carlsbad, CA (US); C. Frank Bennett, Carlsbad, CA (US); Susan M. Freier, San Diego, CA (US); Gayatri Arun, Huntington, NY (US); Kung-Chi Chang, Cold Spring Harbor, NY (US)

(73) Assignees: Ionis Pharmaceuticals, Inc., Carlsbad, CA (US); Cold Spring Harbor Laboratory, Cold Spring Harbor, NY (US)

( * ) Notice: Subject to any disclaimer, the term of this patent is extended or adjusted under 35 U.S.C. 154(b) by 264 days.

(21) Appl. No.: 15/781,249

(22) PCT Filed: Dec. 5, 2016

(86) PCT No.: PCT/US2016/064998
§ 371 (c)(1),
(2) Date: Jun. 4, 2018

(87) PCT Pub. No.: WO2017/096395
PCT Pub. Date: Jun. 8, 2017

Related U.S. Application Data

(60) Provisional application No. 62/378,125, filed on Aug. 22, 2016, provisional application No. 62/263,484, filed on Dec. 4, 2015.

(51) Int. Cl.
| | | |
|---|---|---|
| *A61K 31/713* | (2006.01) |
| *A61P 35/00* | (2006.01) |
| *A61K 31/175* | (2006.01) |
| *A61K 31/712* | (2006.01) |
| *A61K 31/7125* | (2006.01) |
| *C07H 21/04* | (2006.01) |
| *C12N 15/113* | (2010.01) |

(52) U.S. Cl.
CPC .......... *A61K 31/713* (2013.01); *A61K 31/175* (2013.01); *A61K 31/712* (2013.01); *A61K 31/7125* (2013.01); *A61P 35/00* (2018.01); *C07H 21/04* (2013.01); *C12N 15/113* (2013.01); *A61K 2300/00* (2013.01)

(58) Field of Classification Search
CPC .......... C12Q 1/6886; C12Q 2600/178
USPC .... 435/6.1, 91.1, 91.31, 455, 458; 536/23.1, 536/24.5; 514/44 A
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |

(Continued)

FOREIGN PATENT DOCUMENTS

| | | |
|---|---|---|
| WO | WO 2000/063364 | 10/2000 |
| WO | WO 2010/138806 A2 | 12/2010 |

(Continued)

OTHER PUBLICATIONS

Huarte, M, Nature Medicine, vol. 21, No. 11, pates 1253-1261. (Year: 2015).*

(Continued)

*Primary Examiner* — Jane J Zara
(74) *Attorney, Agent, or Firm* — Michael Best & Friedrich LLP

(57) ABSTRACT

Provided herein are methods, compounds, and compositions for reducing expression of a MaTAR in an animal. Such methods, compounds, and compositions are useful to treat, prevent, delay, or ameliorate breast cancer in an individual in need.

15 Claims, No Drawings
Specification includes a Sequence Listing.

(56) References Cited

U.S. PATENT DOCUMENTS

| | | |
|---|---|---|
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,673,661 B1 | 1/2004 | Liu et al. |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 7,015,315 B1 | 3/2006 | Cook et al. |
| 7,034,133 B2 | 4/2006 | Wengel et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| RE34,036 E | 3/2011 | McGeehan |
| 7,939,677 B2 | 5/2011 | Bhat et al. |
| 8,022,193 B2 | 9/2011 | Swayze et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,062,351 B2 | 6/2015 | Chang et al. |

(56) References Cited

U.S. PATENT DOCUMENTS

| | | | |
|---|---|---|---|
| 9,127,276 | B2 | 8/2015 | Prakash et al. |
| 9,290,760 | B2 | 3/2016 | Rajeev et al. |
| 2001/0053519 | A1 | 12/2001 | Fodor et al. |
| 2003/0082807 | A1 | 5/2003 | Wengel |
| 2003/0158403 | A1 | 8/2003 | Manoharan et al. |
| 2003/0175906 | A1 | 9/2003 | Manoharan et al. |
| 2003/0207841 | A1 | 11/2003 | Kaneko et al. |
| 2003/0224377 | A1 | 12/2003 | Wengel et al. |
| 2003/0228597 | A1 | 12/2003 | Cowsert et al. |
| 2004/0143114 | A1 | 7/2004 | Imanishi et al. |
| 2004/0171570 | A1 | 9/2004 | Allerson et al. |
| 2004/0192918 | A1 | 9/2004 | Imanishi et al. |
| 2005/0130923 | A1 | 6/2005 | Bhat et al. |
| 2006/0148740 | A1 | 7/2006 | Platenburg |
| 2007/0031844 | A1 | 2/2007 | Khvorova et al. |
| 2008/0039618 | A1 | 2/2008 | Allerson et al. |
| 2010/0190837 | A1 | 7/2010 | Migawa et al. |
| 2010/0197762 | A1 | 8/2010 | Swayze et al. |
| 2011/0123520 | A1 | 5/2011 | Manoharan et al. |
| 2013/0130378 | A1 | 5/2013 | Manoharan et al. |
| 2013/0178428 | A1 | 7/2013 | Hoon et al. |
| 2013/0203836 | A1 | 8/2013 | Rajeev et al. |
| 2013/0267575 | A1 | 10/2013 | Safe et al. |
| 2014/0107330 | A1 | 4/2014 | Freier et al. |
| 2014/0242192 | A1 | 8/2014 | Cormack et al. |
| 2015/0018540 | A1 | 1/2015 | Prakash et al. |
| 2015/0184153 | A1 | 7/2015 | Freier et al. |
| 2015/0191727 | A1 | 7/2015 | Migawa et al. |
| 2015/0267195 | A1 | 9/2015 | Seth et al. |
| 2015/0275212 | A1 | 10/2015 | Albaek et al. |

FOREIGN PATENT DOCUMENTS

| | | | |
|---|---|---|---|
| WO | WO 2012/058268 | A2 | 5/2012 |
| WO | 2013/066721 | A2 | 5/2013 |
| WO | WO 2013/066821 | A2 | 5/2013 |
| WO | WO 2014/205555 | | 12/2014 |

OTHER PUBLICATIONS

Ali et al., "Endocrine-responsive breast cancer and strategies for combating resistance" Nat Rev Cancer (2002) 2(2): 101-112.
Anders et al., "HTSeq—a Python framework to work with high-throughput sequencing data" Bioinformatics (2015) 31(2): 166-169.
Anderson et al., "Tracking and evaluating molecular tumor markers with cancer registry data: HER2 and breast cancer" J Natl Cancer Inst (2014) 106(5): 1-3.
Anderson et al., "How many etiological subtypes of breast cancer: two, three, four, or more?" J Natl Cancer Inst (2014) 106(8): 1-11.
Andrechek et al., "Amplification of the neu/erbB-2 oncogene in a mouse model of mammary tumorigenesis" PNAS (2000) 97: 3444-3449.
Arase et al., "Transforming growth factor-β-induced lncRNA-Smad7 inhibits apoptosis of mouse breast cancer JygMC(A) cells." Cancer Sci. (2014) 105: 974-982.
Arun et al., "Differentiation of mammary tumors and reduction in metastasis upon Malat1 lncRNA loss" Genes & Development (2016) 30: 34-51.
Arun et al., "Therapeutic Targeting of Long Non-Coding RNAs in Cancer" Trends in Mol. Med. (2018) 24(3): 257-277.
Barcellos-Hoff et al., "Functional differentiation and alveolar morphogenesis of primary mammary culatures on reconstituted basement membrane" Development (1989) 105: 223-235.
Bergmann et al., "Long non-coding RNAs: modulators of nuclear structure and function" Curr. Opin. Cell Biol. (2014) 26: 10-18.
Bergmann et al., "Regulation of the ESC transcriptome by nuclear long noncoding RNAs" Genome Res (2015) 25: 1336-1346.
Bertone et al., "Global identification of human transcribed sequences with genome tiling arrays" Science (2004) 306: 224202246.
Boj et al., "Organoid Models of Human and Mouse Ductal Pancreatic Cancer" Cell (2015) 160: 324-338.
Branch et al., "A good antisense molecule is hard to find," TIBS (1998) 23:45-50.
Bundy et al., "CCAAT/enhancer binding protein beta (C/EBPβ-2 transforms normal mammary epithelial cells and induces epithelial to mesenchymal transition in culture" Oncogene (2003) 22: 869-883.
Cabili et al., "Integrative annotation of human large intergenic noncoding RNAs reveals global properties and specific subclasses" Genes & Development (2011) 25: 1915-1927.
The Cancer Genome Atlas Network, "Comprehensive molecular portraits of human breast tumours" Nature (2012) 490: 61-70.
Carninci et al., "The transcriptional landscape of the mammalian genome" Science (2005) 309: 1559-1563.
Chang et al., "Androgen receptor (AR) differential roles in hormone-related tumors indcluding prostate, bladder, kidney, lung, breast and liver" Oncogene (2013) 1-10.
Cheetham et al., "Long noncoding RNAs and the genetics of cancer" British Journal of Cancer (2013) 108: 2419-2425.
Cheung et al., "Collective Invasion in Breast Cancer Requires a Conserved Basal Epithelial Program" Cell (2013) 155: 1639-1651.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Chou et al., "HSF1 regulation of β-catenin in mammary cancer cells through control of HuR/elavL1 expression" Oncogene (2015) 34: 2178-2188.
Clevers, "Modeling Development and Disease with Organoids" Cell (2016) 165: 1586-1597.
Crooke et al., "Basic Principles of Antisense Therapeutics" Antisense Research and Application (1998) Chapter 1:1-50.
Derrien et al., "The GENCODE v7 catalog of human long noncoding RNAs: Analysis of their gene structure, evolution, and expression" Genome Res. (2012) 22: 1775-1789.
Diederichs, "The four dimensions of noncoding RNA conservation." Trends in Genetics (2014) 30: 121-123.
Diermeier et al., "Mammaly Tumor-Associate RNAs Impact Tumor Cell Proliferation, Invasion, and Migration" Cell Rep (2016) 17: 261-274.
Diermeier et al., "Abstract A43: Long noncoding RNAs as targets of mammary tumor cell proliferation and migration" Cancer Research (2016) 76(6).
Diermeier et al., "Antisense Oligonucleotide-mediated Knockdown in Mammaly Tumor Organoids" Bio-Protocol (2017) 7(16): 1-13.
Dimitrova et al., "LncRNA-p21 activates p21 in cis to promote polycomb target gene expression and to enforce he G1/S checkpoint" Molecular Cell (2014) 54: 777-790.
Djebali et al., "Landscape of transcription in human cells" Nature (2012) 489: 101-108.
Dobin et al., "STAR: ultrafast universal RNA-seq aligner" Bioinformatics (2013) 29: 15-21.
Domcke et al., "Evaluating cell lines as tumour models by comparison of genomic profiles" Nature Communications (2013) 4: 2126.
Eden et al., "GOrilla: a tool for discovery and visualization of enriched GO terms in ranked gene lists" BMC Bioinformatics (2009) 10: 48.
Ewald, "Isolation of mouse mammary organoids for long-term time-lapse imaging" Cold Spring Harb. Protoc. (2013) 130-133.
Ewald et al., "Collective epithelial Migration and Cell Rearrangements Drive Mammaly Branching Morphogenesis" Developmental Cell (2008) 14: 570-581.
Fabregat et al., "The reactome pathway knowledgebase" Nucleic Acids Res (2016) 44: D481-D487.
Fata et al., "The MAPKERK-1,2 pathway integrates distinct and antagonistic signals from TGFα and FGF7 in morphogenesis of mouse mammary epithelium" Developmental Biology (2007) 306: 193-207.
Geary et al., "Pharmacokinetics, biodistribution and cell uptake of antisense oligonucleotides" Adv. Drug Deliv. Rev. (2015) 87: 46-51.
Gupta et al., "Long non-coding RNA HOTAIR reprograms chromatin state to promote cancer metastasis" Nature (2010) 464: 1071-1076.

(56) References Cited

OTHER PUBLICATIONS

Guy et al., "Induction of mammary tumors by expression of polyomavirus middle T oncogene: a transgenic mouse model for metastatic disease" Molecular and Cellular Biology (1992) 12: 954-961.
Hansji et al., "Keeping abreast with long non-coding RNAs in mammary gland development and breast cancer" Front Genet (2014) 5: 379.
Heinz et al., "Simple Combinations of Lineage-Determining Transcription Factors Prime cis-Regulatory Elements Required for Macrophage and B Cell Identities" Molecular Cell (2010) 38: 576-589.
Higgins et al., "Targeted therapies for breast cancer" J Clin Invest (2011) 121(10): 3797-3803.
Huarte, "The emerging role of lncRNAs in cancer" Nature Medicine (2015) 21: 1253-1261.
Huarte et al., "A large intergenic noncoding RNA induced by p53 mediates global gene repression in the p53 response" Cell (2010) 142: 409-419.
Huber et al., "NF-KB is essential for epithelial-mesenchymal transition and metastasis in a model of breast cancer progression" J. Clin. Invest. (2004) 114: 569-581.
International Search Report for PCT/US2016/064998 dated May 4, 2017.
Iyer et al., "The landscape of long noncoding RNAs in the human transcriptome" Nat. Genet. (2015) 47: 199-208.
Kapranov et al., "RNA maps reveal new RNA classes and a possible function for pervasive transcription" Science (2007) 316: 1484-1488.
Katayama et al., "Antisense transcription in the mammalian tmnscriptome" Science (2005) 309(5740): 1564-1566.
Koller et al., "Mechanisms of single-stranded phosphorothioate modified antisense oligonucleotide accumulation in hepatocytes" Nucleic Acids Res. (2011) 39: 4795-4807.
Koller et al., "Use of a chemically modified antisense oligonucleotide library to identify and validate Eg5 (kinesin-like 1) as a target for antineoplastic drug development" Cancer Research (2006) 66: 2059-2066.
Kornienko et al., "Gene regulation by the act of long non-coding RNA transcription" BMC Biol (2013) 11: 1-14.
Lancaster et al., "Organogenesis in a dish: Modeling development and disease using organoid technologies" Science (2014) 345: 1247125.
Langfelder et al., "WGCNA: an R package for weighted correlation network analysis" BMC Bioinformatics (2008) 9: 559.
Li et al., "RSEM: accurate transcript quantification from RNA-Seq data with or without a reference genome" BMC Bioinformatics (2011) 12: 323.
Lopes et al., "Kaiso Contributes to DNA Methylation-Dependent Silencing of Tumor Suppressor Genes in Colon Cancer Cell Lines" Cancer Research (2008) 68: 7258-7263.
Love et al., "Moderated estimation of fold change and dispersion for RNA-seq data with DESeq2" Genome Biol (2014) 15: 550.
Luo et al., "Pathview: an R/Bioconductor package for pathway-based data integration and visualization" Bioinformatics (2013) 29: 1830-1831.
Luo et al., "GAGE: generally applicable gene sest enrichment for pathway analysis" BMC Bioinformatics (2009) 10: 161.
New England Biolabs 1998/99 Catalog (cover page and pp. 121 and 284).
Nguyen-Ngoc et al., "ECM microenvironment regulates collective migration and local dissemination in normal and malignant mammary epithelium" PNAS (2012) 109: E2595-E2604.
Okazaki et al., "Analysis of the mouse transcriptome based on functional annotation of 60,770 full-length cDNAs" Nature (2002) 420: 563-573.
Parker et al., "Supervised Risk Predictor of Breast Cancer Based on Intrinsic Subtypes" Journal of Clinical Oncology (2009) 27: 1160-1167.
Perou et al., "Molecular portraits of human breast tumours" Nature (2000) 406(6797): 747-752.
Prensner et al., "The Emergence of lncRNAs in Cancer Biology" Cancer Discovery (2011) 1: 391-407.
Ran et al., "Genome engineering using the CRISPR-Cas9 system" Nat Protoc (2013) 8: 2281-2308.
Reynolds et al., "Rational siRNA design for RNA interference" Nature Biotechnology (2004) 22(3):326-330.
Rinn et al., "Genome Regulation by Long Noncoding RNAs" Annu. Rev. Biochem (2012) 81: 145-166.
Rinn et al., "Functional demarcation of active and silent chromatin domans in human HOX loci by noncoding RNAs" Cell (2007) 129: 1311-1323.
Sachs et al., "Organoid culture for the analysis of cancer phenotypes" Curr. Opin. Genet. Dev. (2014) 24: 68-73.
Sanghvi et al., "Heterocyclic Base Modifications in Nucleic Acids and Their Applications in Antisense Oligonucleotides" Antisense Research and Applications (1993) pp. 273-288.
Shamir et al., "Three-dimensional organotypic culture: experimental models of mammalian biology and disease" Nature Review Molecular Cell Biology (2014) 15: 647-664.
Shore et al., "Noncoding RNAs involved in mammary gland development and tumorigenesis: there's a long way to go" J. Mammary Gland Biol Neoplasia (2012) 17: 43-58.
Siegel et al., "Elevated expression of activate dforms of Neu/ErbB-2 and ErbB-3 are involved in the induction of mammary tumors in transgenic mice: implications for human breast cancer" The EMBO Journal (1999) 18: 2149-2164.
Siegel et al., "Cancer statistics, 2015" CA Cancer J Clin (2015) 65(1): 5-29.
Sorlie et al., "Repeated observation of breast tumor subtypes in independent gene expression data sets" Proc Natl Acad Sci USA (2003) 100(14): 8418-8423.
St Laurent et al., "Intronic RNAs constitute the major fraction of the non-coding RNA in mammalian cells" BMC Genomics (2012) 13: 504.
Subramanian et al., "Gene set enrichment analysis: a knowledge-based approach for interpreting genome-wide expression profiles" PNAS (2005) 102: 15545-15550.
Sun et al., "Discovery, annotation, and Functional Analysis of Long Noncoding RNAs Controlling Cell-Cycle Gene Expression and Proliferation in Breast Cancer Cells" Molecular Cell (2015) 59: 698-711.
Tomita et al., "A cluster of noncoding RNAs activates the ESR1 locus during breast cancer adaptation" Nature Communications (2015) 6: 6966.
Ulitsky et al., "Conserved Function of lncRNAs in Vertebrate Embryonic Develoment despite Rapid Sequence Evolution" Cell (2011) 147: 1537-1550.
Van Staveren et al., "Human cancer cell lines: Experimental models for cancer cells in situ? For cancer stem cells?" Biochim Biophys Acta (2009) 1795: 92-103.
Vikram et al., "Functional significance of long non-coding RNAs in breast cancer" Breast Cancer (2014) 21: 515-521.
Wahlestedt, "Targeting long non-coding RNA to therapeutically upregulate gene expression" Nat Rev Drug Discov (2013) 12: 433-446.
Wang et al., "CPAT: Coding-Potential Assessment Tool using and alignment-free logistic regression model" Nucleic Acids Res (2013) 41: e74.
Wapinski et al., "Long noncoding RNAs and human disease" Trends in Cell Biology (2011) 21: 354-361.
Xing et al., "lncRNA directs cooperative epigenetic regulation downstream of chemokine signals" Cell (2014) 159: 1110-1125.
Yan et al., "Comprehensive Genomic Characterization of Long Non-coding RNAs across Human Cancers" Cancer Cell (2015) 28: 529-540.
Yang et al., "Reciprocal regulation of HIF-1α and lncRNA-p21 modulates the Warburg effect" Molecular Cell (2014) 53: 88-100.
Zhang et al., "A myelopoiesis-associated regulatory intergenic noncoding RNA transcript within the human HOXA cluster" Blood (2009) 113: 2526-2534.

(56) References Cited

OTHER PUBLICATIONS

Zhang et al., "Long intergenic noncoding RNA HOTAIRM1 Regulates cell cycle progression during myeloid maturation in NB4 human promyelocytic leukemia cells" RNA Biology (2014) 11: 777-787.
Bhan et al., "Antisense Transcript Long Noncoding RNA (lncRNA) HOTAIR is Transcriptionally Induced by Estradiol" J Mol Biol (2013) 425(19): 3707-3722.
Crooke, ST., et al., "Antisense Drug Technology" Second Edition, CRC Press (2008) Chapters 1-28.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Gautschi et al., "Activity of a novel bcl-2/bcl-xLbispecific antisense oligonucleotide against tumors of diverse histologic origins" J. Natl. Cancer Inst. (2001) 93:463-471.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Woolf et al., "Specificity of antisense oligonucleotides in vivo" PNAS (1992) 89: 7305-7309.
Partial Search report for EP 16871732.0 dated Sep. 10, 2019.
European Patent Office Extended Search Report for Application No. 16871732.0 dated Dec. 11, 2019 (14 pages).

\* cited by examiner

METHODS OF TREATING BREAST CANCER

STATEMENT OF GOVERNMENT SUPPORT

This invention was made with Government support under CA013106 and GM042694 awarded by National Institute of Health. The government has certain rights in the invention.

SEQUENCE LISTING

The present application is being filed along with a Sequence Listing in electronic format. The Sequence Listing is provided as a file entitled BIOL0280USASEQ_ST25.txt, created on Jun. 1, 2018 which is 4.92 MB in size. The information in the electronic format of the sequence listing is incorporated herein by reference in its entirety.

FIELD OF THE INVENTION

Provided herein are methods, compounds, and compositions useful for reducing expression of long noncoding RNAs (lncRNAs), specifically, Mammary Tumor Associated RNAs (hereinafter referred to as MaTARs) in an animal. Also, provided herein are methods, compounds, and compositions comprising MaTAR inhibitors, which can be useful in reducing MaTAR-related diseases or conditions in an animal. Such methods, compounds, and compositions can be useful, for example, to treat, prevent, delay or ameliorate breast cancer in an animal.

BACKGROUND

Breast cancer is the most frequent malignancy in women worldwide and the second leading cause of cancer mortality in women (Siegel et al. Cancer Statistics, 2015. CA: A Cancer Journal for Clinicians 65: 5-29, 2015). The challenge of finding more efficient treatments is complicated by the diversity of the disease, resulting in the classification of numerous breast cancer subtypes. The most common type, invasive ductal carcinoma, can be stratified into two fundamental classes: the estrogen receptor (ER) and/or progesterone receptor (PR) positive subtypes (luminal A and luminal B) and ER-negative (HER2/neu-amplified and basal-like) disease. These "intrinsic" breast cancer subtypes differ in gene expression patterns, histo-pathology, patient prognosis and treatment strategy (Perou et al. Nature. 406: 747-752, 2000; Sorlie et al. Proc. Natl. Acad. Sci. USA 100: 8418-8423, 2003; Cancer Genome Atlas Network Nature. 490: 61-70, 2012; Anderson et al. J. Natl. Cancer Inst. 106, 2014).

While currently available endocrine and targeted therapies have lead to improved overall survival rates, many breast tumors are intrinsically resistant or acquire resistance after initial responsiveness (Ali and Coombes Nat. Rev. Cancer 2: 101-112, 2002; Higgins and Baselga J. Clin. Invest. 121: 3797-3803, 2011). To improve the existing treatment regimens, it is critical to identify and investigate new molecular targets that have the potential to inhibit breast cancer progression and metastasis by impacting alternative pathways and/or restoring drug sensitivity.

SUMMARY

Provided herein are compositions, compounds and methods for modulating expression of lncRNAs associated with breast cancer. In certain embodiments, these compositions, compounds and methods are for modulating the expression of mammary tumor associated RNAs (MaTARs). In certain embodiments, the MaTAR modulator is a MaTAR-specific inhibitor. In certain embodiments, the MaTAR-specific inhibitor decreases expression of a MaTAR. In certain embodiments, MaTAR-specific inhibitors include nucleic acids, proteins and small molecules. In certain embodiments, the MaTAR-specific inhibitor is a nucleic acid. In certain embodiments, the nucleic acid is a compound. In certain embodiments, the compound comprises a modified oligonucleotide. In certain embodiments, the modified oligonucleotide can be single stranded or double stranded.

Certain embodiments relate to the novel findings of a comprehensive catalog of lncRNAs that are upregulated in mammary tumors compared to mammary gland epithelia. Certain embodiments relate to the novel identification of MaTARs as the key drivers in tumor progression. Certain embodiments relate to the novel findings of MaTAR involvement in mammary tumor proliferation and carcinogenesis. Certain embodiments are directed to MaTAR inhibitors useful for inhibiting a MaTAR, which can be useful for treating, ameliorating, or slowing progression of breast cancer.

DETAILED DESCRIPTION OF THE INVENTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ISIS number (ISIS #) indicate a combination of nucleobase sequence, chemical modification, and motif.

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE and 2'-O(CH$_2$)$_2$—OCH$_3$) refers to an O-methoxy-ethyl modification at the 2' position of a furanosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within ±10% of a value. For example, if it is stated, "the compounds affected about 70% inhibition of a MaTAR", it is implied that MaTAR levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a bicyclic furanosyl sugar moiety comprising a bridge connecting the 4'-carbon and the 2'-carbon, wherein the bridge has the formula: 4'-CH(CH$_3$)—O-2'.

"Constrained ethyl nucleoside" (also cEt nucleoside) means a nucleoside comprising a cEt.

"Chemical modification" in a compound describes the substitutions or changes through chemical reaction, of any of the units in the compound. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" mean chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded compound" means a compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Ensembl ID" is an identification number consisting of letters and numbers assigned to a gene sequence by Ensembl, which is a joint project between EMBL-EBI and the Wellcome Trust Sanger Institute to develop a software system that produces and maintains automatic annotation of selected eukaryotic genomes. Ensembl annotation helps identify a gene location in a particular genome and can be used to configure the equivalent gene on another species' genome.

"Expression" includes all the functions by which a gene's coded information is converted into structures present and operating in a cell. Such structures include, but are not limited to the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Intravenous administration" means administration into a vein.

"Lengthened oligonucleotides" are those that have one or more additional nucleosides relative to an oligonucleotide disclosed herein, e.g. a parent oligonucleotide.

"lncRNA" means any long transcript that is not classified as protein-coding, including, but not limited to pseudogenes and antisense transcripts.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"MaTAR" means Mammary Tumor Associated RNA and are potentially oncogenic lncRNAs that differentially expressed in breast cancer.

"MaTAR nucleic acid" means any nucleic acid encoding a MaTAR. For example, in certain embodiments, a MaTAR nucleic acid includes a DNA sequence encoding the MaTAR, an RNA sequence transcribed from DNA encoding the MaTAR (including genomic DNA comprising introns and exons), including a non-protein encoding (i.e. non-coding) RNA sequence. The target may be referred to in either upper or lower case.

"MaTAR-specific inhibitor" refers to any agent capable of specifically inhibiting the MaTAR expression or activity at the molecular level. For example, MaTAR-specific inhibitors include nucleic acids (including antisense compounds), peptides, antibodies, small molecules, and other agents capable of inhibiting the expression of the MaTAR.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating a MaTAR can mean to increase or decrease the level of the MaTAR in a cell, tissue, organ or organism. A "modulator" effects the change in the cell, tissue, organ or organism. For example, a compound can be a modulator of MaTAR that decreases the amount of MaTAR in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Nulliparous" is the medical term for a female who has never given birth to a viable, or live, baby.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an animal. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide.

"Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites," are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" a target nucleic acid means to reduce or block expression of the target nucleic acid while exhibiting fewer, minimal, or no effects on non-target nucleic acids reduction and does not necessarily indicate a total elimination of the target nucleic acid's expression.

"Standard cell assay" means assay(s) described in the Examples and reasonable variations thereof "Standard in vivo experiment" means the procedure(s) described in the Example(s) and reasonable variations thereof.

"Sugar moiety" means an unmodified sugar moiety or a modified sugar moiety. "Unmodified sugar moiety" or "unmodified sugar" means a 2'-OH(H) furanosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. "Modified sugar moiety" or "modified sugar" means a modified furanosyl sugar moiety or a sugar surrogate. "Modified furanosyl sugar moiety" means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or nucleic acids.

"Subcutaneous administration" means administration just below the skin.

"Target gene" refers to a gene encoding a target.

"Targeting" means specific hybridization of a compound that to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound described herein is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

Certain Embodiments

Certain embodiments provide methods, compounds, and compositions for modulating a breast cancer condition, or a symptom thereof, in an animal by administering a therapeutically effective amount of the compound or composition to the animal, wherein the compound or composition comprises a MaTAR modulator. Modulation of a MaTAR can lead to a decrease of the MaTAR level or expression in order to treat, prevent, ameliorate or delay breast cancer, or a symptom thereof. In certain embodiments, the MaTAR modulator is a MaTAR-specific inhibitor. In certain embodiments, MaTAR-specific inhibitors are nucleic acids (including antisense compounds), peptides, antibodies, small molecules, and other agents capable of inhibiting the expression of the MaTAR.

In certain embodiments disclosed herein, each MaTAR has the sequences recited in the Tables of the specification disclosed herein. In certain embodiments disclosed herein, each MaTAR has the human sequence recited in SEQ ID Nos: 1-111 and SEQ ID Nos: 193-280.

Certain embodiments disclosed herein provide compounds or compositions comprising a MaTAR modulator. In certain embodiments, the MaTAR modulator is a MaTAR-specific inhibitor. In certain embodiments, the MaTAR-specific inhibitor is a nucleic acid, polypeptide, antibody, small molecules, or other agent capable of inhibiting the expression of a MaTAR. In certain embodiments, the nucleic acid is a compound or composition targeting a MaTAR. In certain embodiments, the compound or composition is single stranded. In certain embodiments, the compound or composition is double stranded. In certain embodiments, the compound or composition targeting a MaTAR comprises an oligonucleotide. In certain embodiments, the oligonucleotide is single stranded. In certain embodiments, the compound comprises deoxyribonucleotides. In certain embodiments, the compound is double-stranded and comprises ribonucleotides. In certain embodiments, the oligonucleotide is a modified oligonucleotide. In certain embodiments, the modified oligonucleotide is single stranded. In any of the foregoing embodiments, the compound can be an antisense compound or oligomeric compound.

In any of the foregoing embodiments, the compound can consist of 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides. In certain embodiments, these compounds are oligonucleotides.

Certain embodiments disclosed herein provide a compound or composition comprising a modified oligonucleotide that is 10 to 30 linked nucleosides in length targeted to a MaTAR. The MaTAR target can have a nucleobase sequence selected from any one of SEQ ID NOs: 1-111 and SEQ ID Nos: 193-280. In certain embodiments, the nucleobase sequence of the modified oligonucleotide is at least 70%, 75%, 80%, 85%, 90%, 95% or 100% complementary to the nucleobase sequences recited in any one of SEQ ID NOs: 1-111 and SEQ ID Nos: 193-280 as measured over the entirety of the modified oligonucleotide. In certain embodiments, the modified oligonucleotide comprises a nucleobase sequence comprising a portion of at least 8, at least 9, at least 10, at least 11, at least 12, at least 13, at least 14, at least 15, or 16 contiguous nucleobases complementary to an equal length portion of SEQ ID NO: 1-111 and SEQ ID Nos: 193-280.

Certain embodiments provide a compound comprising a modified oligonucleotide 8 to 80 linked nucleosides in length and having a nucleobase sequence comprising the nucleobase sequence of any one of SEQ ID NOs: 112-156 and SEQ ID Nos: 169-192. In certain embodiments, the compound is an antisense compound or oligomeric compound. In certain embodiments, the compound is single-stranded. In certain embodiments, the compound is double-stranded. In certain embodiments, the modified oligonucleotide consists of 12 to 30 linked nucleosides.

Certain embodiments provide a compound comprising a modified oligonucleotide consisting of the nucleobase sequence of any one of SEQ ID NOs: 112-156 and SEQ ID Nos: 169-192. In certain embodiments, the compound is an antisense compound or oligomeric compound. In certain embodiments, the compound is single-stranded. In certain embodiments, the compound is double-stranded.

In certain embodiments, the modified oligonucleotide consists of 10 to 50, 10 to 30, 12 to 30, 13 to 24, 14 to 24, 15 to 30, 15 to 24, 15 to 20, 15 to 18, 16 to 30, 16 to 24, 16 to 20, 16 to 18, 18 to 24 or 19 to 22 linked nucleosides. In certain embodiments, the modified oligonucleotide consists of 8, 9, 10, 11, 12, 13, 14, 15, 16, 17, 18, 19, 20, 21, 22, 23, 24, 25, 26, 27, 28, 29 or 30 linked nucleosides or a range defined by any two of these values.

In certain embodiments, at least one internucleoside linkage of said modified oligonucleotide is a modified internucleoside linkage. In certain embodiments, each internucleoside linkage is a phosphorothioate internucleoside linkage.

In certain embodiments, any of the foregoing oligonucleotides comprises at least one modified sugar. In certain embodiments, at least one modified sugar comprises a 2'-O-methoxyethyl group. In certain embodiments, at least one modified sugar is a bicyclic sugar, such as a 4'-CH(CH$_3$)—O-2' group, a 4'-CH$_2$—O-2' group, or a 4'-(CH$_2$)$_2$—O-2' group.

In certain embodiments, at least one nucleoside of said modified oligonucleotide comprises a modified nucleobase. In certain embodiments, the modified nucleobase is a 5-methylcytosine.

Certain embodiments disclosed herein provide a compound or composition comprising a modified oligonucleotide with: a) a gap segment consisting of linked deoxynucleosides; b) a 5' wing segment consisting of linked nucleosides; and c) a 3' wing segment consisting of linked nucleosides. The gap segment is positioned between the 5' wing segment and the 3' wing segment and each nucleoside of each wing segment comprises a modified sugar. In certain embodiments, at least one internucleoside linkage is a phosphorothioate linkage. In certain embodiments, and at least one cytosine is a 5-methylcytosine.

Certain embodiments disclosed herein provide a method of reducing a MaTAR expression in an animal comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the compound comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

In certain embodiments, the compounds or compositions disclosed herein further comprise a conjugate group. In certain embodiments, the conjugate group is a carbohydrate group. In certain embodiments, the conjugate group is a GalNAc group.

In certain embodiments, the compounds or compositions disclosed herein comprise a salt of the compound. In certain embodiments, the compounds or compositions disclosed herein comprise a salt of the modified oligonucleotide. In certain embodiments, the salt is a sodium salt. In certain embodiments, the salt is a potassium salt.

In certain embodiments, the compounds or compositions disclosed herein further comprise a pharmaceutically acceptable carrier or diluent.

Certain embodiments disclosed herein provide a method of treating, preventing, delaying or ameliorating breast cancer in an animal comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the compound comprises an antisense compound or an oligomeric compound. In certain embodiments, the compound comprises a modified oligonucleotide In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments disclosed herein, the MaTAR has the human sequence recited in SEQ ID Nos: 1-111 and SEQ ID Nos: 193-280. In certain embodiments, the modified oligonucleotide consists of 10 to 30 linked nucleosides.

Certain embodiments disclosed herein provide a method of treating an animal at risk for breast cancer comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound. In certain embodiments, the compound comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of reducing tumor progression in an animal with breast cancer comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of reducing metastasis in an animal with breast cancer comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of reducing cell proliferation in an animal with breast cancer comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of a MaTAR In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of reducing tumor cell invasion in an animal with breast cancer comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of a MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of reducing collective cell migration in an animal with breast cancer comprising administering to the animal a compound or composition comprising a MaTAR-specific inhibitor. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of ameliorating breast cancer in an animal comprising administering to the animal a therapeutically effective amount of a compound or composition comprising a MaTAR-specific inhibitor. In certain embodiments, the breast cancer is luminal B breast cancer. In certain embodiments, the breast cancer is HER2/neu-amplified breast cancer. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the therapeutically effective amount of the compound or composition administered to the animal ameliorates breast cancer in the animal. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method for treating an animal at risk for breast cancer comprising administering to said animal a therapeutically effective amount of a compound or composition comprising a MaTAR-specific inhibitor. In certain embodiments, the breast cancer is luminal B breast cancer. In certain embodiments, the breast cancer is HER2/neu-amplified breast cancer. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the therapeutically effective amount of the compound or composition administered to the animal reduces the risk of breast cancer in the animal. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of differentiating a primary breast tumor in an animal comprising administering to the animal a therapeutically effective amount of a compound comprising a MaTAR-specific inhibitor. In certain embodiments, differentiation is specific to breast tumor tissue and not in normal mammary gland tissue. In certain embodiments, the MaTAR is expressed in breast tumors and not in normal mammary gland tissue. In certain embodiments, the breast tumor is luminal B breast cancer. In certain embodiments, the breast tumor is HER2/neu-amplified breast cancer. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the therapeutically effective amount of the compound or composition administered to the animal results in differentiation of the primary breast tumor in the animal. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain embodiments disclosed herein provide a method of modulating the gene expression pattern of a breast tumor in an animal comprising administering to the animal a therapeutically effective amount of a compound comprising a MaTAR-specific inhibitor to the animal. In certain embodiments, gene expression modulation is specific to breast tumor tissue and not in normal mammary gland tissue. In certain embodiments, the MaTAR is expressed in breast tumors and not in normal mammary gland tissue. In certain embodiments, the breast tumor is luminal B breast cancer. In certain embodiments, the breast tumor is HER2/neu-amplified breast cancer. In certain embodiments, the MaTAR-specific inhibitor is a nucleic acid, peptide, antibody, small molecule or other agent capable of inhibiting the expression of the MaTAR. In certain embodiments, the MaTAR-specific inhibitor comprises a compound described herein. In certain embodiments, the MaTAR-specific inhibitor comprises an antisense compound or an oligomeric compound. In certain embodiments, the compound comprises a modified oligonucleotide. In certain embodiments, the therapeutically effective amount of the compound or composition administered to the animal results in modulation of the gene expression of the primary breast tumor in the animal. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

In certain embodiments, the breast tumor or cancer is luminal B or HER2/neu-amplified subtypes of human breast cancer.

In certain embodiments, administering the compound or composition disclosed herein reduces the levels of tumor progression, metastasis, cell proliferation, tumor cell invasion, or collective cell migration, or a combination thereof. In certain embodiments, tumor cell invasion was independently reduced by at least 5%, at least 10%, at least 20%, at least 30%, at least 35%, at least 40%, at least 45% or at least 50%. In certain embodiments, tumor organoid branching was independently reduced by at least 5%, at least 10%, at least 20%, at least 30%, at least 35%, at least 40%, at least 45% or at least 50%. In certain embodiments, tumor cell viability was reduced by at least 5%, at least 10%, at least 20%, at least 30%, at least 35%, at least 40%, at least 45% or at least 50%.

Certain embodiments provide uses of the compounds and compositions described herein for inhibiting a MaTAR expression. In certain embodiments, the compounds or compositions inhibit a MaTAR by at least 5%, at least 10%, at least 20%, at least 30%, at least 35%, at least 40%, at least 45%, at least 50%, at least 55%, at least 60%, at least 65%, at least 70%, at least 75%, at least 80%, at least 85%, or at least 90%.

Certain embodiments provide uses of the compounds and compositions described herein for use in therapy. In certain embodiments, the therapy is used in treating, preventing, delaying the onset or slowing progression of a disease related to elevated expression of a MaTAR. In certain embodiments, the disease is breast cancer. In certain embodiments, the breast cancer is luminal B breast cancer. In certain embodiments, the breast cancer is HER2/neu-amplified breast cancer. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

In certain embodiments, the animal is a human.

In certain embodiments, administration comprises parenteral administration. In certain embodiments, parenteral administration comprises subcutaneous administration. In certain embodiments, parenteral administration comprises intravenous administration.

In certain embodiments, the compounds or compositions disclosed herein are designated as a first agent and the methods or uses disclosed herein further comprise administering a second agent. In certain embodiments, the first agent and the second agent are co-administered. In certain embodiments the first agent and the second agent are co-administered sequentially or concomitantly.

In certain embodiments, use of a compound or composition disclosed herein results in tumor cell invasion independently reduced by at least 5%, at least 10%, at least 20%, at least 30%, at least 35%, at least 40%, at least 45% or at least 50%. In certain embodiments, use of a compound or composition disclosed herein results in tumor organoid branching independently reduced by at least 5%, at least 10%, at least 20%, at least 30%, at least 35%, at least 40%, at least 45% or at least 50%. In certain embodiments, use of a compound or composition disclosed herein results in tumor cell viability reduced by at least 5%, at least 10%, at least 20%, at least 30%, at least 35%, at least 40%, at least 45% or at least 50%.

Certain embodiments provide the use of a compound or composition as described herein in the manufacture of a medicament for treating, ameliorating, delaying or preventing one or more diseases, disorders, conditions, symptoms or physiological markers associated with a MaTAR. In certain embodiments, the compound or composition as described herein is used in the manufacture of a medicament for treating, ameliorating, delaying or preventing breast cancer, or a symptom or physiological marker thereof. In certain embodiments, the breast cancer is luminal B breast cancer. In certain embodiments, the breast cancer is HER2/neu-amplified breast cancer. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides. In certain embodiments disclosed herein, the MaTAR has the human sequence recited in SEQ ID Nos: 1-111 and SEQ ID Nos: 193-280.

Certain Indications

Certain embodiments provided herein relate to methods of inhibiting a MaTAR expression, which can be useful for treating, preventing, or ameliorating a disease associated with a MaTAR in an individual, by administration of a compound that targets a MaTAR. In certain embodiments, such a compound is a MaTAR-specific inhibitor. In certain embodiments, the compound is an antisense compound or an oligomeric compound targeted to a MaTAR. In certain embodiments, the compound comprises a modified oligonucleotide targeted to a MaTAR.

In certain embodiments disclosed herein, MaTARs have the human and murine coordinates and sequences as set forth in the Tables in this specification and also as recited in SEQ ID Nos: 1-111 and SEQ ID Nos: 193-280.

Examples of diseases associated with a MaTAR treatable, preventable, and/or ameliorable with the methods provided herein include breast cancer. In certain embodiments, the breast cancer is luminal B breast cancer. In certain embodiments, the breast cancer is HER2/neu-amplified breast cancer.

In certain embodiments, a method of treating, preventing, or ameliorating a disease associated with a breast cancer in an individual comprises administering to the individual a MaTAR-specific inhibitor of a MaTAR, thereby treating, preventing, or ameliorating the disease. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be single-stranded. In any of the foregoing embodiments, the compound can be an antisense compound or oligomeric compound. In certain embodiments, the compound is administered to the individual parenterally. In certain embodiments, administering the compound improves, preserves, or prevents breast cancer. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In certain embodiments, a method of treating, preventing, or ameliorating tumor progression, metastasis, cell proliferation, tumor cell invasion, or collective migration comprises administering to the individual a MaTAR-specific inhibitor, thereby treating, preventing, or ameliorating tumor progression, metastasis, cell proliferation, tumor cell invasion, or collective migration. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be single-stranded. In any of the foregoing embodiments, the compound can be an antisense compound or oligomeric compound. In certain embodiments, the compound is administered to the individual parenterally. In certain embodiments, administering the compound improves, preserves, or prevents tumor progression, metastasis, cell proliferation, tumor cell invasion, or collective migration. In certain embodiments, the individual is identified as having or at risk of having a disease associated with a MaTAR. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In certain embodiments, a method of inhibiting expression of a MaTAR in an individual having, or at risk of having, a disease associated with breast cancer comprises administering a MaTAR-specific inhibitor to the individual, thereby inhibiting expression of a MaTAR in the individual. In certain embodiments, the individual has, or is at risk of having breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In certain embodiments, a method of inhibiting expression of a MaTAR in a cell comprises contacting the cell with a MaTAR-specific inhibitor, thereby inhibiting expression of a MaTAR in the cell. In certain embodiments, the cell is in an individual who has, or is at risk of having breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In certain embodiments, a method of reducing or inhibiting tumor progression, metastasis, cell proliferation, tumor cell invasion, or collective migration in an individual having, or at risk of having, a disease associated with breast cancer comprises administering a MaTAR-specific inhibitor to the individual, thereby reducing or inhibiting tumor progression, metastasis, cell proliferation, tumor cell invasion, or collective migration in the individual. In certain embodiments, the individual has, or is at risk of having, breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

Certain embodiments are drawn to a MaTAR-specific inhibitor for use in treating a disease associated with breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

Certain embodiments are drawn to a MaTAR-specific inhibitor for use in reducing or inhibiting tumor progression, metastasis, cell proliferation, tumor cell invasion, or collective migration in an individual having or at risk of having breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

Certain embodiments are drawn to use of a MaTAR-specific inhibitor for the manufacture of a medicament for treating a disease associated with breast cancer. Certain embodiments are drawn to use of a MaTAR-specific inhibitor for the preparation of a medicament for treating breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

Certain embodiments are drawn to use of a MaTAR-specific inhibitor for the manufacture of a medicament for reducing or inhibiting tumor progression, metastasis, cell proliferation, tumor cell invasion, or collective migration in an individual having or at risk of having breast cancer. In certain embodiments, the breast cancer is luminal B breast cancer. In certain embodiments, the breast cancer is HER2/neu-amplified breast cancer. In certain embodiments, the MaTAR-specific inhibitor is a compound targeted to a MaTAR, such as an oligonucleotide targeted to a MaTAR. In certain embodiments, the MaTAR-specific inhibitor is a compound comprising a modified oligonucleotide consisting of 8 to 80 linked nucleosides and having a nucleobase sequence complementary to any of the nucleobase sequences of SEQ ID NOs: 1-111 and SEQ ID Nos: 193-280. In any of the foregoing embodiments, the compound can be an antisense compound or oligomeric compound. In any of the foregoing embodiments, the compound can be single-stranded or double-stranded. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In any of the foregoing methods or uses, the compound can be an antisense compound targeted to a MaTAR. In certain embodiments, the compound comprises an oligonucleotide, for example an oligonucleotide consisting of 8 to 80 linked nucleosides, 10 to 30 linked nucleosides, 12 to 30 linked nucleosides, or 20 linked nucleosides. In certain embodiments, the oligonucleotide is at least 80%, 85%, 90%, 95% or 100% complementary to any of the nucleobase sequences recited in SEQ ID NOs: 1-111 and SEQ ID Nos: 193-280. In certain embodiments, the oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In any of the foregoing embodiments, the oligonucleotide consists of 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides. In certain aspects, the oligonucleotide is at least 80%, 85%, 90%, 95% or 100% complementary to any of the nucleobase sequences recited in SEQ ID NOs: 1-111 and SEQ ID Nos: 193-280. In certain aspects, the oligonucleotide comprises at least one modified internucleoside linkage, at least one modified sugar and/or at least one modified nucleobase. In certain aspects, the modified internucleoside linkage is a phosphorothioate internucleoside linkage, the modified sugar is a bicyclic sugar or a 2'-O-methoxyethyl, and the modified nucleobase is a 5-methylcytosine. In certain aspects, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In any of the foregoing methods or uses, the compound comprises or consists of a modified oligonucleotide 12 to 30 linked nucleosides in length and having a nucleobase sequence complementary to any one of SEQ ID NOs: 1-111 and SEQ ID Nos: 193-280, wherein the modified oligonucleotide comprises:
   a gap segment consisting of linked 2'-deoxynucleosides;
   a 5' wing segment consisting of linked nucleosides; and
   a 3' wing segment consisting of linked nucleosides;
   wherein the gap segment is positioned between the 5' wing segment and the 3' wing segment and wherein each nucleoside of each wing segment comprises a modified sugar. In certain embodiments, the compound or composition comprises a modified oligonucleotide 8 to 80 linked nucleosides in length and having a nucleobase sequence comprising at least an 8, 9, 10, 11, 12, 13, 14, 15, or 16 contiguous nucleobase portion of any one of SEQ ID NOs: 112-156 and SEQ ID Nos: 169-192. In certain embodiments, the modified oligonucleotide consists of 10 to 30 linked nucleosides.

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration.

Certain Compounds

In certain embodiments, compounds described herein are antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, each modified oligonucleotide is 12-30 linked nucleosides in length.

In certain embodiments, compounds are double-stranded. Such double-stranded compounds comprise a first oligomeric compound having a region complementary to a target nucleic acid and a second oligomeric compound having a region complementary to the first oligomeric compound. The first oligomeric compound of such double stranded compounds typically comprises or consists of a modified oligonucleotide and optionally a conjugate group. The oligonucleotide of the second oligomeric compound of such double-stranded compound may be modified or unmodified. Either or both oligomeric compounds of a double-stranded compound may comprise a conjugate group. The oligomeric compounds of double-stranded compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 10 to 30 linked subunits in length. In certain embodiments, compound described herein comprises an oligonucleotide is 12 to 30 linked subunits in length. In certain embodiments, compound described herein comprises an oligonucleotide is 12 to 22 linked subunits in length. In certain embodiments, compound described herein comprises an oligonucleotide is 14 to 30 linked subunits in length. In certain embodiments, compound described herein comprises an oligonucleotide is 14 to 20 linked subunits in length. In certain embodiments, compound described herein comprises an oligonucleotide is 15 to 30 linked subunits in length. In certain embodiments, compound described herein comprises an oligonucleotide is 15 to 20 linked subunits in length. In certain embodiments, compound described herein comprises an oligonucleotide is 16 to 30 linked subunits in length. In certain embodiments, compound described herein comprises an oligonucleotide is 16 to 20 linked subunits in length. In certain embodiments, compound described herein comprises an oligonucleotide is 17 to 30 linked subunits in length. In certain embodiments, compound described herein comprises an oligonucleotide is 17 to 20 linked subunits in length. In certain embodiments, compound described herein comprises an oligonucleotide is 18 to 30 linked subunits in length. In certain embodiments, compound described herein comprises an oligonucleotide is 18 to 21 linked subunits in length. In certain embodiments, compound described herein comprises an oligonucleotide is 18 to 20 linked subunits in length. In certain embodiments, compound described herein comprises an oligonucleotide is 20 to 30 linked subunits in length. In other words, such oligonucleotides are from 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, a compound described herein comprises an oligonucleotide 14 linked subunits in length. In certain embodiments, a compound described herein comprises an oligonucleotide 16 linked subunits in length. In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to a MaTAR nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. (Proc. Natl. Acad. Sci. USA 89:7305-7309, 1992; Gautschi et al. *J. Natl. Cancer Inst.* 93:463-471, March 2001; Maher and Dolnick *Nuc. Acid. Res.* 16:3341-3358, 1988). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics.

In certain embodiments, a double-stranded compound described herein can comprise any of the oligonucleotide sequences targeted to a MaTAR described herein. In certain embodiments, a double-stranded compound comprises a first strand comprising sequence complementary to any one of SEQ ID NOs: 1-111 and SEQ ID Nos: 193-280 and a second strand.

In certain embodiments, a double-stranded compound comprises a first strand comprising the nucleobase sequence complementary to any one of SEQ ID NOs: 1-111 and SEQ ID Nos: 193-280 and a second strand. In certain embodiments, the double-stranded compound comprises ribonucleotides in which the first strand has uracil (U) in place of thymine (T) and is complementary to any one of SEQ ID NOs: 1-111 and SEQ ID Nos: 193-280. In certain embodiments, a double-stranded compound comprises (i) a first strand comprising a nucleobase sequence complementary to the site on a MaTAR of any of SEQ ID NOs: 1-111 and SEQ ID Nos: 193-280, and (ii) a second strand. In certain embodiments, the double-stranded compound comprises one or more modified nucleotides in which the 2' position in the sugar contains a halogen (such as fluorine group; 2'-F) or contains an alkoxy group (such as a methoxy group; 2'-OMe). In certain embodiments, the double-stranded compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the double-stranded compound comprises one or more linkages between adjacent nucleotides other than a naturally-occurring phosphodiester linkage. Examples of such linkages include phosphoramide, phosphorothioate, and phosphorodithioate linkages. The double-stranded compounds may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000. In certain embodiments, the first strand of the double-stranded compound is an siRNA guide strand and the second strand of the double-stranded compound is an siRNA passenger strand. In certain embodiments, the second strand of the double-stranded compound is complementary to the first strand. In certain embodiments, each strand of the double-stranded compound consists of 16, 17, 18, 19, 20, 21, 22, or 23 linked nucleosides. In certain embodiments, the first or second strand of the double-stranded compound can comprise a conjugate group.

In certain embodiments, a single-stranded compound described herein can comprise any of the oligonucleotide sequences targeted to a MaTAR described herein. In certain embodiments, such a single-stranded compound is a single-stranded RNAi (ssRNAi) compound. In certain embodiments, a ssRNAi compound comprises at least an 8, 9, 10, 11, 12, 13, 14, 15, 16, 17, 18, 19, or 20 contiguous nucleobase portion complementary to any one of SEQ ID NOs: 1-111 and SEQ ID Nos: 193-280. In certain embodiments, a ssRNAi compound comprises the nucleobase sequence complementary to any one of SEQ ID NOs: 1-111 and SEQ ID Nos: 193-280. In certain embodiments, the ssRNAi compound comprises ribonucleotides in which uracil (U) is in place of thymine (T). In certain embodiments, ssRNAi compound comprises a nucleobase sequence complementary to the site on a MaTAR with any of the the sequences of SEQ ID NOs: 1-111 and SEQ ID Nos: 193-280. In certain embodiments, a ssRNAi compound comprises one or more modified nucleotides in which the 2' position in the sugar contains a halogen (such as fluorine group; 2'-F) or contains an alkoxy group (such as a methoxy group; 2'-OMe). In certain embodiments, a ssRNAi compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the ssRNAi compound. In certain embodiments, the ssRNAi compound comprises one or more linkages between adjacent nucleotides other than a naturally-occurring phosphodiester linkage. Examples of such linkages include phosphoramide, phosphorothioate, and phosphorodithioate linkages. The ssRNAi compounds may also be chemically modified nucleic acid molecules as taught in U.S. Pat. No. 6,673,661. In other embodiments, the ssRNAi contains a capped strand, as disclosed, for example, by WO 00/63364, filed Apr. 19, 2000. In certain embodiments, the ssRNAi compound consists of 16, 17, 18, 19, 20, 21, 22, or 23 linked nucleosides. In certain embodiments, the ssRNAi compound can comprise a conjugate group.

In certain embodiments, compounds described herein comprise modified oligonucleotides. Certain modified oligonucleotides have one or more asymmetric center and thus give rise to enantiomers, diastereomers, and other stereoisomeric configurations that may be defined, in terms of absolute stereochemistry, as (R) or (S), as a or 13 such as for sugar anomers, or as (D) or (L) such as for amino acids etc. Included in the modified oligonucleotides provided herein are all such possible isomers, including their racemic and optically pure forms, unless specified otherwise. Likewise, all cis- and trans-isomers and tautomeric forms are also included.

Certain Mechanisms

In certain embodiments, compounds described herein comprise or consist of modified oligonucleotides. In certain embodiments, compounds described herein are antisense compounds. In certain embodiments, such antisense compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such selective compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain such embodiments, the target nucleic acid is selected from: an mRNA and a pre-mRNA, including intronic, exonic and untranslated regions. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target region is an lncRNA.

Human gene sequences that encode a MaTAR include, without limitation, the following gene sequences, as listed in the Tables below:

TABLE 1

Bioinformatically identified human gene sequences for MaTARs identified in murine models of human breast cancer

| MaTAR # | Human gene sequence | SEQ ID NO |
|---|---|---|
| 1 | The complement of NC_000005.10 truncated from nucleotides 88540779 to 88684803 | 1 |
| 2 | The complement of NC_000016.10 truncated from nucleotides 66932055 to 66934423 | 2 |
| 3 | The complement of NC_000004.12 truncated from nucleotides 90121784 to 90121954 | 3 |
| 4 | NC_000007.14 truncated from nucleotides 27096094 to 27100258 | 4 |
| 5 | NC_000021.9 truncated from nucleotides 18857779 to 18858276 | 5 |
| 6 | NC_000006.12 truncated from nucleotides 30766825 to 30792250 | 6 |
|   | The complement of NC_000006.12 truncated from nucleotides 30812866-30830659 | 7 |
| 7 | The complement of NC_000001.11 truncated from nucleotides 47432133 to 47434641 | 8 |
| 8 | NC_000018.10 truncated from nucleotides 48955665 to 48956059 | 9 |
|   | The complement of NC_000018.10 truncated from nucleotides 48962951 to 48963941 | 10 |
| 9 | NC_000007.14 truncated from nucleotides 99374675 to 99394781 | 11 |
|   | The complement of NC_000007.14 truncated from nucleotides 99394676 to 99408682 | 12 |
| 10 | The complement of NC_000001.11 truncated from nucleotides 183555563 to 183590876 | 13 |
|   | The complement of NC_000005.10 truncated from nucleotides 56504635 to 56505072 | 14 |
|   | NC_000005.10 truncated from nucleotides 56381781 to 56382075 | 15 |
|   | The complement of NC_000005.10 truncated from nucleotides 56275304 to 56276630 | 16 |
|   | The complement of NC_000005.10 truncated from nucleotides 56504635 to 56505073 | 17 |
| 11 | NC_000009.12 truncated from nucleotides 104927553 to 104928892 | 18 |
| 12 | The complement of NC_000003.12 truncated from nucleotides 141050613 to 141052013 | 19 |
|   | The complement of NC_000003.12 truncated from nucleotides 141115124 to 141124182 | 20 |
| 13 | NC_000002.12 truncated from nucleotides 230125310 to 230167494 | 21 |
| 14 | The complement of NC_000002.12 truncated from nucleotides 230309741 to 230311581 | 22 |
|   | The complement of NC_000002.12 truncated from nucleotides 230401360 to 230401793 | 23 |
| 15 | NC_000023.11 truncated from nucleotides 148052233 to 148052746 | 24 |
|   | The complement of NC_000023.11 truncated from nucleotides 30290047 to 30290351 | 25 |
|   | The complement of NC_000023.11 truncated from nucleotides 30017160 to 30017881 | 26 |
| 16 | NC_000001.11 truncated from nucleotides 55217861 to 55234177 | 27 |
|   | NC_000001.11 truncated from nucleotides 55215408 to 55217455 | 28 |
| 17 | NC_000007.14 truncated from nucleotides 101299613 to 101301270 | 29 |
|   | NC_000007.14 truncated from nucleotides 101308346 to 101310985 | 30 |

TABLE 1-continued

Bioinformatically identified human gene sequences for MaTARs identified in murine models of human breast cancer

| MaTAR # | Human gene sequence | SEQ ID NO |
|---|---|---|
|  | The complement of NC_000007.14 truncated from nucleotides 101287482 to 101289771 | 31 |
| 18 | NC_000001.11 truncated from nucleotides 51329654 to 51331281 | 32 |
| 19 | NC_000007.14 truncated from nucleotides 100509717 to 100519926 | 33 |
| 20 | NC_000009.12 truncated from nucleotides 137286112 to 137287236 | 34 |
|  | The complement of NC_000009.12 truncated from nucleotides 137293868 to 137295721 | 35 |
| 21 | NC_000022.11 truncated from nucleotides 31617011 to 31617070 | 36 |
| 22 | NC_000008.11 truncated from nucleotides 58503588 to 58504068 | 37 |
| 23 | The complement of NC_000005.10 truncated from nucleotides 70968483 to 71025114 | 38 |
| 24 | NC_000013.11 truncated from nucleotides 81689911 to 81691072 | 39 |
|  | The complement of NC_000009.12 truncated from nucleotides 36303499 to 36304924 | 40 |
| 25 | The complement of NC_000020.11 truncated from nucleotides 50310711 to 50321342 | 41 |
|  | NC_000020.11 truncated from nucleotides 50292720 to 50314922 | 42 |
|  | NC_000020.11 truncated from nucleotides 50267486 to 50279795 | 43 |
| 26 | NC_000006.12 truncated from nucleotides 144216543 to 144216627 | 44 |
|  | The complement of NC_000006.12 truncated from nucleotides 144200447 to 144200965 | 45 |
|  | The complement of NC_000006.12 truncated from nucleotides 144257034 to 144257624 | 46 |
| 27 | The complement of NC_000007.14 truncated from nucleotides 5527155 to 5529569 | 47 |
|  | NC_000023.11 truncated from nucleotides 53001527 to 53001617 | 48 |
| 28 | NC_000001.11 truncated from nucleotides 55222379 to 55223372 | 49 |
|  | NC_000001.11 truncated from nucleotides 55217861 to 55234178 | 50 |
|  | NC_000001.11 truncated from nucleotides 55215408 to 55217456 | 51 |
| 29 | The complement of NC_000011.10 truncated from nucleotides 59781318 to 59781722 | 52 |
|  | The complement of NC_000018.10 truncated from nucleotides 50256036 to 50256461 | 53 |
| 30 | The complement of NC_000015.10 truncated from nucleotides 74976240 to 74976573 | 54 |
|  | The complement of NC_000015.10 truncated from nucleotides 74983274 to 74983376 | 55 |
|  | The complement of NC000011.10 truncated from nucleotides 59781318 to 59781723 | 56 |

The human equivalent gene sequences that were found to be upregulated in mammary carcinoma tissue (as exemplified in the Examples below) are further provided in the Table below:

TABLE 2

Human equivalent gene sequences of lncRNAs

| Gene name | Gene sequence | SEQ ID NO |
|---|---|---|
| predicted gene, OTTMUSG00000005723 | NC_000005.10 truncated from nucleotides 154993598 to 154994445 | 57 |
| ENSMUST00000180755 | NC_000012.12 truncated from nucleotides 6533927 to 6538371 | 58 |
| ENSMUST00000180755 | The complement of NC_000004.12 truncated from nucleotides 77350370 to 77351235 | 59 |

TABLE 2-continued

Human equivalent gene sequences of lncRNAs

| Gene name | Gene sequence | SEQ ID NO |
|---|---|---|
| ENSMUST00000180755 | The complement of NC_000004.12 truncated from nucleotides 77311397 to 77312111 | 60 |
| ENSMUST00000180755 | The complement of NC_000004.12 truncated from nucleotides 77216416 to 77216878 | 61 |
| ENSMUST00000187117 | NC_000006.12 truncated from nucleotides 69745871 to 69746851 | 62 |
| ENSMUST00000187117 | The complement of NC_000006.12 truncated from nucleotides 69705287 to 69706160 | 63 |
| ENSMUST00000187117 | The complement of NC_000006.12 truncated from nucleotides 70098390 to 70098676 | 64 |
| ENSMUST00000181833 | NC_000004.12 truncated from nucleotides 128768228 to 128769948 | 65 |
| ENSMUST00000181833 | The complement of NC_000004.12 truncated from nucleotides 128582999 to 128601400 | 66 |
| ENSMUST00000186885 | NC_000002.12 truncated from nucleotides 125710969 to 125765842 | 67 |
| ENSMUST00000186885 | The complement of NC_000002.12 truncated from nucleotides 126110099 to 126117985 | 68 |
| ENSMUST00000187677 | NC_000002.12 truncated from nucleotides 192629919 to 192645706 | 69 |
| ENSMUST00000187677 | The complement of NC_000002.12 truncated from nucleotides 192644102 to 192645387 | 70 |
| ENSMUST00000187677 | NC_000002.12 truncated from nucleotides 192749845 to 192776899 | 71 |
| ENSMUST00000189594 | The complement of NC_000001.11 truncated from nucleotides 224175476 to 224175706 | 72 |
| ENSMUST00000189594 | The complement of NC_000001.11 truncated from nucleotides 224208747 to 224213279 | 73 |
| ENSMUST00000189594 | NC_000001.11 truncated from nucleotides 224219613 to 224228043 | 74 |
| ENSMUST00000191042 | NC_000005.10 truncated from nucleotides 102144077 to 102146572 | 75 |
| ENSMUST00000192612 | NC_000003.12 truncated from nucleotides 143111802 to 143112359 | 76 |
| ENSMUST00000195727 | The complement of NC_000008.11 truncated from nucleotides 81275399 to 81277570 | 77 |
| ENSMUST00000195727 | The complement of NC_000008.11 truncated from nucleotides 81279871 to 81281446 | 78 |
| ENSMUST00000195727 | NC_000008.11 truncated from nucleotides 81154279 to 81159083 | 79 |
| ENSMUST00000197386 | The complement of NC_000004.12 truncated from nucleotides 106003317 to 106022478 | 80 |
| ENSMUST00000199279 | NC_000012.12 truncated from nucleotides 121190868 to 121191518 | 81 |
| ENSMUST00000199279 | NC_000012.12 truncated from nucleotides 121391962 to 121399859 | 82 |
| ENSMUST00000200473 | NC_000004.12 truncated from nucleotides 16178939 to 16183120 | 83 |
| ENSMUST00000200473 | NC_000004.12 truncated from nucleotides 16400430 to 16512187 | 84 |
| ENSMUST00000123623 | NC_000011.10 truncated from nucleotides 30584130 to 30630508 | 85 |
| ENSMUST00000139492 | The complement of NC_000002.12 truncated from nucleotides 188035596 to 188287691 | 86 |
| ENSMUST00000143673 | The complement of NC_000017.11 truncated from nucleotides 35540039 to 35540797 | 87 |
| ENSMUST00000155384 | The complement of NC_000017.11 truncated from nucleotides 77879027 to 77884087 | 88 |
| ENSMUST00000181029 | The complement of NC_000006.12 truncated from nucleotides 35733867 to 35736947 | 89 |
| ENSMUST00000185425 | NC_000002.12 truncated from nucleotides 234682668 to 234717764 | 90 |
| ENSMUST00000185425 | The complement of NC_000002.12 truncated from nucleotides 234882279 to 234888802 | 91 |
| ENSMUST00000191737 | NC_000001.11 truncated from nucleotides 111250254 to 111256715 | 92 |
| ENSMUST00000191737 | The complement of NC_000001.11 truncated from nucleotides 111184415 to 111185061 | 93 |
| ENSMUST00000196337 | NC_000004.12 truncated from nucleotides 128428070 to 128519394 | 94 |
| ENSMUST00000196668 | The complement of NC_000001.11 truncated from nucleotides 87353524 to 87371655 | 95 |
| ENSMUST00000196668 | The complement of NC_000001.11 truncated from nucleotides 87899909 to 87905714 | 96 |

TABLE 2-continued

Human equivalent gene sequences of lncRNAs

| Gene name | Gene sequence | SEQ ID NO |
|---|---|---|
| ENSMUST00000196668 | The complement of NC_000001.11 truncated from nucleotides 87805286 to 87808372 | 97 |
| ENSMUST00000198677 | The complement of NC_000004.12 truncated from nucleotides 16360686 to 16361826 | 98 |
| ENSMUST00000198677 | NC_000004.12 truncated from nucleotides 16400430 to 16512188 | 99 |
| ENSMUST00000200327 | NC_000004.12 truncated from nucleotides 104490965 to 104697592 | 100 |
| ENSMUST00000200327 | NC_000004.12 truncated from nucleotides 104973712 to 105120000 | 101 |
| ENSMUST00000200327 | The complement of NC_000004.12 truncated from nucleotides 104653874 to 104966793 | 102 |
| ENSMUST00000188231 | NC_000006.12 truncated from nucleotides 69745871 to 69746852 | 103 |
| ENSMUST00000188231 | The complement of NC_000006.12 truncated from nucleotides 69705287 to 69706161 | 104 |
| ENSMUST00000188231 | The complement of NC_000006.12 truncated from nucleotides 70098390 to 70098677 | 105 |
| ENSMUST00000187714 | NC_000006.12 truncated from nucleotides 69745870 to 69746851 | 106 |
| ENSMUST00000187714 | The complement of NC_000006.12 truncated from nucleotides 69705286 to 69706160 | 107 |
| ENSMUST00000187714 | The complement of NC_000006.12 truncated from nucleotides 70098389 to 70098676 | 108 |
| ENSMUST00000146576 | The complement of NC_000009.12 truncated from nucleotides 36303499 to 36304925 | 109 |
| ENSMUST00000195679 | NC_000001.11 truncated from nucleotides 55215407 to 55217455 | 110 |
| ENSMUST00000195679 | NC_000001.11 truncated from nucleotides 55217860 to 55234177 | 111 |

Hybridization

In some embodiments, hybridization occurs between a compound disclosed herein and a MaTAR nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a MaTAR nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a MaTAR nucleic acid may be tolerated provided that the compound remains able to specifically hybridize to a target nucleic acid. Moreover, a compound may hybridize over one or more segments of a MaTAR nucleic acid such that intervening or adjacent segments are not involved in the hybridization event (e.g., a loop structure, mismatch or hairpin structure).

In certain embodiments, the compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a MaTAR nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of a compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a MaTAR nucleic acid, or a target region, or a target segment or target sequence thereof. As used herein, "fully complementary" means each nucleobase of a compound is capable of precise base pairing with the corresponding nucleobases of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a MaTAR nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a MaTAR nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific Isis number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of an compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific Isis number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein are antisense compounds. In certain embodiments, a portion of the compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein are oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more acyclic substituent, including but not limited to substituents at the 2', 4', and/or 5' positions. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for linearlynon-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH2-O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., *J. Org. Chem.*, 2009, 74, 118-134), 4'-CH$_2$—C(=CH$_2$)-2' and analogs thereof (see e.g., Seth et al., U.S. Pat. No. 8,278, 426), 4'-C(R$_a$R$_b$)—N(R)—O-2', 4'-C(R$_a$R$_b$)—O—N(R)-2', 4'-CH2-O—N(R)-2', and 4'-CH2-N(R)—O-2', wherein each R, R$_a$, and R$_b$ is, independently, H, a protecting group, or C$_1$-C$_{12}$ alkyl (see, e.g. Imanishi et al., U.S. Pat. No. 7,427, 672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 20017, 129, 8362-8379; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. Pat. No. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 91999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

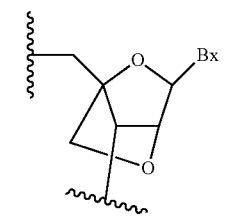

LNA (β-D-configuration)
bridge = 4'-CH$_2$—O-2'

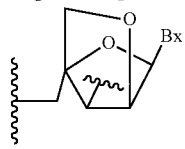

α-L-LNA (α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. *Bioorg. & Med. Chem.* 2002, 10, 841-854), fluoro HNA:

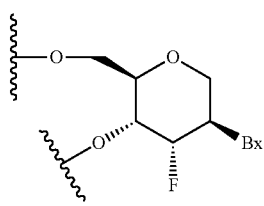

F-HNA ("F-HNA", see e.g., Swayze et al., U.S. Pat. No. 8,088,904; Swayze et al., U.S. Pat. No. 8,440,803; Swayze et al., U.S.; and Swayze et al., U.S. Pat. No. 9,005,906, F-HNA can also be referred to as a F-THP or 3'-fluoro tetrahydropyran), and nucleosides comprising additional modified THP compounds having the formula:

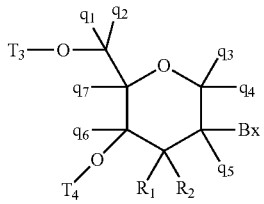

wherein, independently, for each of said modified THP nucleoside: Bx is a nucleobase moiety; $T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

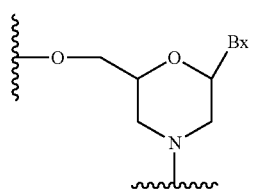

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to compounds described herein.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH3) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

In certain embodiments, compounds targeted to a MaTAR nucleic acid comprise one or more modified nucleobases. In certain embodiments, the modified nucleobase is 5-methylcytosine. In certain embodiments, each cytosine is a 5-methylcytosine.

Modified Internucleoside Linkages

The naturally occurring internucleoside linkage of RNA and DNA is a 3' to 5' phosphodiester linkage. In certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

In certain embodiments, compounds targeted to a MaTAR nucleic acid comprise one or more modified internucleoside linkages. In certain embodiments, the modified internucleoside linkages are phosphorothioate linkages. In certain embodiments, each internucleoside linkage of the compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH2-N(CH3)-O—CH2-), thiodiester, thionocarbamate (—O—C(=O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(=O)—N(H)-5'), amide-4 (3'-CH2-N(H)—C(=O)-5'), formacetal (3'-O—CH2-O-5'), methoxypropyl, and thioformacetal (3'-S—CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH2 component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides of the present invention comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

B. Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3¹-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

2. Certain Nucleobase Motifs In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified.

C. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide of a compound is modified. In certain embodiments, the oligonucleotide of a compound may have any nucleobase sequence. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript. In certain embodiments, oligonucleotides are complementary to a long non-coding RNA (lncRNA).

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., *Proc. Natl. Acad. Sci. USA,* 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid, a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; doi:10.1038/mtna.2014.72 and Nishina et al., *Molecular Therapy,* 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

In certain embodiments, the present invention provides pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to a MaTAR nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to a MaTAR nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound.

In certain embodiments, the compounds or compositions further comprise a pharmaceutically acceptable carrier or diluent.

RNA-Sequencing

Total RNA was isolated either directly from cryosections of the tumor tissue or from organotypic epithelial cultures using TRIzol (Life Technologies) according to the manufacturer's instructions. For tissue sections, the tumors were embedded in OCT and cryosectioned. Sections from the middle of the tumor were stained using toluidine blue (Sigma) and assayed regarding the homogeneity of the section. Homogenous 30 μm sections comprising >90% malignant cells were immediately dispersed and homogenized in TRIzol. RNA quality was assayed by running an RNA 6000 Nano chip on a 2100 Bioanalyzer (Agilent). For high-throughput sequencing, RNA samples were required to have an RNA integrity number (RIN) ≥9. TruSeq (Illumina) libraries for polyA+RNA-Seq were prepared from 0.5-1 μg RNA per sample. To ensure efficient cluster generation, an additional gel purification step of the libraries was applied. The libraries were multiplexed (4-6 libraries per lane) and sequenced paired-end 101 bp on the HiSeq2000 platform (Illumina), resulting in on average 40 Mio reads per library.

Computational Analysis

The quality of the raw data was evaluated using FastQC (http://www.bioinformatics.babraham.ac.uk/projects/fastqc/), and reads were mapped to mm10 using STAR v2.4.1 (Dobin et al. Bioinformatics 29: 15-21, 2012), resulting in an overall mapping efficiency of >90%. The GENCODE mV5 GTF was used as a reference and the reads per gene record were counted using the HTSeq package v0.5.4p5 (Anders et al. Bioinformatics 31: 166-169, 2015) and parameters -m union -s no. Differential gene expression was performed with DESeq2 v1.8.1 (Love et al. Genome Biol. 15: 550, 2014). An adjusted p-value of <0.1 was set as threshold for statistical significance of differential gene expression. Functional analysis of KEGG pathways was carried out using the R/Bioconductor packages GAGE (Luo et al. BMC Bioinformatics 10: 161, 2009) and Pathview (Luo and Brouwer, Bioinformatics 29: 1830-1831, 2013). Gene set enrichment analysis was performed using the javaGSEA desktop application (Subramanian et al. 2005). Gene ontology (GO) analysis was carried out using GOrilla (Eden et al. BMC Bioinformatics 10: 48, 2009) separately on genes up- or down-regulated compared to normal mammary gland organoids.

Weighted Gene Coexpression Network Analysis

Weighted gene coexpression network analysis (WGCNA) was carried out as described previously (Bergmann et al. Genome Res. 2015). Briefly, ENCODE data sets (CSHL long RNA sequencing), ESC data as well as the tumor and organoid RNA-Seq datasets were used as input. We performed variance-stabilizing transformation of HTSeq-generated counts and averaged the counts from replicate samples. The WGCNA R package (Langfelder and Horvath BMC Bioinformatics 9: 559, 2008) was used with a value of β=5 as empirically chosen soft-threshold. This analysis identified 39 modules with a median gene number of 274.

Identification of Human MaTAR Counterparts

To identify human counterparts of MaTARs, mouse and human transcripts were compared on the level of both sequence conservation and genomic location.

First, the mouse MaTAR sequence (mm10) was extracted and screened for transcripts with sequence overlap in the human genome (hg38) using the BLAT alignment tool. If the mouse MaTAR sequence overlapped significantly with an annotated human transcript, this transcript was defined as the human counterpart. For some candidates, sequence identities of up to 70% were obtained while any sequence overlap for others was not observed. Next, the analysis was extended to conserved genomic location (=synteny) by analyzing the nearest neighboring genes of each MaTAR. This was carried out using the UCSC Genome Browser. For instance, if the genomic location of a MaTAR is in close proximity to a protein-coding gene, the surrounding genomic position of the same protein-coding gene in the human genome was screened. Many non-coding RNAs are conserved between different species on the level of genomic location rather than based on sequence, implying functional conservation. Human counterparts for almost all MaTARs were identified based on synteny. In several cases, we observed conservation on both sequence and synteny levels.

Advantages of Certain Embodiments

An RNA-Seq screen was performed to identify lncRNAs that are up-regulated in mammary tumors.

A total of 290 lncRNAs that are up-regulated at least two-fold in tumors were identified. Antisense inhibition of several of these transcripts, particularly, MaTAR transcripts, lead to a reduction or complete loss of organoid branching. Provided herein, for the first time, are methods and compositions for the modulation of a MaTAR that can treat, delay, prevent and/or ameliorate a breast cancer disorder or condition, or a physiological marker thereof. In a particular embodiment, for the first time, MaTAR inhibitors (e.g., oligonucleotides targeting a nucleic acid encoding a MaTAR) are provided for reducing tumor progression, metastasis, cell proliferation, tumor cell invasion, an/or collective cell migration in an animal.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Comparison of the Transcriptome of Mammary Tumors and Corresponding Organoids The expression of several breast cancer markers, such as estrogen receptor (ER), progesterone receptor (PR), and ER-negative (HER2/neu-amplified and basal-like), from mammary tumors of comparable volume and histological profile, were measured. The mammary tumors were from 3 MMTV-PyMT mice, which is a physiologically relevant mouse model of luminal B subtype of breast cancer.

Organoids from WT nulliparous mammary glands, MMTV-PyMT tumors and MMTV-Neu-NDL tumors were prepared and cultured as described in Ewald Cold Spring Harb. Protoc. 2013: 130-133, 2013. For MMTV-PyMT mice, individual tumors were isolated and organoids were generated in a tumor-specific manner. Mammary epithelial fragments (organoids) were mixed with growth factor-reduced matrigel (Corning) at a concentration of 5 organoids/μL and plated as 80 μL domes in Cellstar 24-well dishes (Greiner Bio One). Organoids were grown in DMEM/F12 medium supplemented with 1×ITS (insulin, transferrin, and sodium selenite) media supplement (Sigma), 1% penicillin/streptomycin, and 2.5 nM murine FGF2 (Peprotech). Comparative RNA-Seq analyses revealed that the global gene expression signature of mammary organoids correlates well with the tumor transcriptome (Pearson correlation coefficient=0.82 for day 0 and 0.84 for day 6). Thus, the first direct transcriptomic comparison of cultured organoids and the tumors they were derived from demonstrates that the gene expression signature of day 6 mammary organoids closely resembles the tumor transcriptome and represents a reliable model system to study the expression of non-coding RNAs. The RNA-Seq data presented here is also publicly available at the NCBI Gene Expression Omnibus (GEO; http://www.ncbi/nlm/nih.gov/geo) under accession number GSE72823.

Example 2: Transcriptome of Luminal B and HER2-Amplified Mammary Tumors

RNA-Seq analysis was performed on physiologically relevant transgenic mouse models of luminal B (MMTV-PyMT) and HER2/neu-amplified (MMTV-Neu-NDL and MMTV-Cre; Flox-Neo-Neu-NT) subtypes of breast cancer (Guy et al, Mol. Cell Biol. 12: 954-961, 1992; Siegel et al, EMBO J. 18: 2149-2164, 1999; Andrechek et al, Proc. Natl. Acad. Sci. USA 97: 3444-3449, 2000).

To identify the complement of lncRNAs expressed in different subtypes of mammary carcinomas, organoids were generated from 5 MMTV-PyMT and 3 MMTV-Neu-NDL mice. After 6 days in matrigel, the transcriptome of the organoids was analyzed using RNA-Seq. Organoids from nulliparous mammary glands of 3 age-matched wild type FVB females served as controls.

Gene-set enrichment analyses (GSEA) revealed that the mouse mammary organoid data resembled the transcriptome of human breast cancer. For instance, the down-regulated genes of both models correlated well with expression signatures of invasive breast cancer and metastatic tumors. A similar correlation was found for up-regulated genes in both datasets.

Taken together, the data demonstrated that mouse mammary carcinoma-derived organoids recapitulated the transcriptome of luminal B and HER2/neu-amplified breast cancer. The data also demonstrate that mouse mammary carcinoma-derived organoids are a reliable model system to study the expression of non-coding RNAs.

Example 3: Identification of Up-Regulated lncRNAs in Mammary Tumors

A catalog of lncRNAs that exhibited altered expression levels in mammary tumor organoids was generated to provide a useful resource for research and drug development.

A total of 484 lncRNAs in MMTV-PyMT and 402 lncRNAs in MMTV-Neu-NDL were identified with an overlap of 122 between both models that are differentially expressed in organoids derived from mammary tumors compared to wild-type (WT) mammary glands. Approximately, 30% of the identified RNA genes are classified as 'lincRNA' (long intergenic non-coding RNAs), 23% as 'processed pseudogenes', 16% as 'antisense' transcripts, and 13% as 'processed' transcripts. The gene biotypes of the 484 lncRNAs differentially expressed in MMTV-PyMT tumor organoids and 402 lncRNAs differentially expressed in MMTV-Neu-NDL tumor organoids is presented in the table below. 'TEC' denotes 'to be experimentally confirmed' (GENCODE classification).

TABLE 3

| Gene biotypes (%) of lncRNA | | |
|---|---|---|
| Gene biotype | MMTV-PyMT | MMTV-Neu-NDL |
| Antisense | 18 | 13 |
| lincRNA | 31 | 27 |
| Processed pseudogene | 16 | 28 |
| Processed transcript | 15 | 10 |
| TEC | 7 | 5 |
| Unprocessed pseudogene | 4 | 3 |
| others | 9 | 14 |

Of these, 109 lncRNAs in MMTV-PyMT and 207 lncRNAs in MMTV-Neu-NDL were up-regulated >two-fold, with an overlap of 26 between both models. These up-regulated genes are presented in the Tables below. The genes marked with an asterisk (*) are the overlapping 26 genes. 'log 2FC' denotes the fold-changes compared to WT mammary organoids, on a log 2 scale. 'adj. p-value' indicates the false-discovery rate (FDR) adjusted p-value, a statistical measure of significance. Differentially expressed genes were included in the Tables below if the log 2FC was ≥2 and the adj. p-value was <0.1. These putative oncogenes represent a diverse group of lncRNAs in terms of their biotypes, length, expression levels, and genomic location (depicted by their Ensembl ID).

TABLE 4

| Up-regulated (≥2-fold) lncRNAs in MMTV-PyMT | | | | |
|---|---|---|---|---|
| Ensembl ID | log2FC | adj. p-value | Biotype | Gene name |
| ENSMUSG00000085541* | 6.5 | 7.14E-51 | antisense | Gm16010 |
| ENSMUSG00000091199* | 5.4 | 1.03E-10 | transcribed unprocessed pseudogene | Gm2619 |
| ENSMUSG00000096802* | 4.6 | 3.21E-06 | processed pseudogene | Gm15433 |
| ENSMUSG00000050334* | 4.5 | 8.45E-13 | lincRNA | C130071C03Rik |
| ENSMUSG00000089652* | 4.4 | 8.77E-06 | lincRNA | Gm16025 |
| ENSMUSG00000090186* | 4.2 | 1.00E-05 | transcribed unprocessed pseudogene | Gm7592 |
| ENSMUSG00000103440 | 4.0 | 6.46E-12 | TEC | Gm37131 |
| ENSMUSG00000082082 | 3.8 | 4.54E-04 | transcribed unprocessed | Gm13230 |
| ENSMUSG00000097960* | 3.6 | 8.17E-17 | lincRNA | A330074K22Rik |
| ENSMUSG00000096292* | 3.6 | 1.14E-03 | processed pseudogene | Gm2666 |
| ENSMUSG00000094991 | 3.6 | 1.25E-03 | lincRNA | Gm21718 |
| ENSMUSG00000087659 | 3.3 | 1.59E-03 | lincRNA | Gm12606 |
| ENSMUSG00000100816* | 3.2 | 6.01E-04 | lincRNA | Gm28321 |
| ENSMUSG00000103620 | 3.0 | 1.54E-03 | antisense | Gm37359 |
| ENSMUSG00000104192 | 3.0 | 4.69E-05 | TEC | Gm37253 |
| ENSMUSG00000099693* | 3.0 | 5.35E-03 | unprocessed pseudogene | Gm29284 |
| ENSMUSG00000098224 | 2.9 | 3.41E-03 | processed pseudogene | Gm7985 |
| ENSMUSG00000086748 | 2.8 | 5.56E-03 | processed transcript | Gm13261 |

TABLE 4-continued

Up-regulated (≥2-fold) lncRNAs in MMTV-PyMT

| Ensembl ID | log2FC | adj. p-value | Biotype | Gene name |
|---|---|---|---|---|
| ENSMUSG00000087051 | 2.7 | 8.83E-04 | lincRNA | Gm12730 |
| ENSMUSG00000051832 | 2.7 | 1.08E-05 | processed transcript | E230016K23Rik |
| ENSMUSG00000073821 | 2.7 | 1.16E-05 | processed transcript | 8030451A03Rik |
| ENSMUSG00000097804 | 2.7 | 3.85E-04 | antisense | Gm16685 |
| ENSMUSG00000083563 | 2.6 | 1.90E-03 | unprocessed pseudogene | Gm13340 |
| ENSMUSG00000083863 | 2.5 | 4.59E-06 | unprocessed pseudogene | Gm13341 |
| ENSMUSG00000082978 | 2.5 | 1.14E-02 | processed pseudogene | Rpsa-ps11 |
| ENSMUSG00000082480 | 2.5 | 7.15E-04 | processed pseudogene | Gm11687 |
| ENSMUSG00000043903* | 2.4 | 1.32E-08 | lincRNA | Gm22 |
| ENSMUSG00000084141 | 2.3 | 3.39E-03 | processed pseudogene | Olfr1372-ps1 |
| ENSMUSG00000087028* | 2.3 | 1.33E-06 | lincRNA | Gm13387 |
| ENSMUSG00000095042 | 2.3 | 8.67E-03 | processed pseudogene | Gm12537 |
| ENSMUSG00000094334 | 2.2 | 5.39E-02 | processed pseudogene | Fabp512 |
| ENSMUSG00000105613 | 2.2 | 1.31E-02 | TEC | RP23-31J24.2 |
| ENSMUSG00000100865 | 2.2 | 1.92E-02 | transcribed processed | Gm9320 |
| ENSMUSG00000084289* | 2.2 | 8.13E-07 | processed pseudogene | Gm6977 |
| ENSMUSG00000069939 | 2.1 | 3.95E-03 | processed pseudogene | Gm12070 |
| ENSMUSG00000103032 | 2.1 | 7.42E-02 | TEC | Gm37121 |
| ENSMUSG00000105353 | 2.1 | 2.57E-02 | lincRNA | RP24-230J14.4 |
| ENSMUSG00000067203* | 2.1 | 2.74E-11 | unprocessed pseudogene | H2-K2 |
| ENSMUSG00000083311 | 2.1 | 5.23E-02 | processed pseudogene | Gm5643 |
| ENSMUSG00000082424 | 2.1 | 2.90E-03 | processed pseudogene | Gm13292 |
| ENSMUSG00000096751 | 2.1 | 8.98E-02 | processed transcript | Gm28373 |
| ENSMUSG00000041449 | 2.0 | 4.73E-07 | transcribed unprocessed pseudogene | Serpina3h |
| ENSMUSG00000086249 | 2.0 | 2.84E-03 | processed transcript | Gm12724 |
| ENSMUSG00000101452 | 2.0 | 2.17E-02 | processed pseudogene | Gm28530 |
| ENSMUSG00000097924* | 2.0 | 7.52E-02 | lincRNA | A730020E08Rik |
| ENSMUSG00000085912* | 2.0 | 9.93E-05 | lincRNA | Trp53cor1 |
| ENSMUSG00000097636 | 2.0 | 5.53E-02 | lincRNA | 5830416P10Rik |
| ENSMUSG00000100750 | 2.0 | 1.98E-02 | antisense | Gm29084 |
| ENSMUSG00000095419 | 2.0 | 1.02E-04 | processed pseudogene | Gm14328 |
| ENSMUSG00000090063 | 1.9 | 7.62E-02 | antisense | Dlx6os1 |
| ENSMUSG00000092171* | 1.9 | 5.16E-04 | lincRNA | 4833427F10Rik |
| ENSMUSG00000105520 | 1.9 | 8.31E-03 | TEC | RP23-105B8.4 |
| ENSMUSG00000082179 | 1.9 | 9.69E-02 | processed pseudogene | Gm11407 |
| ENSMUSG00000096617* | 1.8 | 1.95E-02 | processed pseudogene | Gm5559 |
| ENSMUSG00000093405 | 1.8 | 6.36E-02 | processed transcript | Gm20684 |
| ENSMUSG00000091553 | 1.8 | 3.93E-02 | unprocessed pseudogene | Serpina3e-ps |
| ENSMUSG00000098113 | 1.8 | 2.62E-02 | processed pseudogene | Gm2445 |
| ENSMUSG00000085471 | 1.8 | 7.67E-02 | antisense | 4933423P22Rik |
| ENSMUSG00000085786 | 1.7 | 1.39E-02 | antisense | Gm15987 |
| ENSMUSG00000102550 | 1.7 | 3.13E-02 | processed pseudogene | Gm8276 |
| ENSMUSG00000080775 | 1.7 | 9.19E-02 | processed pseudogene | Gm6368 |
| ENSMUSG00000105356 | 1.7 | 6.77E-02 | TEC | RP23-480P21.3 |
| ENSMUSG00000098019 | 1.7 | 2.55E-02 | processed pseudogene | Gm2546 |
| ENSMUSG00000090307 | 1.6 | 1.09E-02 | antisense | 1700071M16Rik |
| ENSMUSG00000089728 | 1.6 | 8.26E-02 | unprocessed pseudogene | Clec2f |
| ENSMUSG00000063586 | 1.6 | 9.97E-02 | processed pseudogene | Gm5513 |
| ENSMUSG00000026729 | 1.6 | 6.21E-02 | lincRNA | 4930562F07Rik |
| ENSMUSG00000104693* | 1.5 | 7.23E-02 | sense intronic | RP23-103P11.1 |
| ENSMUSG00000097728 | 1.5 | 4.95E-03 | lincRNA | Gm26840 |
| ENSMUSG00000103755 | 1.5 | 1.18E-05 | TEC | Gm37805 |
| ENSMUSG00000067389* | 1.5 | 7.68E-05 | antisense | Gm17080 |
| ENSMUSG00000097800 | 1.5 | 5.87E-03 | lincRNA | B230344G16Rik |
| ENSMUSG00000099492 | 1.4 | 3.30E-02 | processed pseudogene | Gm5525 |
| ENSMUSG00000082762 | 1.4 | 8.01E-02 | processed pseudogene | Gm12366 |
| ENSMUSG00000097660* | 1.4 | 7.59E-02 | lincRNA | Gm26762 |
| ENSMUSG00000099471 | 1.4 | 6.99E-03 | processed pseudogene | Gm8451 |
| ENSMUSG00000079311 | 1.4 | 4.13E-03 | processed pseudogene | Gm3222 |
| ENSMUSG00000104018 | 1.4 | 7.37E-02 | TEC | 4833412K13Rik |
| ENSMUSG00000105263 | 1.4 | 8.60E-02 | TEC | RP24-230J14.5 |
| ENSMUSG00000074280 | 1.4 | 2.95E-05 | pseudogene | Gm6166 |
| ENSMUSG00000080746 | 1.4 | 4.49E-02 | processed pseudogene | Rpsa-ps12 |
| ENSMUSG00000085399* | 1.4 | 5.59E-02 | processed transcript | Foxd2os |
| ENSMUSG00000101249 | 1.3 | 1.99E-04 | unprocessed pseudogene | Gm29216 |
| ENSMUSG00000086321 | 1.3 | 5.81E-02 | antisense | Gm11413 |
| ENSMUSG00000094708 | 1.3 | 9.14E-02 | processed pseudogene | Gm10359 |
| ENSMUSG00000100131 | 1.3 | 5.73E-02 | unprocessed pseudogene | Gm28439 |
| ENSMUSG00000087528* | 1.3 | 8.31E-03 | processed transcript | 9830144P21Rik |
| ENSMUSG00000104737* | 1.3 | 2.02E-02 | sense intronic | RP23-103P11.2 |
| ENSMUSG00000105954 | 1.2 | 4.07E-04 | TEC | RP24-299A7.2 |
| ENSMUSG00000097979 | 1.2 | 4.94E-02 | transcribed processed pseudogene | Gm4691 |
| ENSMUSG00000103098 | 1.2 | 8.37E-02 | processed pseudogene | Gm37559 |
| ENSMUSG00000104000* | 1.2 | 6.68E-02 | lincRNA | Gm38335 |

TABLE 4-continued

Up-regulated (≥2-fold) lncRNAs in MMTV-PyMT

| Ensembl ID | log2FC | adj. p-value | Biotype | Gene name |
|---|---|---|---|---|
| ENSMUSG00000083773 | 1.2 | 1.64E-03 | processed pseudogene | Gm13394 |
| ENSMUSG00000097113 | 1.1 | 1.52E-02 | lincRNA | Gm19705 |
| ENSMUSG00000097090 | 1.1 | 9.31E-02 | lincRNA | Gm26724 |
| ENSMUSG00000075391 | 1.1 | 2.13E-02 | processed pseudogene | Gm13443 |
| ENSMUSG00000081208 | 1.1 | 7.94E-03 | processed pseudogene | Gm11400 |
| ENSMUSG00000084974 | 1.1 | 5.82E-02 | processed transcript | Gm15567 |
| ENSMUSG00000043889 | 1.1 | 5.82E-03 | pseudogene | Gm8399 |
| ENSMUSG00000102070 | 1.1 | 1.68E-02 | unprocessed pseudogene | Gm28661 |
| ENSMUSG00000103039 | 1.1 | 5.80E-02 | TEC | Gm37123 |
| ENSMUSG00000066553 | 1.1 | 2.54E-02 | processed pseudogene | Gm6969 |
| ENSMUSG00000105558 | 1.0 | 2.97E-02 | processed pseudogene | RP23-349J3.8 |
| ENSMUSG00000090610 | 1.0 | 5.62E-02 | pseudogene | Gm3571 |
| ENSMUSG00000089776* | 1.0 | 3.73E-02 | antisense | Gm15684 |
| ENSMUSG00000054418 | 1.0 | 3.94E-02 | processed transcript | Gm12715 |
| ENSMUSG00000090330 | 1.0 | 3.02E-02 | antisense | 9130221H12Rik |
| ENSMUSG00000059195 | 1.0 | 1.66E-05 | processed pseudogene | Gm12715 |
| ENSMUSG00000084145 | 1.0 | 5.77E-02 | processed pseudogene | Gm12263 |

TABLE 5

Up-regulated (≥2-fold) lncRNAs in MMTV-Neu-NDL

| Ensembl ID | log2FC | adj. p-value | Biotype | Gene name |
|---|---|---|---|---|
| ENSMUSG00000085541* | 6.2 | 6.02E-35 | antisense | Gm16010 |
| ENSMUSG00000091199* | 5.8 | 6.90E-13 | transcribed unprocessed pseudogene | Gm2619 |
| ENSMUSG00000079457 | 5.6 | 2.97E-09 | transcribed unprocessed pseudogene | Gm7609 |
| ENSMUSG00000096802* | 5.5 | 1.84E-09 | processed pseudogene | Gm15433 |
| ENSMUSG00000087028* | 4.8 | 1.50E-13 | lincRNA | Gm13387 |
| ENSMUSG00000090186* | 4.8 | 2.24E-07 | transcribed unprocessed pseudogene | Gm7592 |
| ENSMUSG00000096292* | 4.7 | 2.74E-06 | processed pseudogene | Gm2666 |
| ENSMUSG00000104645 | 4.6 | 3.40E-08 | lincRNA | RP23-437C24.2 |
| ENSMUSG00000073902 | 4.5 | 1.69E-08 | unprocessed pseudogene | Gm1966 |
| ENSMUSG00000105811 | 4.4 | 2.08E-10 | lincRNA | RP23-327I19.1 |
| ENSMUSG00000082292 | 4.1 | 5.28E-09 | processed pseudogene | Gm12250 |
| ENSMUSG00000075549 | 4.0 | 7.07E-10 | antisense | Gm6878 |
| ENSMUSG00000089652* | 4.0 | 2.50E-04 | lincRNA | Gm16025 |
| ENSMUSG00000106230 | 3.9 | 6.45E-07 | lincRNA | RP23-447N11.2 |
| ENSMUSG00000085452 | 3.8 | 7.54E-04 | lincRNA | 4930554G24Rik |
| ENSMUSG00000085083 | 3.7 | 2.97E-04 | antisense | Gm11615 |
| ENSMUSG00000099375 | 3.6 | 3.24E-06 | lincRNA | Gm28187 |
| ENSMUSG00000082305 | 3.6 | 2.90E-12 | unprocessed pseudogene | Gm2420 |
| ENSMUSG00000086964 | 3.6 | 7.66E-04 | antisense | Gm15948 |
| ENSMUSG00000102801 | 3.6 | 2.17E-03 | TEC | Gm37478 |
| ENSMUSG00000084328 | 3.6 | 1.42E-04 | processed pseudogene | Gm14046 |
| ENSMUSG00000085218 | 3.5 | 2.91E-04 | processed transcript | BB218582 |
| ENSMUSG00000100252 | 3.4 | 2.33E-04 | lincRNA | Mir124-2hg |
| ENSMUSG00000097766 | 3.4 | 2.36E-09 | lincRNA | 5730420D15Rik |
| ENSMUSG00000102160 | 3.3 | 5.52E-04 | TEC | Gm36944 |
| ENSMUSG00000081665 | 3.3 | 1.27E-05 | unprocessed pseudogene | Gm15922 |
| ENSMUSG00000083161 | 3.2 | 3.34E-03 | unprocessed pseudogene | Gm11427 |
| ENSMUSG00000099157 | 3.2 | 7.23E-03 | misc RNA | Gm27804 |
| ENSMUSG00000090252 | 3.2 | 6.22E-03 | antisense | Gm16028 |
| ENSMUSG00000085295 | 3.1 | 6.40E-04 | antisense | 4930430E12Rik |
| ENSMUSG00000102389 | 3.1 | 3.02E-03 | TEC | D630023O14Rik |
| ENSMUSG00000097924* | 3.1 | 2.17E-03 | lincRNA | A730020E08Rik |
| ENSMUSG00000100009 | 3.1 | 2.37E-05 | lincRNA | Gm7967 |
| ENSMUSG00000099693* | 3.1 | 3.25E-03 | unprocessed pseudogene | Gm29284 |
| ENSMUSG00000106004 | 3.0 | 1.34E-02 | antisense | RP24-152F23.2 |
| ENSMUSG00000087326 | 3.0 | 4.18E-05 | processed transcript | Gm12503 |
| ENSMUSG00000087107 | 3.0 | 7.23E-06 | lincRNA | AI662270 |
| ENSMUSG00000087248 | 2.9 | 6.61E-04 | antisense | Gm16120 |
| ENSMUSG00000086605 | 2.9 | 1.62E-06 | lincRNA | Gm14290 |
| ENSMUSG00000082433 | 2.9 | 6.86E-05 | processed pseudogene | Gm9025 |
| ENSMUSG00000063286 | 2.9 | 9.43E-05 | unprocessed pseudogene | Gm8995 |
| ENSMUSG00000085399* | 2.9 | 2.43E-12 | processed transcript | Foxd2os |
| ENSMUSG00000066170 | 2.8 | 2.14E-06 | lincRNA | E230001N04Rik |
| ENSMUSG00000085696 | 2.8 | 1.12E-02 | antisense | Hoxaas3 |
| ENSMUSG00000061852 | 2.8 | 3.05E-02 | unprocessed pseudogene | Gm7582 |
| ENSMUSG00000102788 | 2.8 | 5.19E-03 | TEC | Gm38255 |

TABLE 5-continued

Up-regulated (≥2-fold) lncRNAs in MMTV-Neu-NDL

| Ensembl ID | log2FC | adj. p-value | Biotype | Gene name |
|---|---|---|---|---|
| ENSMUSG00000081723 | 2.7 | 2.79E-04 | unprocessed pseudogene | Gm15931 |
| ENSMUSG00000073538 | 2.7 | 1.53E-02 | processed transcript | E330020D12Rik |
| ENSMUSG00000099848 | 2.7 | 1.13E-04 | lincRNA | Gm29337 |
| ENSMUSG00000087658 | 2.7 | 2.01E-02 | antisense | Hotairm1 |
| ENSMUSG00000078122 | 2.7 | 2.53E-03 | antisense | F630028O10Rik |
| ENSMUSG00000036322 | 2.7 | 1.74E-02 | unprocessed pseudogene | H2-Ea-ps |
| ENSMUSG00000104350 | 2.7 | 1.52E-04 | TEC | Gm38244 |
| ENSMUSG00000087139 | 2.6 | 1.98E-02 | antisense | Gm11683 |
| ENSMUSG00000078952 | 2.6 | 9.17E-04 | lincRNA | Lincenc1 |
| ENSMUSG00000083489 | 2.6 | 4.41E-02 | unprocessed pseudogene | Gm11784 |
| ENSMUSG00000100550 | 2.6 | 5.94E-03 | lincRNA | 2310039L15Rik |
| ENSMUSG00000100816* | 2.6 | 2.41E-02 | lincRNA | Gm28321 |
| ENSMUSG00000083708 | 2.6 | 1.91E-02 | processed pseudogene | Gm13123 |
| ENSMUSG00000086704 | 2.6 | 4.30E-02 | antisense | Gm14582 |
| ENSMUSG00000050334* | 2.5 | 4.12E-03 | lincRNA | C130071C03Rik |
| ENSMUSG00000099111 | 2.5 | 4.71E-02 | misc RNA | Gm27369 |
| ENSMUSG00000082116 | 2.5 | 4.97E-02 | processed pseudogene | Gm12188 |
| ENSMUSG00000104022 | 2.5 | 3.79E-02 | sense intronic | Gm37214 |
| ENSMUSG00000074465 | 2.5 | 2.55E-02 | antisense | Gm10701 |
| ENSMUSG00000085912* | 2.5 | 1.41E-08 | lincRNA | Trp53cor1 |
| ENSMUSG00000084243 | 2.5 | 4.76E-02 | processed pseudogene | Gm13784 |
| ENSMUSG00000084826 | 2.5 | 5.37E-02 | antisense | AI847159 |
| ENSMUSG00000105397 | 2.4 | 3.11E-03 | processed pseudogene | RP23-335E20.2 |
| ENSMUSG00000097076 | 2.4 | 6.75E-02 | lincRNA | Platr7 |
| ENSMUSG00000086109 | 2.4 | 6.22E-02 | lincRNA | Gm13391 |
| ENSMUSG00000078601 | 2.4 | 4.57E-02 | lincRNA | Gm12525 |
| ENSMUSG00000074805 | 2.4 | 1.54E-02 | antisense | Il1bos |
| ENSMUSG00000084108 | 2.4 | 6.96E-02 | processed pseudogene | Gm15794 |
| ENSMUSG00000092171* | 2.4 | 1.52E-02 | lincRNA | 4833427F10Rik |
| ENSMUSG00000100301 | 2.4 | 9.52E-18 | lincRNA | 6030407O03Rik |
| ENSMUSG00000085833 | 2.3 | 1.07E-02 | lincRNA | Gm13003 |
| ENSMUSG00000106396 | 2.3 | 4.97E-02 | antisense | RP24-140D11.1 |
| ENSMUSG00000105492 | 2.3 | 6.27E-02 | processed pseudogene | RP24-224P21.1 |
| ENSMUSG00000082072 | 2.3 | 3.89E-03 | processed pseudogene | Gm15785 |
| ENSMUSG00000072683 | 2.3 | 7.88E-02 | processed transcript | Gm7457 |
| ENSMUSG00000097281 | 2.3 | 1.29E-02 | lincRNA | Gm26685 |
| ENSMUSG00000103596 | 2.3 | 7.93E-02 | TEC | Gm37354 |
| ENSMUSG00000054510 | 2.3 | 6.38E-02 | lincRNA | Gm14461 |
| ENSMUSG00000056716 | 2.3 | 8.63E-03 | lincRNA | Gm5420 |
| ENSMUSG00000087149 | 2.3 | 9.63E-05 | transcribed unprocessed pseudogene | Itih5l-ps |
| ENSMUSG00000044633 | 2.3 | 3.87E-04 | lincRNA | B530045E10Rik |
| ENSMUSG00000043903* | 2.3 | 1.20E-05 | lincRNA | Gm22 |
| ENSMUSG00000082127 | 2.2 | 7.72E-08 | processed pseudogene | Gm13577 |
| ENSMUSG00000099757 | 2.2 | 1.25E-02 | processed transcript | BE692007 |
| ENSMUSG00000101210 | 2.2 | 3.46E-02 | lincRNA | Gm28720 |
| ENSMUSG00000097730 | 2.2 | 3.06E-02 | lincRNA | Gm26588 |
| ENSMUSG00000097673 | 2.2 | 2.03E-02 | lincRNA | Gm26608 |
| ENSMUSG00000087364 | 2.2 | 2.59E-02 | antisense | Gm13398 |
| ENSMUSG00000105374 | 2.2 | 8.92E-02 | TEC | RP24-230L5.2 |
| ENSMUSG00000097639 | 2.2 | 3.80E-03 | lincRNA | Platr4 |
| ENSMUSG00000102827 | 2.1 | 1.46E-02 | transcribed processed pseudogene | Gm8242 |
| ENSMUSG00000081833 | 2.1 | 4.94E-03 | processed pseudogene | Gm13669 |
| ENSMUSG00000101365 | 2.1 | 1.07E-02 | lincRNA | Gm19325 |
| ENSMUSG00000085702 | 2.1 | 7.92E-02 | antisense | Mecomos |
| ENSMUSG00000086187 | 2.0 | 2.39E-02 | lincRNA | Gm12860 |
| ENSMUSG00000072387 | 2.0 | 8.27E-02 | processed pseudogene | Gm10356 |
| ENSMUSG00000063388 | 2.0 | 1.74E-02 | pseudogene | BC023105 |
| ENSMUSG00000082956 | 2.0 | 9.02E-02 | unprocessed pseudogene | Naip3 |
| ENSMUSG00000085182 | 2.0 | 1.85E-02 | antisense | Gm13596 |
| ENSMUSG00000087528* | 2.0 | 8.13E-08 | processed transcript | 9830144P21Rik |
| ENSMUSG00000106524 | 2.0 | 6.38E-07 | lincRNA | RP23-229C5.2 |
| ENSMUSG00000105057 | 2.0 | 9.56E-02 | lincRNA | RP23-71G16.7 |
| ENSMUSG00000106654 | 2.0 | 5.34E-02 | processed pseudogene | RP23-118L1.5 |
| ENSMUSG00000101344 | 2.0 | 1.68E-07 | lincRNA | Gm29183 |
| ENSMUSG00000096938 | 2.0 | 3.44E-02 | lincRNA | 9530052E02Rik |
| ENSMUSG00000105260 | 2.0 | 2.67E-02 | lincRNA | RP23-325M18.5 |
| ENSMUSG00000097814 | 1.9 | 4.72E-02 | antisense | Panct2 |
| ENSMUSG00000087014 | 1.9 | 8.43E-03 | antisense | Gm16364 |
| ENSMUSG00000099604 | 1.9 | 3.74E-02 | processed pseudogene | Gm6651 |
| ENSMUSG00000061728 | 1.9 | 7.10E-02 | unprocessed pseudogene | Btn17-ps |
| ENSMUSG00000023341 | 1.9 | 1.19E-03 | polymorphic pseudogene | Mx2 |
| ENSMUSG00000091575 | 1.9 | 2.46E-03 | processed transcript | 2010016I18Rik |
| ENSMUSG00000096617* | 1.9 | 1.74E-03 | processed pseudogene | Gm5559 |
| ENSMUSG00000075027 | 1.9 | 2.87E-03 | processed transcript | 4631405J19Rik |

TABLE 5-continued

Up-regulated (≥2-fold) lncRNAs in MMTV-Neu-NDL

| Ensembl ID | log2FC | adj. p-value | Biotype | Gene name |
|---|---|---|---|---|
| ENSMUSG00000106164 | 1.9 | 4.10E-02 | lincRNA | RP24-292F8.1 |
| ENSMUSG00000083152 | 1.8 | 7.09E-02 | transcribed processed pseudogene | Apc-ps1 |
| ENSMUSG00000086150 | 1.8 | 1.23E-02 | antisense | Bach2os |
| ENSMUSG00000089711 | 1.8 | 5.45E-02 | antisense | Gm16240 |
| ENSMUSG00000087113 | 1.8 | 1.55E-02 | processed transcript | Gm11714 |
| ENSMUSG00000105326 | 1.8 | 3.44E-02 | TEC | RP24-230L5.3 |
| ENSMUSG00000105453 | 1.8 | 9.72E-02 | TEC | RP23-31L10.4 |
| ENSMUSG00000097887 | 1.8 | 3.15E-02 | lincRNA | Gm26542 |
| ENSMUSG00000093826 | 1.8 | 6.52E-04 | processed pseudogene | Gm6900 |
| ENSMUSG00000082192 | 1.7 | 5.03E-02 | processed pseudogene | Gm14719 |
| ENSMUSG00000097242 | 1.7 | 1.95E-13 | lincRNA | Gm16907 |
| ENSMUSG00000097352 | 1.7 | 2.75E-02 | transcribed unprocessed pseudogene | C920009B18Rik |
| ENSMUSG00000103532 | 1.7 | 2.49E-02 | TEC | Gm4430 |
| ENSMUSG00000104616 | 1.7 | 3.71E-02 | processed pseudogene | RP23-325M18.2 |
| ENSMUSG00000097471 | 1.7 | 7.62E-02 | lincRNA | 5830432E09Rik |
| ENSMUSG00000105741 | 1.7 | 8.53E-03 | TEC | RP23-396H16.2 |
| ENSMUSG00000100005 | 1.7 | 1.34E-02 | processed transcript | B130024G19Rik |
| ENSMUSG00000084289* | 1.7 | 1.62E-03 | processed pseudogene | Gm6977 |
| ENSMUSG00000029605 | 1.6 | 1.14E-03 | polymorphic pseudogene | Oas1b |
| ENSMUSG00000090399 | 1.6 | 8.53E-02 | lincRNA | Gm38399 |
| ENSMUSG00000096980 | 1.6 | 2.71E-02 | lincRNA | Gm26526 |
| ENSMUSG00000086712 | 1.6 | 1.42E-02 | lincRNA | AI427809 |
| ENSMUSG00000097660* | 1.6 | 5.14E-02 | lincRNA | Gm26762 |
| ENSMUSG00000084807 | 1.6 | 1.67E-02 | lincRNA | Gm13073 |
| ENSMUSG00000084183 | 1.6 | 1.68E-02 | processed pseudogene | Gm12009 |
| ENSMUSG00000074067 | 1.6 | 6.09E-02 | lincRNA | Gm10619 |
| ENSMUSG00000104693* | 1.6 | 9.42E-02 | sense intronic | RP23-103P11.1 |
| ENSMUSG00000084274 | 1.6 | 1.20E-02 | transcribed processed pseudogene | Gm12504 |
| ENSMUSG00000103009 | 1.5 | 1.41E-03 | TEC | Gm4430 |
| ENSMUSG00000097960* | 1.5 | 2.72E-02 | lincRNA | A330074K22Rik |
| ENSMUSG00000090222 | 1.5 | 4.69E-02 | unprocessed pseudogene | Gm16340 |
| ENSMUSG00000047643 | 1.5 | 1.45E-02 | processed pseudogene | Gm5454 |
| ENSMUSG00000106288 | 1.5 | 7.51E-02 | TEC | RP24-140D11.6 |
| ENSMUSG00000087684 | 1.5 | 4.97E-04 | lincRNA | 1200007C13Rik |
| ENSMUSG00000093619 | 1.5 | 7.54E-03 | antisense | 4930535L15Rik |
| ENSMUSG00000067389* | 1.5 | 2.84E-06 | antisense | Gm17080 |
| ENSMUSG00000104973 | 1.5 | 9.91E-02 | sense intronic | RP23-357D17.3 |
| ENSMUSG00000105324 | 1.5 | 8.13E-02 | lincRNA | RP23-229C5.1 |
| ENSMUSG00000105107 | 1.5 | 7.62E-02 | TEC | RP23-214I6.4 |
| ENSMUSG00000052403 | 1.5 | 4.74E-02 | antisense | Fcnaos |
| ENSMUSG00000104126 | 1.5 | 1.39E-02 | processed pseudogene | Gm37486 |
| ENSMUSG00000101431 | 1.5 | 3.36E-02 | processed pseudogene | Gm7901 |
| ENSMUSG00000089755 | 1.5 | 1.06E-02 | antisense | 0610012D04Rik |
| ENSMUSG00000085836 | 1.5 | 8.30E-02 | lincRNA | Gm13074 |
| ENSMUSG00000067121 | 1.4 | 4.63E-08 | processed pseudogene | Gm7027 |
| ENSMUSG00000102259 | 1.4 | 1.01E-02 | TEC | Gm38230 |
| ENSMUSG00000104263 | 1.4 | 5.64E-02 | TEC | 9430062P05Rik |
| ENSMUSG00000072962 | 1.4 | 4.79E-02 | antisense | Gm16401 |
| ENSMUSG00000106028 | 1.4 | 1.83E-02 | unprocessed pseudogene | RP23-20307.3 |
| ENSMUSG00000087362 | 1.4 | 3.52E-02 | lincRNA | Gm13710 |
| ENSMUSG00000097194 | 1.4 | 6.75E-02 | lincRNA | 9330175E14Rik |
| ENSMUSG00000100147 | 1.4 | 9.87E-02 | lincRNA | 1700047M11Rik |
| ENSMUSG00000089776* | 1.3 | 3.47E-02 | antisense | Gm15684 |
| ENSMUSG00000067203* | 1.3 | 4.25E-04 | unprocessed pseudogene | H2-K2 |
| ENSMUSG00000100701 | 1.3 | 7.08E-03 | processed pseudogene | Gm19587 |
| ENSMUSG00000079671 | 1.3 | 3.28E-02 | processed transcript | 2610203C22Rik |
| ENSMUSG00000046993 | 1.3 | 4.58E-02 | processed pseudogene | Gm5637 |
| ENSMUSG00000103653 | 1.3 | 7.07E-02 | processed pseudogene | Gm3934 |
| ENSMUSG00000097908 | 1.3 | 1.89E-04 | lincRNA | 4933404O12Rik |
| ENSMUSG00000102813 | 1.3 | 1.76E-05 | TEC | Gm37795 |
| ENSMUSG00000089817 | 1.2 | 1.84E-03 | processed pseudogene | Gm7162 |
| ENSMUSG00000064281 | 1.2 | 1.37E-02 | processed pseudogene | Rpl19-ps1 |
| ENSMUSG00000097378 | 1.2 | 1.81E-02 | lincRNA | B230208H11Rik |
| ENSMUSG00000085174 | 1.2 | 3.46E-02 | antisense | Gm16206 |
| ENSMUSG00000074506 | 1.2 | 2.87E-02 | processed pseudogene | Gm10705 |
| ENSMUSG00000079491 | 1.2 | 7.50E-05 | polymorphic pseudogene | H2-T10 |
| ENSMUSG00000089769 | 1.2 | 8.31E-03 | processed pseudogene | Gm16574 |
| ENSMUSG00000084781 | 1.2 | 4.72E-02 | processed transcript | D930015M05Rik |
| ENSMUSG00000085558 | 1.2 | 5.40E-02 | processed transcript | 4930412C18Rik |
| ENSMUSG00000081684 | 1.2 | 1.48E-02 | processed pseudogene | Rps2-ps13 |
| ENSMUSG00000100158 | 1.2 | 5.33E-02 | sense intronic | Gm28119 |
| ENSMUSG00000093507 | 1.2 | 6.27E-02 | processed transcript | Gm20627 |
| ENSMUSG00000104000* | 1.1 | 4.87E-02 | lincRNA | Gm38335 |

TABLE 5-continued

Up-regulated (≥2-fold) lncRNAs in MMTV-Neu-NDL

| Ensembl ID | log2FC | adj. p-value | Biotype | Gene name |
|---|---|---|---|---|
| ENSMUSG00000096918 | 1.1 | 9.92E-02 | lincRNA | Gm16863 |
| ENSMUSG00000086894 | 1.1 | 5.59E-02 | sense intronic | Gm15708 |
| ENSMUSG00000101878 | 1.1 | 4.59E-03 | processed pseudogene | Gm8203 |
| ENSMUSG00000092569 | 1.1 | 3.53E-02 | processed transcript | Gm20544 |
| ENSMUSG00000104737* | 1.1 | 6.02E-02 | sense intronic | RP23-103P11.2 |
| ENSMUSG00000085873 | 1.1 | 1.41E-03 | antisense | Ttc39aos1 |
| ENSMUSG00000086453 | 1.1 | 9.40E-02 | antisense | Gm11457 |
| ENSMUSG00000073145 | 1.1 | 8.67E-02 | antisense | Gm12000 |
| ENSMUSG00000082475 | 1.1 | 1.49E-02 | processed pseudogene | Gm7206 |
| ENSMUSG00000106237 | 1.0 | 2.33E-02 | lincRNA | RP23-45G4.3 |
| ENSMUSG00000097092 | 1.0 | 2.96E-02 | lincRNA | Gm26725 |
| ENSMUSG00000097145 | 1.0 | 1.69E-03 | lincRNA | 9230114K14Rik |
| ENSMUSG00000105742 | 1.0 | 4.97E-02 | TEC | RP24-347B12.1 |
| ENSMUSG00000104913 | 1.0 | 1.20E-03 | processed pseudogene | RP24-324L19.3 |

The distribution of lncRNA across chromosomes is further presented in the Table below. The 'Genome' column depicts the total number of lncRNAs per chromosome according to GENCODE mV5 annotations; the 'PyMT' column depicts differentially expressed lncRNAs in MMTV-PyMT; the 'Neu' column depicts the differentially expressed lncRNAs in MMTV-Neu-NDL.

TABLE 6

Total and differential gene expression across chromosomes

| Chr | Genome | PyMT | Neu |
|---|---|---|---|
| 1 | 3290 | 49 | 59 |
| 2 | 3093 | 36 | 35 |
| 3 | 2704 | 33 | 37 |
| 4 | 2356 | 33 | 44 |
| 5 | 2624 | 27 | 45 |
| 6 | 1524 | 25 | 27 |
| 7 | 2170 | 18 | 25 |
| 8 | 1045 | 10 | 17 |
| 9 | 1582 | 17 | 20 |
| 10 | 967 | 8 | 21 |
| 11 | 2436 | 34 | 34 |
| 12 | 756 | 15 | 8 |
| 13 | 794 | 18 | 21 |
| 14 | 885 | 10 | 10 |
| 15 | 727 | 9 | 8 |
| 16 | 824 | 11 | 9 |
| 17 | 1178 | 16 | 22 |
| 18 | 463 | 9 | 15 |
| 19 | 573 | 10 | 6 |
| X | 1970 | 13 | 20 |
| Y | 1417 | 0 | 0 |

Of the up-regulated lncRNAs, 30 transcripts were selected for further evaluation based on their overexpression in at least 4 out of 5 sequenced PyMT organoid datasets as well as significant upregulation in PyMT tumor sections. These transcripts were also selected based on several stringest criteria: i) statistical significance (FDR adjusted p-value <0.1; ii) at least two-fold up-regulation in tumor organoids and/or tumor sections compared to normal mammary organoids; iii) sufficient read coverage per transcript to eliminate very lowly abundant RNAs; iv) human conservation based on sequence and/or synteny; v) location in an intergenic genomic region; and vi) lack of highly repetitive elements. RNA-Seq data from MMTV-Cre; Flox-Neo-Neu-NT tumors, a second model for the HER2/neu-amplified subtype of human breast cancer, was also included to further refine the candidate lncRNAs. In addition, transcripts of highest clinical value were selected applying the following criteria: i) Up-regulation ≥2-fold compared to WT mammary gland organoids, ii) statistical significance (adjusted p-value <0.1), iii) intergenic location in the genome, iv) lack of highly repetitive regions and v) conservation in human based on sequence and/or synteny. These transcripts were termed Mammary Tumor Associated RNA 1-30 (MaTAR 1-30). These MaTARs are further presented in the Table below.

The expression levels of MaTARs in mammary tumors to other organs were compared by expression analysis of ENCODE datasets. The results confirmed tissue-specific expression of lncRNAs. The results indicated that 20 MaTARs show either exclusive expression or strong upregulation in mammary tumors.

TABLE 7

MaTARs in all datasets

| MaTAR | Ensembl ID | Gene Name | Biotype |
|---|---|---|---|
| 1 | ENSMUSG00000050334 | C130071C03Rik | lincRNA |
| 2 | ENSMUSG00000061852 | Gm7582 | unprocessed pseudogene |
| 3 | ENSMUSG00000097924 | A730020E08Rik | lincRNA |
| 4 | ENSMUSG00000087658 | Hotairm, Gm15051, Hoxaas1 | anti sense |
| 5 | ENSMUSG00000084328 | Gm14046 | processed pseudogene |
| 6 | ENSMUSG00000092171 | 4833427F10Rik | lincRNA |
| 7 | ENSMUSG00000085399 | Foxd2os, 9130206I24Rik | processed transcript |
| 8 | ENSMUSG00000092569 | Gm20544, lncRNA-Smad7 | processed transcript |
| 9 | ENSMUSG00000046993 | Gm5637 | processed pseudogene |
| 10 | ENSMUSG00000082433 | Gm9025, Ncf2-rs | processed pseudogene |

TABLE 7-continued

MaTARs in all datasets

| MaTAR | Ensembl ID | Gene Name | Biotype |
|---|---|---|---|
| 11 | ENSMUSG00000086712 | A1427809, LOC381524 | lincRNA |
| 12 | ENSMUSG00000085541 | Gm16010 | antisense |
| 13 | ENSMUSG00000096802 | Gm15433 | processed pseudogene |
| 14 | ENSMUSG00000089652 | Gm16025 | lincRNA |
| 15 | ENSMUSG00000084289 | Gm6977 | processed pseudogene |
| 16 | ENSMUSG00000086249 | Gm12724 | processed transcript |
| 17 | ENSMUSG00000097908 | 4933404O12Rik | lincRNA |
| 18 | ENSMUSG00000085873 | Ttc39aos1, Gm12750 | antisense |
| 19 | ENSMUSG00000082088 | Gm15753 | unprocessed pseudogene |
| 20 | ENSMUSG00000087028 | Gm13387 | lincRNA |
| 21 | ENSMUSG00000082305 | Gm2420 | unprocessed pseudogene |
| 22 | ENSMUSG00000085295 | 4930430E12Rik | antisense |
| 23 | ENSMUSG00000082956 | Naip3, Birc1c, EG667838, Naip3, Naip-rs5 | unprocessed pseudogene |
| 24 | ENSMUSG00000084274 | Gm12504 | transcribed processed pseudogene |
| 25 | ENSMUSG00000087684 | 1200007C13Rik | lincRNA |
| 26 | ENSMUSG00000097378 | B230208H11Rik | lincRNA |
| 27 | ENSMUSG00000087235 | Gm4750 | transcribed processed pseudogene |
| 28 | ENSMUSG00000087051 | Gm12730 | lincRNA |
| 29 | ENSMUSG00000095419 | Gm14328 | processed pseudogene |
| 30 | ENSMUSG00000074280 | Gm6166 | pseudogene |

To further characterize MaTARs in the context of global gene expression and to elucidate their potential as 'driver genes' in mammary carcinogenesis, weighed gene correlation network analysis (WGCNA) (Langfelder and Horvath, BMC Bioinformatics 9: 559, 2008) was performed. A full list of all MaTARs and their network modules is provided in the Table below. Of the modules, the 'mammary epithelium' module is enriched for genes that are highly expressed in our RNA-Seq datasets, both in normal mammary gland organoids as well as mammary tumors. The module comprises 5,744 genes, of which only 2,588 genes are classified as 'protein coding'. The coding potential of all MaTARs was tested using CPAT (Wang et al, 2013). While 63% of the MaTARs were classified as non-coding, 37% were predicted to be coding, attributed to the pseudogene fraction. This emphasizes the tissue specificity of non-coding RNA species as well as their potential functional role. MaTARs were further characterized according to their total length and number of exons. MaTARs range from 291-4,867 nucleotides with the majority of MaTARs being shorted than 1,500 nucleotides.

Notably, 16 of the 17 MaTARs in the mammary epithelium module were also highly expressed in tumor tissue compared to normal organs. This indicates that MaTARs are excellent marker genes and sufficient to stratify mammary epithelia from other tissue types.

As presented in the Table below, 'kTotal'=whole network connectivity; 'kWithin'=intramodular connectivity. Both values can be used to identify hub genes; genes are likely hub genes if their 'kWithin' is high, i.e. close to the 'kTotal' value. 'Eigengene corr'=Correlation of the respective MaTAR with the module Eigengene. The Eigengene represents the first principal component of the module. The closer this number is to 1, the higher the correlation of a MaTAR and its eigengene, and the more likely that the respective MaTAR is a hub gene. Positive values indicate positive correlation, negative values indicate negative correlation. 'GO' means gene ontology. At least 6 MaTARs (MaTAR5, 6, 9, 15, 16, and 30) fall into this region, indicating their important within the module.

TABLE 8

Network modules of MaTARs

| MaTAR | Tissue expression | GO terms | kTotal | kWithin | Eigengene corr |
|---|---|---|---|---|---|
| 1 | CNS | neuronal development | 1425 | 702 | 0.8 |
| 2 | thymus/spleen | immune system | 579 | 62 | 0.8 |
| 3 | CNS | neuronal development | 885 | 545 | 0.7 |
| 4 | adult tissue | metabolism | 1023 | 528 | −0.8 |
| 5 | mammary epithelium | epithelia | 2350 | 1565 | 0.9 |
| 6 | mammary epithelium | epithelia | 2424 | 1615 | 0.9 |
| 7 | adult tissue | metabolism | 699 | 252 | −0.5 |
| 8 | mammary epithelium | epithelia | 1311 | 770 | 0.7 |
| 9 | mammary epithelium | epithelia | 2768 | 1811 | 1.0 |
| 10 | mammary epithelium | epithelia | 2120 | 1436 | 0.9 |
| 11 | adult tissue | metabolism | 845 | 369 | −0.7 |
| 12 | mammary epithelium | epithelia | 784 | 543 | 0.4 |
| 13 | CNS | neuronal development | 768 | 312 | −0.5 |
| 14 | PyMT tumor | odontogenesis | 1371 | 156 | 0.9 |
| 15 | mammary epithelium | epithelia | 2925 | 1923 | 1.0 |

TABLE 8-continued

Network modules of MaTARs

| MaTAR | Tissue expression | GO terms | kTotal | kWithin | Eigengene corr |
|---|---|---|---|---|---|
| 16 | mammary epithelium | epithelia | 2518 | 1633 | 0.9 |
| 17 | testis | spermatogenesis | 1562 | 1091 | 0.6 |
| 18 | embryonic liver | cell cycle | 742 | 74 | −0.7 |
| 19 | mammary | epithelium epithelia | 2190 | 1462 | 0.9 |
| 20 | mammary | epithelium epithelia | 979 | 531 | 0.5 |
| 21 | mammary | epithelium epithelia | 1717 | 1131 | 0.8 |
| 22 | mammary | epithelium epithelia | 1644 | 1132 | 0.8 |
| 23 | colon/intestine | digestion | 442 | 47 | 0.9 |
| 24 | mammary | epithelium epithelia | 739 | 268 | 0.4 |
| 25 | mammary | epithelium epithelia | 1599 | 1058 | 0.8 |
| 26 | mammary | epithelium epithelia | 1006 | 522 | 0.5 |
| 27 | CNS | neuronal development | 1400 | 720 | 0.8 |
| 28 | mammary | epithelium epithelia | 2308 | 1489 | 0.9 |
| 29 | CNS/embryonic proliferation | liver development, | 618 | 44 | 0.7 |
| 30 | mammary | epithelium epithelia | 3319 | 2178 | 1.0 |

Example 4: Antisense Inhibition of MaTARs in Primary Tumor Cells

Based on the computational results, it was proposed that MaTARs are driver genes in mammary cancer progression and/or metastasis and thus, could serve as novel therapeutic targets. This hypothesis was tested by performing antisense inhibition of MaTARs with ISIS oligonucleotides.

Antisense inhibition of 14 MaTARs was performed in primary MMTV-PyMT tumor cells to understand the role of MaTARs in mammary cancer progression and/or metastasis. To investigate the functional impact of MaTAR down-regulation on tumor cells, cell viability and invasion assays were conducted.

To generate primary mammary tumor cells, organoids were treated with 0.25% Trypsin and 0.1% EDTA in PBS for 5 min at 37° C. To stop the reaction, 10 mL DMEM/F12 medium supplemented with 10% FCS and 4 U/µL of DNase I (Sigma) was added and incubated for 15 min at 100 rpm and 37° C. The cell solution was spun down for 10 min at 520 g. The pellet was resuspended in 10 mL DMEM/F12 with 10% FCS and 1% penicillin/streptomycin and filtered via a 70 µM cell strainer. Three additional washing steps (centrifugation for 5 min at 520 g, resuspension of the pellet in 10 mL DMEM/F12 with 10% FCS and 1% penicillin/streptomycin) were performed. The final cell pellet was resuspended and cultured in DMEM/F12 medium supplemented with 10% FCS, 1% penicillin/streptomycin, and 5 µg/mL insulin (Sigma).

ISIS oligonucleotides tested in the assay, were designed as 5-10-5 MOE gapmers, and are 20 nucleosides in length, wherein the central gap segment is comprised of ten 2'-deoxynucleosides and is flanked on both sides (in the 5' and 3' directions) by wings comprising 5 nucleosides each. Each nucleoside in the 5' wing segment and each nucleoside in the 3' wing segment has a 2'-MOE modification. The internucleoside linkages throughout the gapmer are phosphorothioate (P=S) linkages. All cytosine residues throughout the gapmer are 5-methylcytosines. The ISIS oligonucleotide sequences are presented in the Table below. The MaTARs targeted by the ISIS oligonucleotides are also shown in the Table below. 'scASO' is a control oligonucleotide that is a 5-10-5 MOE gapmer with no known murine target.

TABLE 9

ISIS oligonucleotides targeting MaTARS

| MaTAR | ISIS No. | Sequence | SEQ ID NO |
|---|---|---|---|
| 1 | 710749 | TTTATGCTGGGACTAGTGAC | 157 |
| 3 | 710776 | TAACTCACTAATTTGGTAAA | 158 |
| 4 | 710763 | CGTCACCTACACTGAGGAGC | 159 |
| 5 | 710625 | CTCAGAGCTCAAAAGTTTTC | 160 |
| 6 | 710849 | CAGGCCCACAGCAGGCTCAA | 112 |
| 7 | 710716 | TCCCTCTGAGATCAAGCGGC | 161 |
| 8 | 710855 | CGGGTTGCTTTAGAGTGTTC | 162 |
| 9 | 714133 | TGGAGCTGATGGGCTTTTTG | 113 |
| 10 | 714110 | GCTGCGAGCACCCCTTCATT | 137 |
| 11 | 710707 | CAGGATCTCTGATGTGCAGG | 114 |
| 12 | 710814 | GGGATGAGCTCAGCCGGATC | 115 |
| 13 | 714039 | TATCAGGGTAGGTATCACAT | 116 |
| 14 | 714142 | TGATGTCTCATGACTGAGAG | 139 |
| 15 | 710700 | CATTCAGGTAATGTGTCACA | 163 |
| 16 | 710798 | TAAAGATATTGTCCCGTTGG | 117 |
| 17 | 710784 | TTACCAATTGAGCGACATCT | 118 |
| 18 | 710838 | CCCACAGGAGTTAGGGCTGC | 119 |
| 19 | 714079 | CAGGTGAAGCCACTCCTGCT | 164 |
| 20 | 710728 | GCTGGTCCAGAGAGCTTTCC | 120 |
| 21 | 710640 | CAGGCCCAGCCAGGTGCTTA | 165 |
| 22 | 710829 | TACCTTGACATTCCATGTAG | 121 |
| 23 | 714051 | AAGAACTTTTTAATATATAG | 166 |
| 24 | 710679 | TGCTTTATCCCATTGCAAGC | 150 |
| 25 | 710806 | GAAACACCCAGGTCATCCAG | 122 |
| 26 | 710752 | TAGCTGATGTTGCTGTAGCT | 123 |
| 27 | 714129 | CTCATTGTACTGCTTGCTGA | 167 |
| 28 | 710740 | TCAATCTTACAACAGCAAAG | 124 |
| 29 | 714102 | AGTCTGGCTTGGCCATGGCA | 168 |
| 30 | 714043 | TGCTGGTGCTGGACCAGGGC | 125 |
| scASO | 141923 | CCTTCCCTGAAGGTTCCTCC | 126 |

Antisense Inhibition

MMTV-PyMT primary cells were seeded at a density of 20,000 cells/well into 96-well plates. Transfection-free uptake of oligonucleotide was accomplished by adding 5 µM of either a MaTAR-specific oligonucleotide or the scASO to the primary cell culture medium immediately after seeding the cells. Cells were incubated for 24 hours at 37° C. and RNA was isolated using the RNeasy 96 kit (Qiagen), according to the manufacturer's instructions. RNA samples were used directly in a one-step 384-well qRT-PCR (QuantiTect SYBR Green RT-PCR Kit, Qiagen) on an Applied Biosystems 7900HT Fast Real-Time PCR System (Thermo Fisher Scientific). The results are presented in the Table below, and indicate knockdown efficiencies ranging from 38% for MaTAR26 to 89% for MaTAR13 after 24 hours.

TABLE 10

Antisense inhibition of MaTARs
in primary MMTV-PyMT cells

| MaTAR | ISIS No | % inhibition |
|---|---|---|
| 1 | 710749 | 64 |
| 3 | 710776 | 51 |
| 4 | 710763 | 32 |
| 5 | 710625 | 47 |
| 6 | 710849 | 69 |
| 7 | 710716 | 68 |
| 8 | 710855 | 72 |
| 9 | 714133 | 55 |
| 10 | 714110 | 61 |
| 11 | 710707 | 74 |
| 12 | 710814 | 69 |
| 13 | 714039 | 89 |
| 14 | 714142 | 68 |
| 15 | 710700 | 45 |
| 16 | 710798 | 47 |
| 17 | 710784 | 53 |
| 18 | 710838 | 52 |
| 19 | 714079 | 68 |
| 20 | 710728 | 72 |
| 21 | 710640 | 65 |
| 22 | 710829 | 54 |
| 23 | 714051 | 51 |
| 24 | 710679 | 57 |
| 25 | 710806 | 64 |
| 26 | 710752 | 38 |
| 27 | 714129 | 97 |
| 28 | 710740 | 69 |
| 29 | 714102 | 61 |
| 30 | 714043 | 55 |

Cell Viability

MMTV-PyMT primary tumor cells were seeded at a density of 10,000 cells/well into 96-well plates and treated with 5 µM of either a MaTAR-specific ISIS oligonucleotide or scASO. Cells were grown for 72 hours at 37° C. MTT solution at 10 µL volume (Cell Growth Determination Kit, MTT based; Sigma) was added to the wells and incubated for 4 hours at 37° C. Next, 100 µL MTT solvent was added directly to the wells to ensure total solubility of the formazan crystals and incubated for 10 min with shaking. Measurements of absorbance at 570 nm were performed using a SpectraMax i3 Multi-Mode Detection Platform (Molecular Devices). Background absorbance at 690 nm was subtracted. Percent viability in the ISIS oligonucleotide-treated wells was calculated as a percentage of the control. Significant changes were defined as a consistent reduction ≥25% of viability or invasion compared to untreated control cells. The results indicated that knockdown of MaTAR12 lead to a 50% decrease in cell viability. Additionally, inhibition of MaTAR11, 18, and 20 also had a 20-30% decrease in cell viability. There was no effect on cell viability with the scASO.

To confirm the results obtained with the MTT assay, protease activity within living cells was measured separately on a subset of the MaTARs and similar results were obtained.

TABLE 11

Cell viability (% untreated control)
after antisense inhibition of MaTARs

| MaTAR | ISIS No | % viability |
|---|---|---|
| 1 | 710749 | 117 |
| 3 | 710776 | 99 |
| 4 | 710763 | 108 |
| 5 | 710625 | 98 |
| 6 | 710849 | 77 |
| 7 | 710716 | 93 |
| 8 | 710855 | 101 |
| 9 | 714133 | 88 |
| 10 | 714110 | 86 |
| 11 | 710707 | 75 |
| 12 | 710814 | 49 |
| 13 | 714039 | 100 |
| 14 | 714142 | 105 |
| 15 | 710700 | 105 |
| 16 | 710798 | 101 |
| 17 | 710784 | 87 |
| 18 | 710838 | 73 |
| 19 | 714079 | 95 |
| 20 | 710728 | 70 |
| 21 | 710640 | 94 |
| 22 | 710829 | 95 |
| 23 | 714051 | 103 |
| 24 | 710679 | 102 |
| 25 | 710806 | 106 |
| 26 | 710752 | 90 |
| 27 | 714129 | 102 |
| 28 | 710740 | 104 |
| 29 | 714102 | 83 |
| 30 | 714043 | 81 |

Invasion Potential

The invasion potential of MMTV-PyMT primary tumor cells was assessed using the QCM 96-well Invasion Assay Kit (ECM555; Millipore). Cells were starved in DMEM/F12 serum-free medium for 24 hours, then harvested and seeded at a density of $1\times10^5$ cells/well into the invasion chamber. MaTAR-specific ISIS oligonucleotide or scASO at 5 µM was added to the growth medium. The plate was incubated at 37° C. for 24 hours and the assay was performed according to the manufacturer's instructions. Briefly, the tumor cells that invaded the ECM layer and attached to the bottom of the invasion chamber were collected using cell detachment solution and lysed in 1: 75 CyQuant GR dye lysis buffer. As a negative control, serum-free medium was used that did not stimulate cell invasion through the ECM. 150 µL of cell lysates were transferred to a new 96-well plate and the fluorescence was measured with a SpectraMax i3 Multi-Mode Detection Platform (Molecular Devices) using the 480 nm/520 nm filter set. The results are presented in the Table below. Significant reduction of tumor cell invasion upon antisense inhibition of MaTAR13 (49% inhibition) and MaTAR9 (36% inhibition) was detected. Furthermore, 25-45% reduction of invasive potential was observed upon independent knockdown of 15 candidates; MaTAR8, 9, 13, 14, 15, 16, 17, 19, 20, 21, 23, 24, 25, 28, and 29.

TABLE 12

Invasive potential (% control) after
antisense inhibition of MaTARs

| MaTAR | % invasion |
|---|---|
| 25 | 55 |
| 16 | 58 |
| 21 | 59 |
| 24 | 60 |
| 23 | 65 |
| 15 | 65 |
| 17 | 65 |

TABLE 12-continued

Invasive potential (% control) after antisense inhibition of MaTARs

| MaTAR | % invasion |
|---|---|
| 9 | 65 |
| 20 | 68 |
| 8 | 69 |
| 13 | 70 |
| 29 | 70 |
| 19 | 72 |
| 14 | 74 |
| 28 | 75 |
| 7 | 79 |
| 30 | 82 |
| 22 | 83 |
| 11 | 87 |
| 10 | 88 |
| 18 | 88 |
| 3 | 88 |
| 27 | 94 |
| 5 | 95 |
| 26 | 95 |
| 6 | 101 |
| 4 | 102 |
| 1 | 111 |
| 12 | 121 |
| scASO | 77 |
| Serum-free control | 14 |

While 9 of the 14 tested MaTARs seem to impact either the viability or the invasive potential of mammary tumor cells, indicating specific roles of the different non-coding transcripts in cellular processes, two MaTARs (11 and 20) show effects in both assays. Viability and invasion potential also correlated well with knockdown efficiency of the ISIS oligonucleotides. The data is summarized in the Table below. Reduction of viability, invasive potential or branching of >25% compared to untreated cells is defined as a significant difference and is marked with an asterisk. These results also confirm that the initial computational selection of up-regulated lncRNAs indeed identified transcripts that have the potential to act as driver genes in tumor progression.

TABLE 13

Observed effects after antisense inhibition of MaTARs

|  | Viability | Invasion | Branching |
|---|---|---|---|
| MaTAR1 | 117 | 111 | 99 |
| MaTAR3 | 99 | 88 | 83 |
| MaTAR4 | 108 | 102 | 88 |
| MaTAR5 | 98 | 95 | 83 |
| MaTAR6 | 77* | 101 | 75* |
| MaTAR7 | 93 | 79* | 87 |
| MaTAR8 | 101 | 69* | 87 |
| MaTAR9 | 88 | 65* | 82 |
| MaTAR10 | 86 | 88 | 78 |
| MaTAR11 | 75 | 87 | 72 |
| MaTAR12 | 49* | 121 | 50* |
| MaTAR13 | 100 | 70* | 80 |
| MaTAR14 | 105 | 74* | 81 |
| MaTAR15 | 105 | 65* | 85 |
| MaTAR16 | 101 | 58* | 62* |
| MaTAR17 | 87 | 65* | 61* |
| MaTAR18 | 73* | 88 | 60* |
| MaTAR19 | 95 | 72* | 71* |
| MaTAR20 | 70* | 68* | 68* |
| MaTAR21 | 94 | 59* | 86 |
| MaTAR22 | 95 | 83 | 83 |
| MaTAR23 | 103 | 65* | 84 |
| MaTAR24 | 102 | 60* | 86 |
| MaTAR25 | 106 | 55* | 56* |

TABLE 13-continued

Observed effects after antisense inhibition of MaTARs

|  | Viability | Invasion | Branching |
|---|---|---|---|
| MaTAR26 | 90 | 95 | 65* |
| MaTAR27 | 102 | 94 | 77 |
| MaTAR28 | 104 | 75* | 57* |
| MaTAR29 | 83 | 70* | 78 |
| MaTAR30 | 81 | 82 | 85 |

Example 5: Effect of Antisense Inhibition of MaTARs in Organoids

To further elucidate the functional role of MaTARs in a more physiological context, antisense inhibition was performed in mammary tumor organoids (Barcellos-Hoff et al, Development 105: 223-235, 1989; Fata et al, Dev. Biol. 306: 193-207, 2007; Ewald et al, Dev. Cell 14: 570-581, 2008; Nguyen-Ngoc et al, Proc. Natl. Acad. Sci. USA 109: E2595-604, 2012). Organoids mimic aspects of the three-dimensional organization of an organ more closely than individual cells cultured in two-dimension.

Organoids were prepared and cultured as described in the Examples above. ISIS oligonucleotides tested in the assay, were designed as 5-10-5 MOE gapmers, and are 20 nucleosides in length, wherein the central gap segment is comprised of ten 2'-deoxynucleosides and is flanked on both sides (in the 5' and 3' directions) by wings comprising 5 nucleosides each. Each nucleoside in the 5' wing segment and each nucleoside in the 3' wing segment has a 2'-MOE modification. The internucleoside linkages throughout the gapmer are phosphorothioate (P=S) linkages. All cytosine residues throughout the gapmer are 5-methylcytosines. The ISIS oligonucleotide sequences are presented in the Table below. The MaTARs targeted by the ISIS oligonucleotides are also shown in the Table below. For some MaTARs, multiple ISIS oligonucleotides were designed to different regions of the transcript.

TABLE 14

ISIS oligonucleotides tested in mammary tumor organoids

| MaTAR | ISIS No. | sequence | SEQ ID NO |
|---|---|---|---|
| 1 | 710743 | AAAGCCATCGGCAGTTTCCA | 127 |
| 3 | 710773 | AGTCCTGCTCGGCATGAATT | 128 |
| 4 | 710765 | GAAACCTCGGACTTTATTCA | 129 |
| 5 | 710631 | TTAGAGTTGTTCACAGTCGG | 130 |
| 6 | 710845 | CTGGAGGAGGAACAGTTTCA | 131 |
| 7 | 710712 | TGTAGCCACTGCCACCACCA | 132 |
|  | 710719 | ACCCATTGCTTCTGAGCAGA | 133 |
| 8 | 710856 | CCTTTCTAAGATGACACATT | 134 |
|  | 710858 | ACATTAGGAGGCCAACTCAG | 135 |
| 9 | 714132 | CCGGAGGATGACCAGTGTGG | 136 |
| 10 | 714110 | GCTGCGAGCACCCCTTCATT | 137 |
| 11 | 710707 | CAGGATCTCTGATGTGCAGG | 114 |
| 12 | 710814 | GGGATGAGCTCAGCCGGATC | 115 |
| 13 | 714039 | TATCAGGGTAGGTATCACAT | 116 |
|  | 714040 | AAGGGTACAGTTTGCTCTGC | 138 |
| 14 | 714142 | TGATGTCTCATGACTGAGAG | 139 |
| 15 | 710697 | GTTGGTTCTGCAGCTTTATC | 140 |
| 16 | 710795 | CTTTCACACTGGGTGAGTAT | 141 |
|  | 710797 | CACTTCCAGTAAGATTACAT | 142 |
|  | 710798 | TAAAGATATTGTCCCGTTGG | 117 |
| 17 | 710783 | CATCTTCAAAGGCAACTGGC | 143 |
|  | 710784 | TTACCAATTGAGCGACATCT | 118 |
| 18 | 710833 | CTGGCATAGCTGCAGGCAAA | 144 |
|  | 710836 | TTCAAGCCCATATGTGAGGC | 145 |
|  | 710838 | CCCACAGGAGTTAGGGCTGC | 119 |

TABLE 14-continued

ISIS oligonucleotides tested in mammary tumor organoids

| MaTAR | ISIS No. | sequence | SEQ ID NO |
|---|---|---|---|
| 19 | 714077 | TGCAGCCAGGGAGAGGCACA | 146 |
| 20 | 710728 | GCTGGTCCAGAGAGCTTTCC | 120 |
| 21 | 710635 | GCTGCTTCCTCTGCCAGAAG | 147 |
| 22 | 710828 | TTGTCCATAGGTTCAGAGGT | 148 |
| 23 | 714057 | CAGGACCCATAGTGGTTTGC | 149 |
| 24 | 710679 | TGCTTTATCCCATTGCAAGC | 150 |
| 25 | 710804 | GAGTCTGGACACATGATACT | 151 |
| 26 | 710752 | TAGCTGATGTTGCTGTAGCT | 123 |
|  | 710759 | GCCTCAAGTTTACCAGTAGG | 152 |
|  | 710761 | CCCCAAGACATTATTTAAGG | 153 |
| 27 | 714128 | AGCCACTGATCCATTTATTG | 154 |
| 28 | 710740 | TCAATCTTACAACAGCAAAG | 124 |
|  | 710741 | GTGGATCTTGGATTGGCTGC | 155 |
| 29 | 714107 | TCCCATTGCTGGTGCTGGAC | 156 |
| 30 | 714043 | TGCTGGTGCTGGACCAGGGC | 125 |
| scASO | 141923 | CCTTCCCTGAAGGTTCCTCC | 126 |

Organoids were seeded at a density of 5 organoids/4 and plated as 80 µL domes in Cellstar 24-well dishes (Greiner Bio One). Transfection-free uptake of ISIS oligonucleotides was accomplished by adding 4 µM of either a MaTAR-specific oligonucleotide or scASO to the organoid medium 15-20 min after the organoids were plated in the matrigel domes. Organoids were incubated for 6 days at 37° C. and both medium and oligonucleotide were replenished at day 3. Knockdown efficiencies in the organoids ranged from 30-68% after 6 days of treatment. The results are presented in the Table below.

TABLE 15

Antisense inhibition of MaTARs in mammary tumor organoids

| MaTAR | % inhibition |
|---|---|
| 1 | 34 |
| 3 | 44 |
| 4 | 30 |
| 5 | 49 |
| 6 | 42 |
| 7 | 52 |
| 8 | 67 |
| 9 | 53 |
| 10 | 56 |
| 11 | 68 |
| 12 | 50 |
| 13 | 66 |
| 14 | 55 |
| 15 | 36 |
| 16 | 48 |
| 17 | 51 |
| 18 | 47 |
| 19 | 50 |
| 20 | 50 |
| 21 | 64 |
| 22 | 48 |
| 23 | 46 |
| 24 | 37 |
| 25 | 46 |
| 26 | 43 |
| 27 | 60 |
| 28 | 61 |
| 29 | 50 |
| 30 | 34 |

Culturing organoids for several days also allowed observation of phenotypic changes caused by the knockdown. Untreated MMTV-PyMT organoids, as well as organoids treated with scASO, generally exhibited branching in about 70-75% of all organoids. Treatment with ISIS oligonucleotides resulted in a decrease by 25-50% in branching morphogenesis for MaTAR6, 11, MaTAR12, 16, 17, 18, 19, 20, 25, 26, and 28. There was also a decrease of 20-30% for MaTAR6, 10, 11, 19, 27, and 29. The results are presented in the Table below. The mean of two biological replicates is shown; the total number of assayed organoids per treatment was 200.

Many of the MaTARs that interfered with cell viability and/or invasion in 2D assays also inhibited branching defects in the organoids. For instance, antisense inhibition of MaTAR17 and MaTAR28 caused a reduction in organoid branching and both transcripts demonstrate a role in invasion in 2D culture (as shown in Tables 9 and 10).

TABLE 16

Quantification of tumor organoid branching in mammary tumor organoids

|  | % branched organoids |
|---|---|
| Untreated cells | 73 |
| scASO | 70 |
| MaTAR12 | 37 |
| MaTAR25 | 41 |
| MaTAR28 | 42 |
| MaTAR18 | 44 |
| MaTAR17 | 45 |
| MaTAR16 | 46 |
| MaTAR26 | 47 |
| MaTAR20 | 50 |
| MaTAR19 | 52 |
| MaTAR11 | 53 |
| MaTAR6 | 55 |
| MaTAR27 | 56 |
| MaTAR10 | 57 |
| MaTAR29 | 57 |
| MaTAR13 | 59 |
| MaTAR14 | 59 |
| MaTAR9 | 60 |
| MaTAR5 | 60 |
| MaTAR22 | 61 |
| MaTAR3 | 61 |
| MaTAR23 | 61 |
| MaTAR30 | 62 |
| MaTAR15 | 62 |
| MaTAR24 | 63 |
| MaTAR21 | 63 |
| MaTAR7 | 63 |
| MaTAR8 | 64 |
| MaTAR4 | 65 |
| MaTAR1 | 72 |

Further studies were conducted with antisense inhibition of MaTAR16 (ENSMUSG00000086249, Gm12724), MaTAR18 (ENSMUSG00000085873, Ttc39aos1), and MaTAR26 (ENSMUSG00000097378, B230208H11Rik). The three lncRNA represent different gene biotypes; MaTAR16 is classified as 'processed transcript', MaTAR18 as 'antisense', and MaTAR26 as 'lincRNA'. Both MaTAR16 and MaTAR26 are part of the "mammary epithelium" module, while MaTAR18 resides in another highly interesting module that is comprised of the gene-expression signature for embryonic stem cells and embryonic liver. Knockdown experiments were performed with three different ISIS oligonucleotides for each transcript to ensure that the observed phenotypes were not caused by off-target effects. Treatment with ISIS oligonucleotides followed the same protocol as described above. The potency of each ISIS oligonucleotide is presented in the Table below.

Phenotypes of the organoids after treatment with the two most potent ISIS oligonucleotides per transcript are shown in comparison to organoids that were either untreated or treated with scASO (FIG. 1). Knockdown of MaTAR16 and MaTAR26 completely abolished organoid branching, while down-regulation of MaTAR18 resulted in organoids without defined branches and only tiny protrusions. In addition, it was observed that organoids treated with ISIS oligonucleotides targeting MaTAR16 were smaller than untreated or scASO-treated organoids. Individual knockdown efficiencies correlate well with the quantitation of branching, as shown in the Table below. Compared to untreated controls, there was reduction in branching of 48% for MaTAR16, 40% for MaTAR18, and 35% for MaTAR26, with the most potent ISIS oligonucleotide, respectively.

TABLE 17

Effect of inhibition of MaTARs on branching

|  | ISIS No | % inhibition | % branched organoids |
|---|---|---|---|
| MaTAR16 | 710797 | 24 | 60 |
|  | 710795 | 47 | 47 |
|  | 710798 | 61 | 39 |
| MaTAR18 | 710833 | 33 | 62 |
|  | 710836 | 51 | 43 |
|  | 710838 | 68 | 45 |
| MaTAR26 | 710761 | 32 | 59 |
|  | 710752 | 41 | 44 |
|  | 710759 | 41 | 46 |

To further support the role of MaTAR16, MaTAR18, and MaTAR26 as key genes in tumor progression, antisense inhibition of these MaTARs was performed in control organoids derived from WT nulliparous mammary glands. Antisense inhibition of each MaTAR is presented in the Table below. Knockdown efficiencies of the ISIS oligonucleotides were comparable to that in tumor organoids. However, there was no observed loss of branching in the normal mammary gland organoids after ISIS oligonucleotide treatment, strongly indicating the cancer-specific role of these three lncRNAs (FIG. 2). In addition, this experiment served as another control, confirming that the observed reduction in branching morphogenesis of tumor organoids is not due to ASO-induced toxicity or off-target effects.

Data on branching quantitation is also presented in the Table below. The mean of three biological replicates is shown; the total number of assayed organoids per treatment was 300. Branching in untreated organoids was 67% and in scASO-treated organoids was 57%.

TABLE 18

Effect of inhibition of MaTARs on branching in normal mammary organoids

|  | ISIS No | % inhibition | % branched organoids |
|---|---|---|---|
| MaTAR16 | 710795 | 60 | 46 |
|  | 710798 | 50 | 51 |

TABLE 18-continued

Effect of inhibition of MaTARs on branching in normal mammary organoids

|  | ISIS No | % inhibition | % branched organoids |
|---|---|---|---|
| MaTAR18 | 710836 | 44 | 54 |
|  | 710838 | 30 | 50 |
| MaTAR26 | 710752 | 40 | 49 |
|  | 710759 | 38 | 49 |

In order to exclude the possibility that the results were dependent on the genomic background of the mice, these findings were confirmed in organoids derived from C57/Bl6 MMTV-PyMT mice. Knockdown efficiencies and branching quantification in that model are presented in the Table below and FIG. 3. The mean of three biological replicates is shown; totally number of assayed organoids per treatment was 300. The results indicate that treatment with ISIS oligonucleotides resulted in very similar phenotypes for MMTV-PyMT organoids generated from both FVB and C57/Bl6 backgrounds.

TABLE 19

Effect of inhibition of MaTARs in C57/Bl6 MMTV-PyMT mammary organoids

|  | ISIS No | % inhibition | % branched organoids |
|---|---|---|---|
| MaTAR16 | 710795 | 50 | 47 |
|  | 710798 | 41 | 46 |
| MaTAR18 | 710836 | 43 | 44 |
|  | 710838 | 43 | 47 |
| MaTAR26 | 710752 | 43 | 51 |
|  | 710759 | 39 | 46 |

Example 6: Identification of Human Orthologs of MaTAR Genes

To confirm the relevance of MaTARs in breast cancer, the human orthologs of many of the MaTAR genes were identified.

Mouse and human transcripts were compared on the level of both sequence conservation and genomic location. If the mouse MaTAR sequence matched an annotated human gene using BLAT (BLAST-like alignment tool), the respective transcript was defined as the human counterpart of the mouse MaTAR. Since many non-coding RNAs are conserved between different species on the level of genomic location rather than based on sequence, the analysis was extended to synteny by analyzing the neighboring genes of each hMaTAR gene. The complete list of the genomic location of potential human MaTARs (hMaTARs) are provided in the Table below. Many hMaTARs are located in clusters of two or more non-coding genes in the genome, resulting in a total of 41 identified potential hMaTARs. 'r.i' indicates a retained intron; 'p.t.' indicates a processed transcript.

TABLE 20

| MaTAR | Mouse gene name | Human counterpart (seq, hg38) | Human counterpart (synteny, hg38) | Human gene location (hg38) | SEQ ID NOs |
|---|---|---|---|---|---|
| MaTAR1 | C130071C03Rik | LINC00461 | LINC00461 | chr5:88540779-88684803 (−) | 1 |
| MaTAR2 | Gm7582 | FAM96B | — | chr16:66932055-66934423 (−) | 2 |
| MaTAR3 | A730020E08Rik | AF065393.1 | un-annotated sequence upstream of Ccser1 (seq and synteny) | chr4:90121784-90121954 (−) | 3 |
| MaTAR4 | Hotairm1, Gm15051, Hoxaas1 | HOTAIRM1 | HOTAIRM1 | chr7:27096094-27100258 (+) | 4 |
| MaTAR5 | Gm14046 | PPIAP22 | — | chr21:18857779-18858276 (+) | 5 |
| MaTAR6 | 4833427F10Rik | HCG20 | cluster of lncRNAs in both mouse and human. HCG20 or LINC00243 | chr6:30766825-30792250 (+), chr6:30812866-30830659 (−) | 6-7 |
| MaTAR7 | Foxd2os, 9130206I24Rik | FOXD2-AS1 | — | chr1:47432133-47434641 (−) | 8 |
| MaTAR8 | Gm20544, lncRNA-Smad7 | — | un-annotated sequence upstream of Smad7 (seq and synteny); alternatively: RP11-1058N17.1 | chr18:48955665-48956059 (+) | 9-10 |
| MaTAR9 | Gm5637 | ARPC1B r.i./p.t., PDAP1 | — | chr7:99374675-99394781 (+), chr7:99394676-99408682 (−) | 11-12 |
| MaTAR10 | Gm9025, Ncf2-rs | NCF2 | cluster of many lncRNAS upstream of MAP3K1, most likely: RPL26P19 | chr1:183555563-183590876 (−) | 13-17 |
| MaTAR11 | AI427809, LOC381524 | — | un-annotated sequence upstream of ABCA1 within a cluster of non-coding RNAs, most likely: RP11-217B7.2 | chr9:104927553-104928892 (+) | 18 |
| MaTAR12 | Gm16010 | — | un-annotated sequence upstream/exon1 of SPSB4; alternatively: RP11-231L11.1 | chr3:141050613-141052013 (−), chr3:141115124-141124182 (−) | 19-20 |
| MaTAR13 | Gm15433 | — | AC009950.2 | chr2:230125310-230167494 (+) | 21 |
| MaTAR14 | Gm16025 | SP140 r.i. | — | chr2:230309741-230311581 (−), chr2:230401360-230401793 (−) | 22-23 |
| MaTAR15 | Gm6977 | FTH1P8 | cluster of non-coding RNAs and retrotransposons downstream of MAGEB1, most likely: GS1-383H3.7 | chrX:148052233-148052746 (+), chrX:30290047-30290351 (−) | 24-26 |
| MaTAR16 | Gm12724 | — | RP11-101C11.1 | chr1:55217861-55234177(+) | 27-28 |
| MaTAR17 | 4933404O12Rik | AF065393.1 | RP11-132A1.4 | chr7:101308346-101310985 (+) | 29-31 |
| MaTAR18 | Ttc39aos1, Gm12750 | TTC39A-AS1 | TTC39A-AS1 | chr1:51329654-51331281(+) | 32 |
| MaTAR19 | Gm15753 | — | RP11-44M6.1 | chr7:100509717-100519926 (+) | 33 |
| MaTAR20 | Gm13387 | — | RP13-122B23.8 | chr9:137293868-137295721 (−) | 34-35 |
| MaTAR21 | Gm2420 | SFI1 r.i./p.t. | — | chr22:31617011-31617070 (+) | 36 |
| MaTAR22 | 4930430E12Rik | — | RP11-114M5.3 | chr8:58503588-58504068 (+) | 37 |
| MaTAR23 | Naip3, Birc1c, EG667838, Naip-rs5 | NAIP | — | chr5: 70968483-71025114 (−) | 38 |
| MaTAR24 | Gm12504 | PTMAP5 | HMGB3P24 | chr13: 81689911-81691072 (+), chr9:36303499-36304924 (−) | 39-40 |

TABLE 20-continued

Potential human counterparts of MaTARs (hMaTARs)

| MaTAR | Mouse gene name | Human counterpart (seq, hg38) | Human counterpart (synteny, hg38) | Human gene location (hg38) | SEQ ID NOs |
|---|---|---|---|---|---|
| MaTAR25 | 1200007C13Rik | — | cluster of four/three lncRNAs in both mouse and human. LINC01271, LINC01270 or LINC01272 | chr20:50310711-50321342 (−), chr20:50292720-50314922 (+), chr20:50267486-50279795 (+) | 41-43 |
| MaTAR26 | B230208H11Rik | — | un-annotated sequence downstream of STX11 (seq and synteny), alternatively: TPT1P4 or RP1-91J24.1 | chr6:144200447-144200965 (−), chr6:144257034-144257624 (−) | 44-46 |
| MaTAR27 | Gm4750 | ACTB | AC234031.1 | chr7:5527155-5529569 (−), chrX:53001527-53001617 (+) | 47-48 |
| MaTAR28 | Gm12730 | — | RP11-101C11.1 or GYG1P3 | chr1:55217861-55234177 (+), chr1:55222379-55223372 (+) | 49-51 |
| MaTAR29 | Gm14328 | — | RP11-699C17.1 | chr18:50256036-50256461 (−) | 52-53 |
| MaTAR30 | Gm6166 | — | RP11-151H2.3 | chr15:74976240-74976573 (−) | 54-56 |

To evaluate the expression status of the potential hMaTARs, RNA-seq data of The Cancer Genome Atlas (TCGA) was analyzed by comparing breast tumors to matched normal tissues of 103 individuals. The analysis was performed on the Cancer Genomics Cloud hosted by Seven Bridges Genomics (http://www.sbgenomics.com). Raw RNA-seq reads were mapped to hg38 and counted. The GENCODE v24 GTF was used as a reference. For each individual, the tumor and matched normal sample datasets were analyzed independently. Fold changes calculated for individuals were averaged and statistical significance was calculated using Wilcoxon rank tests; p-values were adjusted using the Benjamini & Hochberg method.

Out of 41 hMaTARs, there was differential gene expression observed in 40, as shown in the Table below. hMaTAR3 was dropped out due to insufficient read coverage (denoted as na). Notably, at least 28 hMaTARs were found to be up-regulated in breast tumors, 19 of these with high statistical significance (adj. p<0.05), confirming the results from the initial RNA-seq screen in mouse models that identified multiple lncRNAs as potentially clinically revelevant. 'log 2FC' indicates a log 2-fold change in an average of 103 patients; 'DE' indicates differential gene expression; 'adj. p-value' indicates Wilcoxon rank sum test, p-value adjusted using the Benjamini & Hochberg method.

TABLE 21

Differential expression of hMaTARs in breast tumors compared to normal tissue

| hMaTAR | Gene ID | Ensembl ID | log2FC | DE | adj. p-value |
|---|---|---|---|---|---|
| hMaTAR1 | LINC00461 | ENSG00000245526 | 0.81 | 1.76 | 6.40E−05 |
| hMaTAR2 | FAM96B | ENSG00000166595 | 0.14 | 1.10 | 2.75E−02 |
| hMaTAR3 | AF065393.1 | ENSG00000274152 | na | na | na |
| hMaTAR4 | HOTAIRM1 | ENSG00000233429 | −1.42 | 0.37 | 6.70E−15 |
| hMaTAR5 | PPIAP22 | ENSG00000198618 | 0.72 | 1.65 | 1.78E−15 |
| hMaTAR6.1 | HCG20 | ENSG00000228022 | 0.23 | 1.17 | 1.14E−02 |
| hMaTAR6.2 | LINC00243 | ENSG00000214894 | 1.03 | 2.04 | 1.60E−08 |
| hMaTAR7 | FOXD2-AS1 | ENSG00000237424 | 0.54 | 1.45 | 2.29E−07 |
| hMaTAR8 | RP11-1058N17.1 | ENSG00000266905 | 0.03 | 1.02 | 1.00E+00 |
| hMaTAR9 | PDAP1 | ENSG00000106244 | 0.40 | 1.32 | 4.02E−09 |
| hMaTAR10.1 | NCF2 | ENSG00000116701 | 0.44 | 1.35 | 7.94E−04 |
| hMaTAR10.2 | RPL26P19 | ENSG00000226221 | −0.43 | 0.74 | 9.44E−07 |
| hMaTAR11 | RP11-217B7.2 | ENSG00000226334 | −0.39 | 0.76 | 1.85E−04 |
| hMaTAR12.1 | SPSB4 | ENSG00000175093 | 0.03 | 1.02 | 1.00E+00 |
| hMaTAR12.2 | RP11-231L11.1 | ENSG00000251270 | −0.03 | 0.98 | 1.00E+00 |
| hMaTAR13 | AC009950.2 | ENSG00000225963 | −0.11 | 0.93 | 8.49E−01 |
| hMaTAR14 | SP140 | ENSG00000079263 | 0.74 | 1.67 | 2.58E−08 |
| hMaTAR15.1 | FTH1P8 | ENSG00000219507 | 0.10 | 1.07 | 1.69E−01 |
| hMaTAR15.2 | GS1-383H3.7 | ENSG00000270794 | 0.05 | 1.03 | 4.85E−02 |
| hMaTAR16 | RP11-101C11.1 | ENSG00000231090 | 0.02 | 1.01 | 7.40E−01 |
| hMaTAR17.1 | AZGP1P2 | ENSG00000214252 | 0.22 | 1.16 | 8.88E−01 |
| hMaTAR17.2 | RP11-132A1.4 | ENSG00000232445 | 0.90 | 1.87 | 3.09E−07 |
| hMaTAR18 | TTC39A-AS1 | ENSG00000261664 | 0.62 | 1.54 | 2.16E−03 |
| hMaTAR19 | RP11-44M6.1 | ENSG00000225807 | −0.32 | 0.80 | 7.49E−07 |

TABLE 21-continued

Differential expression of hMaTARs in breast tumors compared to normal tissue

| hMaTAR | Gene ID | Ensembl ID | log2FC | DE | adj. p-value |
|---|---|---|---|---|---|
| hMaTAR20 | RP13-122B23.8 | ENSG00000260996 | 0.38 | 1.30 | 2.26E−05 |
| hMaTAR21 | SFI1 | ENSG00000198089 | 0.29 | 1.22 | 2.87E−03 |
| hMaTAR22 | RP11-114M5.3 | ENSG00000254103 | −0.07 | 0.95 | 8.20E−02 |
| hMaTAR23 | NAIP | ENSG00000249437 | 0.09 | 1.07 | 1.00E+00 |
| hMaTAR24.1 | PTMAP5 | ENSG00000214182 | 0.47 | 1.38 | 2.46E−08 |
| hMaTAR24.2 | HMGB3P24 | ENSG00000215283 | −0.16 | 0.90 | 7.66E−02 |
| hMaTAR25.1 | LINC01270 | ENSG00000203999 | 0.33 | 1.25 | 3.14E−02 |
| hMaTAR25.2 | LINC01271 | ENSG00000233077 | 0.25 | 1.19 | 9.42E−03 |
| hMaTAR25.3 | L1NC01272 | EN5G00000224397 | 0.24 | 1.18 | 1.12E−01 |
| hMaTAR26.1 | TPT1P4 | EN5G00000217027 | −0.71 | 0.61 | 3.27E−09 |
| hMaTAR26.2 | RP1-91124.1 | EN5G00000216475 | −0.08 | 0.95 | 2.83E−01 |
| hMaTAR27.1 | ACTB | EN5G00000075624 | 0.45 | 1.37 | 1.36E−08 |
| hMaTAR27.2 | AC234031.1 | EN5G00000278536 | 0.00 | 1.00 | 1.00E+00 |
| hMaTAR28.1 | RP11-101C11.1 | EN5G00000231090 | 0.02 | 1.01 | 7.40E−01 |
| hMaTAR28.2 | GYG1P3 | ENSG00000231095 | 0.05 | 1.03 | 2.66E−01 |
| hMaTAR29 | RP11-699C17.1 | ENSG00000277310 | 0.33 | 1.26 | 2.97E−04 |
| hMaTAR30 | RP11-151H2.3 | ENSG00000261813 | −0.02 | 0.99 | 1.00E+00 |

Further investigation was conducted on whether hMaTARs are expressed in subtype-specific manner by analyzing all TCGA breast tumor samples with subtype information (463 datasets). The analysis of raw RNA-Seq reads was performed as described above. Transcript abundances were quantified using RSEM quantification suite (li and Dewey, 2011) with default parameters. For each resultant RNA expression profile, normalized read counts of individual genes were obtained by applying the DESeq normalization implemented in the DESeq Bioconductor package. Genes whose median expression count across profiles was zero were excluded from further consideration. Kruskal-Wallis non-parametric test was used to assess differential expression for each of the remaining genes and for three different data partitions: by molecular subtype, by the estrogen receptor status, and by the progesterone receptor status.

Of the 19 up-regulated hMaTARs, 11 had significantly different expression (q<5.00E-11, same range as PAM50 genes (Parker et al, 2009)) among the five TCGA subtypes "basal", "Her2-amplified", "luminal A", "luminal B", and "normal-like". The results are presented in the Tables below. 'Subtype' indicates the correlation with breast cancer subtype, q-values were determined by Kruskal-Wallis test; 'ER' indicates the correlation with the estrogen receptor status, q-values were determined by Wilcoxon test; 'PR' indicates correlation with the progesterone receptor status, q-values were determined by Wilcoxon test. A decimal point and number after each MaTAR signifies that there is more than one possible ortholog for that MaTAR.

TABLE 22

Correlation of hMaTAR expression and breast cancer subtype or hormone receptor status

| hMaTAR | Ensembl ID | Subtype q-value | ER q-value | PR q-value |
|---|---|---|---|---|
| hMaTAR1 | ENSG00000245526 | 1.80E−17 | 4.46E−11 | 3.98E−11 |
| hMaTAR2 | ENSG00000166595 | 2.60E−11 | 1.47E−06 | 5.64E−07 |
| hMaTAR4 | ENSG00000233429 | 1.77E−24 | 6.88E−07 | 2.02E−04 |
| hMaTAR6.1 | ENSG00000228022 | 4.03E−10 | 1.43E−07 | 2.06E−04 |
| hMaTAR6.2 | ENSG00000214894 | 3.46E−15 | 1.10E−11 | 4.64E−04 |
| hMaTAR7 | ENSG00000237424 | 1.71E−06 | 1.03E−01 | 8.10E−02 |
| hMaTAR9 | ENSG00000106244 | 6.63E−09 | 8.09E−08 | 4.88E−06 |
| hMaTAR10.1 | ENSG00000116701 | 5.47E−07 | 3.07E−03 | 9.89E−02 |
| hMaTAR11 | ENSG00000226334 | 4.11E−03 | 5.26E−02 | 2.44E−01 |
| hMaTAR12.1 | ENSG00000175093 | 3.70E−06 | 1.94E−02 | 2.12E−01 |
| hMaTAR13 | ENSG00000225963 | 5.41E−05 | 4.76E−03 | 2.56E−02 |
| hMaTAR14 | ENSG00000079263 | 2.37E−07 | 6.56E−05 | 2.43E−03 |
| hMaTAR17.2 | ENSG00000232445 | 2.81E−11 | 5.86E−08 | 5.13E−04 |
| hMaTAR18 | ENSG00000261664 | 5.54E−37 | 2.88E−29 | 1.46E−17 |
| hMaTAR20 | ENSG00000260996 | 2.06E−10 | 4.93E−07 | 9.96E−05 |
| hMaTAR21 | ENSG00000198089 | 5.84E−23 | 1.03E−21 | 5.66E−15 |
| hMaTAR23 | ENSG00000249437 | 1.76E−12 | 1.11E−15 | 5.48E−10 |
| hMaTAR25.1 | ENSG00000203999 | 1.62E−07 | 6.06E−06 | 1.03E−02 |
| hMaTAR25.2 | ENSG00000233077 | 1.25E−06 | 1.91E−04 | 6.48E−02 |
| hMaTAR25.3 | ENSG00000224397 | 1.14E−26 | 3.11E−16 | 3.79E−10 |
| hMaTAR27.1 | ENSG00000075624 | 1.25E−11 | 9.31E−11 | 4.80E−05 |
| hMaTAR29 | ENSG00000277310 | 3.01E−17 | 1.98E−14 | 1.55E−13 |

TABLE 23

Expression levels (log) of hMaTARs

| | Basal | Her2 | LumA | LumB | Normal |
|---|---|---|---|---|---|
| ENSG00000245526 (hMaTAR1) | 4.1 | 1.4 | 0.0 | 1.0 | 1.0 |
| ENSG00000233429 (hMaTAR4) | 6.1 | 4.5 | 5.1 | 4.2 | 6.2 |

TABLE 23-continued

| Expression levels (log) of hMaTARs | | | | | |
|---|---|---|---|---|---|
| | Basal | Her2 | LumA | LumB | Normal |
| ENSG00000214894 (hMaTAR6.2) | 1.8 | 3.5 | 3.5 | 3.1 | 3.6 |
| ENSG00000261664 (hMaTAR18) | 2.8 | 4.9 | 5.9 | 5.7 | 5.3 |
| ENSG00000198089 (hMaTAR21) | 9.0 | 9.3 | 9.8 | 9.9 | 9.5 |
| ENSG00000224397 (hMaTAR25.3) | 7.3 | 7.0 | 5.0 | 6.1 | 6.4 |
| ENSG00000075624 (hMaTAR27.1) | 17.6 | 17.6 | 17.2 | 17.1 | 17.3 |
| ENSG00000277310 (hMaTAR29) | 1.1 | 1.7 | 2.4 | 2.1 | 1.3 |

In addition, hMaTAR4 and hMaTAR23 showed strong subtype-specificity, indicating that these lncRNAs may be clinically relevant in certain subtypes despite not being significantly up-regulated across the board, as shown in Table 21.

hMaTAR1 lncRNA was up-regulated the most in the original screen (Tables 4 and 5) by 80- and >100-fold in Her2-amplified and PyMT tumors, respectively). hMATAR1 is also significantly over-expressed in breast tumors compared to normal breast tissue (Table 21). This analysis was confirmed using previously published TCGA datasets (Yan et al, 2015). A slight, but significant up-regulation was also detected in kidney carcinoma as well as substantial over-expression in lung squamous cell carcinoma, as shown in the Table below. FDR<0.00001; KIRC=kidney renal clear cell carcinoma; BRCA—breast invasive carcinoma; LUSC=lung squamous cell carcinoma.

TABLE 24

| Expression fold-change compared to normal of hMATAR1 published TCGA RNA-seq datasets | |
|---|---|
| Cancer type | Fold-change |
| KIRC | 0.08 |
| BRCA | 5.26 |
| LUSC | 5.88 |

Moreover, statistically significant differences in the expression levels of hMaTAR1 comparing different subtypes of breast cancer were observed with lowest level in the luminal A and highest levels in the basal subtype (Table 22). Notable, there was a strong correlation of high hMaTAR1 levels and negative ER/PR status, matching the subtype data. Similar observations were made for 7 additional hMaTARs (Table 23, and as shown in the Tables below).

TABLE 25

| Differential gene expression levels (log) of hMaTARs associated with estrogen receptor (ER) status | | |
|---|---|---|
| | ER Negative | ER Positive |
| ENSG00000245526 (hMaTAR1) | 3.7 | 0.6 |
| ENSG00000214894 (hMaTAR6.2) | 2.0 | 3.4 |
| ENSG00000261664 (hMaTAR18) | 3.2 | 5.7 |
| ENSG00000198089 (hMaTAR21) | 9.1 | 9.8 |
| ENSG00000249437 (hMaTAR23) | 9.0 | 10.0 |
| ENSG00000224397 (hMaTAR25.3) | 7.2 | 5.6 |
| ENSG00000075624 (hMaTAR27.1) | 17.6 | 17.2 |
| ENSG00000277310 (hMaTAR29) | 1.2 | 2.3 |

TABLE 26

| Differential gene expression levels (log) of hMaTARs associated with progestrone receptor (PR) status | | |
|---|---|---|
| | PR Negative | PR Positive |
| ENSG00000245526 (hMaTAR1) | 2.9 | 0.0 |
| ENSG00000261664 (hMaTAR18) | 4.4 | 5.7 |
| ENSG00000198089 (hMaTAR21) | 9.3 | 9.8 |
| ENSG00000249437 (hMaTAR23) | 9.2 | 10.0 |
| ENSG00000224397 (hMaTAR25.3) | 6.8 | 5.6 |
| ENSG00000277310 (hMaTAR29) | 1.4 | 2.3 |

For hMaTAR1, the effect of its expression on overall patient survival was assessed using the log-rank test to compare outcomes for patients in the top quartile by the expression of the candidate gene to those in the bottom quartile. Notably, the survival analysis revealed that patients with low levels of hMaTAR1 survive an average of 1,500 days (approximately 4 years) longer than patients with high levels of this lncRNA, as shown in the Table below.

TABLE 27

| Surival probability curve for luminal B subtype breast cancer | |
|---|---|
| Upper Quartile | Survival time (days) |
| Sample 1 | 612 |
| Sample 2 | 811 |
| Sample 3 | 825 |
| Sample 4 | 1365 |
| Sample 5 | 1563 |
| Sample 6 | 1694 |
| Sample 7 | 1699 |
| Sample 8 | 2551 |
| Lower Quartile | Survival time (days) |
| Sample 9 | 558 |
| Sample 10 | 1542 |
| Sample 11 | 2097 |
| Sample 12 | 2422 |
| Sample 13 | 2469 |
| Sample 14 | 3941 |

Pathway analysis of TCGA data was also performed and a significant positive correlation of pathways, such as cell cycle and DNA replication, was observed, indicating the high proliferative rate of tumors with elevated hMaTAR1 levels. The data is presented in the Table below. The canonical pathways that are significantly over-represented among genes strongly correlated with hMaTAR1 were determined. Gene lists for each of the reactome canonical pathways were downloaded from the Reactome database in GMT format and Wilcoxon rank tests were conducted to compare correlations with hMaTAR1 of the genes in the pathway to those of the genes outside the pathway. The resulting p-values were Bonferroni-corrected to account for the number of pathways for which the tests were conducted.

TABLE 28

Reactome pathways positively or negatively correlated to hMaTAR1 expression

| Reactome ID | p-value |
|---|---|
| Positive Correlation | |
| Cell cycle | 5.30E-17 |
| DNA replication | 8.96E-17 |
| Cell cycle mitotic | 3.92E-16 |
| Mitotic M M G1 Phases | 1.27E-13 |
| DNA strand elongation | 8.80E-08 |
| Mitotic G1 G1 S Phases | 1.86E-06 |
| Activation of the pre-replicative complex | 3.50E-06 |
| Chromosome maintenance | 4.46E-06 |
| G2 M Checkpoints | 6.83E-06 |
| Mitotic prometaphase | 8.38E-06 |
| Synthesis of DNA | 9.30E-05 |
| S phase | 1.20E-04 |
| Activation of ATR in response to replication stress | 1.30E-04 |
| M G1 transition | 1.50E-04 |
| G1 S Transition | 3.15E-04 |
| G1 S specific transcription | 1.01E-03 |
| Extension of telomeres | 1.63E-03 |
| Unwinding of DNA | 1.86E-03 |
| Negative Correlation | |
| Phospholipid metabolism | 1.01E-04 |
| Signaling of PDGF | 6.53E-04 |
| Metabolism of lipids and lipoproteins | 8.82E-04 |
| Signaling of NGF | 1.01E-03 |
| NGF signaling via TRKA from plasma membrane | 1.79E-03 |

Example 7: Antisense Inhibition of MaTARs In Vivo

To further elucidate the functional role of MaTARs, antisense inhibition of selected MaTARs was performed in MMTV-PyMT nice, representing the luminal B type of breast cancer. The effect of antisense inhibition of MaTAR in vivo by subcutaneous injections of antisense oligonucleotides into MMTV-PyMT (FVB) mice was conducted and tumor growth, progression, and metastasis were monitored.

Groups of 4 mice each were first injected with tumor cells. The treatment with antisense oligonucleotide was started when tumors were palpable (4-5 mm in diameter). Mice were injected subcutaneously three times a week with 50 mg antisense oligonucleotide per kg body weight per day, resulting in a weekly dose of 150 mg/kg of antisense oligonucleotide. Scrambled antisense oligonucleotide served as the control. Each Table represents an independent experiment. Tumor size was measured twice a week using calipers. Treatments continued until one of tumors reached 2 cm in diameter, after which the mice were euthanized. Antisense oligonucleotides complementary to MaTAR20, MaTAR28, MaTAR17, MaTAR25, and MaTAR3 were tested. The data is presented in the Table below. The results show that antisense inhibition resulted 52% reduction of tumor volume for MaTAR3, 22% reduction for MaTAR17, 17% reduction for MaTAR20, and 40% reduction for MaTAR25.

TABLE 29

Mean tumor volume (mm$^3$) after antisense inhibition of MaTAR20 and MaTAR28 expression

| Time point | scASO | MaTAR20 | MaTAR28 |
|---|---|---|---|
| Week 1 | 46 | 38 | 21 |
|  | 58 | 59 | 26 |
| Week 2 | 147 | 73 | 71 |
|  | 143 | 82 | 64 |
| Week 3 | 148 | 129 | 85 |
|  | 147 | 124 | 134 |
| Week 4 | 130 | 203 | 179 |
|  | 172 | 302 | 167 |
| Week 5 | 155 | 286 | 221 |
|  | 210 | 242 | 382 |
| Week 6 | 263 | 219 | 446 |
|  | 232 | 193 | 554 |
| Week 7 | 269 | 244 | 277 |

TABLE 30

Mean tumor volume (mm$^3$) after antisense inhibition of MaTAR17 and MaTAR25 expression

| Time point | scASO | MaTAR17 | MaTAR25 |
|---|---|---|---|
| Week 1 | 0 | 0 | 1 |
|  | 0 | 0 | 0 |
| Week 2 | 0 | 10 | 4 |
|  | 6 | 21 | 11 |
| Week 3 | 4 | 16 | 10 |
|  | 22 | 25 | 24 |
| Week 4 | 30 | 25 | 29 |
|  | 63 | 43 | 61 |
| Week 5 | 78 | 44 | 69 |
|  | 90 | 42 | 65 |
| Week 6 | 179 | 66 | 102 |
|  | 261 | 129 | 166 |
| Week 7 | 268 | 190 | 189 |
|  | 278 | 182 | 172 |
| Week 8 | 519 | 268 | 303 |
|  | 506 | 316 | 354 |
| Week 9 | 648 | 561 | 478 |
|  | 898 | 702 | 541 |

TABLE 31

Mean tumor volume (mm$^3$) after antisense inhibition of MaTAR3 expression

| Time point | scASO | MaTAR3 |
|---|---|---|
| Week 1 | 144 | 156 |
|  | 142 | 131 |
| Week 2 | 139 | 133 |
|  | 143 | 137 |
| Week 3 | 143 | 145 |
|  | 144 | 150 |
| Week 4 | 269 | 230 |
|  | 399 | 283 |
| Week 5 | 591 | 330 |
|  | 719 | 329 |
| Week 6 | 1123 | 546 |

All the mice were euthanized when one of the tumors reached 2 cm in diameter. The lungs were then examined for the presence of metastatic nodules. Nodules were counted and the data is presented in the Tables below. There was a 68% reduction in metastases in the lungs with antisense inhibition of MaTAR20 and 31% reduction with antisense inhibition of MaTAR3.

TABLE 32

Average number of metastatic modules after antisense inhibition of MaTAR expression

| Treatment | Average metastatic nodules |
|---|---|
| scASO | 15 |
| MaTAR17 | 20 |
| MaTAR20 | 5 |
| MaTAR25 | 19 |
| MaTAR28 | 17 |

TABLE 33

Average number of metastatic modules after antisense inhibition of MaTAR3 expression

| Treatment | Average metastatic nodules |
|---|---|
| scASO | 20 |
| MaTAR3 | 14 |

The results of the in vivo knockdown experiment are summarized in the Table below.

TABLE 34

Summary of antisense inhibition of MaTAR expression

| Candidate | ASO (Ionis no.) | Metastasis | Tumor growth |
|---|---|---|---|
| MaTAR3 | 710772 | −31% | −52% |
| MaTAR17 | 710783 | +36% | −22% |
| MaTAR20 | 710725 | −68% | −17% |
| MaTAR25 | 710806 | +23% | −40% |
| MaTAR28 | 710740 | +15% | +95% |

Example 8: CRISPR/Cas9-Mediated Knockout of MaTAR25

To confirm the results observed on antisense inhibition of MaTAR25, the CRISPR-Cas9 system (Ran et al, 2013) was used to generate genetic knockout clones of MaTAR25 in the highly metastatic mammary cell line 4T1. The results show that the genetic loss of MaTAR25 significantly reduced tumor cell invasion, recapitulating the antisense oligonucleotide-mediated knockdown.

By introducing Cas9 and two guide RNAs (gRNAs) targeting regions upstream and downstream of the transcription start site of MaTAR25, deletions of the MaTAR25 promoter region were generated, resulting in an efficient depletion of MaTAR25 expression. The results are presented in the Table below. As a negative control, Cas9 and a gRNA targeting Renilla luciferase was introduced into 4T1 cells, which is referred to as '4T1 control' below.

TABLE 35

Relative MaTAR25 expression compared to 4T1 control in the MaTAR25 knockout (KO) clones

|  | Expression |
|---|---|
| 4T1 control | 1.00 |
| MaTAR25 KO clone1 | 0.03 |
| MaTAR25 KO clone2 | 0.01 |
| MaTAR25 KO clone3 | 0.03 |

The MaTAR25 KO cells were functionally compared with the 4T1 control cells. For this, 50,000 cells of each clone were seeded and manual cell counting was performed after 48 h and 72 h. The results show significant decrease in the cell proliferation rate in MaTAR25 KO clones (approximately 62% compared to control at day 4). The average of 3 cell counts is presented in the Table below.

TABLE 36

Number of cells of 4T1 control and MaTAR25 knockout (KO) clones

|  | 0 h | 48 h | 72 h |
|---|---|---|---|
| 4T1 control | 0.5 | 3.0 | 10.8 |
| MaTAR25 KO clone1 | 0.5 | 1.7 | 5.5 |
| MaTAR25 KO clone2 | 0.5 | 1.7 | 6.1 |
| MaTAR25 KO clone3 | 0.5 | 1.7 | 4.6 |

To further characterize the MaTAR25 KO clones, a cell migration assay was performed using live cell imaging. An Observer Live Cell Microscope (Zeiss) was used to acquire images every 5 minutes of the same image field in 12-well tissue culture plates for 8 hours, and images of 5 individual fields per group were collected for migration analysis. The collected images were analyzed using the CellTracker image processing software. Reduced cell motility by 40% was observed upon genetic loss of MaTAR25. The results are presented of the relative migration distance.

TABLE 37

Relative migration distance (μm) of 4T1 control and MaTAR25 knockout (KO) clones

|  | Distance |
|---|---|
| 4T1 control | 1.0 |
| MaTAR25 KO clone1 | 0.6 |
| MaTAR25 KO clone2 | 0.7 |
| MaTAR25 KO clone3 | 0.5 |

In addition, invasion assays were performed using 24-well Boyden chambers (TREVIGEN) in 24 hours. The results showed reduced cell invasion by 45% of MaTAR25 KO cells compared to 4T1 control cells. The results are presented as the average of 3 relative invasions in the Table below. 'No serum' denotes a positive control where cells should not invade in the absence of serum.

TABLE 37

Relative invaded cells

|  | Distance |
|---|---|
| No serum | 0.2 |
| 4T1 control | 1.0 |
| MaTAR25 KO clone1 | 0.4 |
| MaTAR25 KO clone2 | 0.5 |
| MaTAR25 KO clone3 | 0.6 |

Example 9: Further Identification of Human Orthologs of MaTAR Genes

Human orthologs of several other MaTAR genes were identified using the methodology described in Example 6. The complete list of the genomic location of potential human MaTARs (hMaTARs) are provided in the Table below.

TABLE 38

Potential human counterparts of MaTARs (hMaTARs)

| Ensembl ID | MaTAR | transcript ID | Human counterpart (sequence, hg38) | Human gene location (sequence, hg38) | human synteny (hg38) | SEQ ID NO |
|---|---|---|---|---|---|---|
| ENSMUSG00000085399 | MaTAR31 (also MaTAR7) | ENSMUST00000123272 | | | | |
| ENSMUSG00000100816 | MaTAR32 | ENSMUST00000187677 | intron of non-coding RNA CNIH3 | chr3:1473111-1473137 (+), chr1:224490851-224490882 (−) | ENST00000414394.1 (chr2:192,629,919-192,645,706), ENST00000422017.1 (chr2:192,644,102-192,645,387) | 193-196 |
| ENSMUSG00000096617 | MaTAR33 | ENSMUST00000180755 | retro-GAPDH | | RP11-62517.1 (chr4:77,394,491-77,494,286) | 197 |
| ENSMUSG00000104000 | MaTAR34 | ENSMUST00000195727 | | chr3:35423136-35423173 (+) | ENST00000615633.1 (chr8:81,356,161-81,356,274), ENST00000518880.1 (chr8:81,279,871-81,281,446), ENST00000606235.1 (chr8:81,275,399-81,277,570) | 198-201 |
| ENSMUSG00000104645 | MaTAR35 | ENSMUST00000200327 | intron of RAD51B | chr14:68,214,801-68,214,832 | ENST00000515649.1 (chr4:104,907,406-104,970,084), ENST00000580856.2 (chr4:104,796,128-104,796,221), ENST00000515127.1 (chr4:104,653,874-104,966,793), ENST00000508358.1 (chr4:104,556,960-104,568,877) | 202-206 |
| ENSMUSG00000105811 | MaTAR36 | ENSMUST00000196668 | | chr1:87673467-87673600 (+) | ENST00000437598.1 (chr1:87,899,909-87,905,714); chr1:87900099-87976514; chr1:87,805,286-87,808,372; chr1:87526364-87529941 | 207-211 |
| ENSMUSG00000082292 | MaTAR37 | ENSMUST00000164282 | intron of CAMTA1 | chr19:34,709,167-34,709,419; chr1:7,032,170-7,032,239 | ENST00000408204.2 (chr5:155,024,714-155,024,800); chr5:155116572-155119608 | 212-215 |
| ENSMUSG00000106230 | MaTAR38 | ENSMUST00000197386 | | chr4:87,891,842-87,892,832 | ENST00000513220.1 (chr4:106,003,317-106,022,478) | 216-217 |
| ENSMUSG00000099375 | MaTAR39 | ENSMUST00000186885 | intron of LINC01648 | chr1:30,026,649-30,027,342 | ENST00000430692.1 (chr2:125,710,969-125,765,842); ENST00000455174.2 (chr2:126,110,099-126,117,985); ENST00000435352.1 (chr2:126,308,510-126,343,992) | 218-221 |
| ENSMUSG00000085218 | MaTAR40 | ENSMUST00000123623 | | chr11:30,635,647-30,638,513 | ENST00000531002.1 (chr11:30,584,130-30,630,508); chr11:30686409-30695389; chr11:30687409-30697149; chr11:30741556-30793130 | 222-226 |
| ENSMUSG00000100009 | MaTAR41 | ENSMUST00000191042 | intron of DAP3 | chr1:155,696,325-155,696,501 | ENST00000411055.1 (chr5:102,302,504-102,302,810); ENST00000506058.1 (chr5:102,144,077-102,146,572); | 227-231 |

TABLE 38-continued

Potential human counterparts of MaTARs (hMaTARs)

| Ensembl ID | MaTAR | transcript ID | Human counterpart (sequence, hg38) | Human gene location (sequence, hg38) | human synteny (hg38) | SEQ ID NO |
|---|---|---|---|---|---|---|
| | | | | | ENST00000362916.1 (chr5:102,131,007-102,131,135); ENST00000615759.1 (chr5:102,108,666-102,108,764) | |
| ENSMUSG00000087326 | MaTAR42 | ENSMUST00000146576 | intron of PCAT29 | chr15:69,631,165-69,631,311 | chr9:36307042-36315279; chr9:36313547-36315321 | 232-234 |
| ENSMUSG00000087107 | MaTAR43 | ENSMUST00000143673 | intron of AGBL4 | chr1:49,319,395-49,319,493 | ENST00000587012.1 (chr17:35,406,684-35,409,768); ENST00000592117.1 (chr17:35,403,837-35,404,373); ENST00000589099.1 (chr17:35,400,878-35,403,006) | 235-238 |
| ENSMUSG00000066170 | MaTAR44 | ENSMUST00000181029 | | chr1:61,652,871-61,653,084 | LOC285847 (chr6:35726762-35736947); ENST00000452048.1 (chr6:35,733,867-35,736,947) | 239-241 |
| ENSMUSG00000099848 | MaTAR45 | ENSMUST00000185425 | intron of TCONS_00011243 | chr6:167,686,270-167,686,755 | ENST00000629370.1 (chr2:234,682,668-234,717,764); ENST00000427619.5 (chr2:234,834,315-234,913,384); ENST00000413842.1 (chr2:234,882,279-234,888,802) | 242-245 |
| ENSMUSG00000104350 | MaTAR46 | ENSMUST00000191737 | | chr2:107,615,711-107,615,781 | ENST00000610049.1 (chr1:111,184,415-111,185,061); chr1:111251780-111252513 | 246-248 |
| ENSMUSG00000097639 | MaTAR47 | ENSMUST00000181833 | intron of SDK1 | chr7:4,176,549-4,176,613; chr3:114,206,658-114,207,102 | ENST00000487657.2 (chr4:128,582,999-128,601,400); ENST00000514265.1 (chr4:128,567,972-128,570,531); ENST00000608228.1 (chr4:128,552,590-128,553,416) | 249-253 |
| ENSMUSG00000105260 | MaTAR48 | ENSMUST00000196337 | intron of MAPK10 | chr4:86,369,041-86,369,080 | ENST00000511497.5 (chr4:128,428,070-128,519,394); ENST00000505133.5 (chr4:128,292,751-128,466,661) | 254-256 |
| ENSMUSG00000087362 | MaTAR49 | ENSMUST00000139492 | intron of DIAPH2 | chrX:97,035,752-97,035,829 | ENST00000434418.2 (chr2:187,712,816-188,287,691) | 257-258 |
| ENSMUSG00000100147 | MaTAR50 | ENSMUST00000189594 | | chr1:195,728,884-195,728,916 | ENST00000436706.1 (chr1:224,208,747-224,213,279) | 259-260 |
| ENSMUSG00000104192 | MaTAR51 | ENSMUST00000195679 | | chr1:102,480,764-102,480,794 | ENST00000451250.1 (chr1:55,217,861-55,234,177); LOC100507634 (chr1:55215408-55217455) | 261-263 |
| ENSMUSG00000105613 | MaTAR52 | ENSMUST00000199279 | | chr12:121,299,793-121,302,026 | chr12:121375393-121392412 | 264-265 |
| ENSMUSG00000105353 | MaTAR53 | ENSMUST00000198677 | intron of TCONS_00028092 | chr20:2,219,060-2,219,103 | chr4:16114342-16120917 | 266-267 |
| ENSMUSG00000103755 | MaTAR54 | ENSMUST00000192612 | | chr3:143,118,914-143,119,438 | ENST00000492307.1 (chr3:143,111,802-143,112,359) | 268-269 |

TABLE 38-continued

Potential human counterparts of MaTARs (hMaTARs)

| Ensembl ID | MaTAR | transcript ID | Human counterpart (sequence, hg38) | Human gene location (sequence, hg38) | human synteny (hg38) | SEQ ID NO |
|---|---|---|---|---|---|---|
| ENSMUSG00000105263 | MaTAR55 | ENSMUST00000200473 | | chr10:14,991,910-14,992,564 | chr4:16114342-16120917 | 270-271 |
| ENSMUSG00000101249 | MaTAR56 | ENSMUST00000187117 | intron of non-coding RNA RP11-3P22.2 | chr7:69,331,847-69,332,251 | — | 272 |
| ENSMUSG00000100131 | MaTAR57 | ENSMUST00000187714 | | chr16:10,722,204-10,722,741 | — | 273 |
| ENSMUSG00000097113 | MaTAR58 | ENSMUST00000181524 | intron of DNAJB4 | chr1:77,981,610-77,983,203 | ENST00000367355.5 (chr1:200,342,544-200,373,792) | 274-275 |
| ENSMUSG00000102070 | MaTAR59 | ENSMUST00000188231 | intron of RP11-3P22.2 | chr2:202,614,880-202,615,460, chr7:69,330,777-69,331,342 | — | 276-277 |
| ENSMUSG00000054418 | MaTAR60 | ENSMUST00000155384 | | chr17:77,904,130-77,904,532 | chr17:77934751-77935349; ENST00000374983.3 (chr17:77,879,027-77,884,087) | 278-280 |

Example 10: Antisense Inhibition of MaTARs in Primary Tumor Cells

Antisense inhibition of the MaTARs described in the previous Example was performed in primary MMTV-PyMT tumor cells.

ISIS oligonucleotides tested in the assay were designed as 5-10-5 MOE gapmers, and are 20 nucleosides in length, wherein the central gap segment is comprised of ten 2'-deoxynucleosides and is flanked on both sides (in the 5' and 3' directions) by wings comprising 5 nucleosides each. Each nucleoside in the 5' wing segment and each nucleoside in the 3' wing segment has a 2'-MOE modification. The internucleoside linkages throughout the gapmer are phosphorothioate (P=S) linkages. All cytosine residues throughout the gapmer are 5-methylcytosines. The ISIS oligonucleotide sequences are presented in the Table below. The MaTARs targeted by the ISIS oligonucleotides are also shown in the Table below.

TABLE 39

ISIS oligonucleotides targeting MaTARS

| MaTAR | ISIS No. | sequence | SEQ ID |
|---|---|---|---|
| 31 | 850592 | CCCCTAGGCAAGGTGGGTCC | 169 |
| 33 | 850868 | GCCAGCCCCGGCATCGAAGG | 170 |
| 36 | 850797 | CAAAAGCACACCCCGATGTC | 171 |
| 37 | 850578 | CACCAGCTTGTCCGCCACAG | 172 |
| 38 | 850701 | GATGCCTGAGGAAGCGCGCC | 173 |
| 39 | 850637 | GGTTCAGGTAGATGTACTTC | 174 |
| 40 | 850718 | GGCTGCCCAACCACTATGGT | 175 |
| 41 | 850671 | GATACTCATGATAAGGGATT | 176 |
| 42 | 850746 | TTACCCTCGCGGGTCCAGGC | 177 |
| 43 | 850744 | CAACCCGAGAATCACAAGAG | 178 |
| 44 | 850766 | GCCCGTTCCTCACAGCGGAT | 179 |
| 45 | 850831 | TCGCTCAGCTGCTCTGGTGT | 180 |
| 46 | 850779 | ATGTGGTGATCAACACTGGC | 181 |
| 49 | 850727 | GCCGCTGAAGCTGCACAGTA | 182 |
| 50 | 850664 | GGATGCCCCGTGGGTAGCAC | 183 |
| 51 | 850794 | GGCCCCTGATAGGTAGGCTC | 184 |
| 52 | 850706 | GCCACCGGGTGAGCGAGCCC | 185 |
| 53 | 850855 | CCGCTCTAACTTTCGCCCGA | 186 |
| 54 | 850678 | GGGACACCAGTGCTGACCGC | 187 |
| 55 | 850823 | GAGCTTGGTAGGCTCCATCT | 188 |
| 56 | 850598 | GGCGAAGTGGGCTTTTGCTC | 189 |

TABLE 39-continued

ISIS oligonucleotides targeting MaTARS

| MaTAR | ISIS No. | sequence | SEQ ID |
|---|---|---|---|
| 57 | 850621 | CGTCTAAGGTGTGTGTTGTG | 190 |
| 58 | 850819 | CGCTCCAGCCACGCGCAGAT | 191 |
| 59 | 850610 | GGCAGAACGACTCGGTTATC | 192 |

Antisense Inhibition

MMTV-PyMT primary cells were seeded at a density of 20,000 cells/well into 96-well plates. Transfection-free uptake of oligonucleotide was accomplished by adding 5 μM of either a MaTAR-specific oligonucleotide or the scASO to the primary cell culture medium immediately after seeding the cells. Cells were incubated for 24 hours at 37° C. and RNA was isolated using the RNeasy 96 kit (Qiagen), according to the manufacturer's instructions. RNA samples were used directly in a one-step 384-well qRT-PCR (QuantiTect SYBR Green RT-PCR Kit, Qiagen) on an Applied Biosystems 7900HT Fast Real-Time PCR System (Thermo Fisher Scientific). The results are presented in the Table below, and indicate knockdown efficiencies ranging from 4% for MaTAR50 to 89% for MaTAR56 after 24 hours.

TABLE 40

Antisense inhibition of MaTARs in primary MMTV-PyMT cells

| MaTAR | ISIS No. | % inhibition |
|---|---|---|
| 31 | 850592 | 26 |
| 33 | 850868 | 50 |
| 36 | 850797 | 36 |
| 37 | 850578 | 13 |
| 38 | 850701 | 13 |
| 39 | 850637 | 21 |
| 40 | 850718 | 20 |
| 41 | 850671 | 16 |
| 42 | 850746 | 40 |
| 43 | 850744 | 14 |
| 44 | 850766 | 57 |
| 45 | 850831 | 84 |
| 46 | 850779 | 53 |
| 49 | 850727 | 53 |

TABLE 40-continued

Antisense inhibition of MaTARs in primary MMTV-PyMT cells

| MaTAR | ISIS No. | % inhibition |
|---|---|---|
| 50 | 850664 | 4 |
| 51 | 850794 | 37 |
| 52 | 850706 | 59 |
| 53 | 850855 | 76 |
| 54 | 850678 | 27 |
| 55 | 850823 | 25 |
| 56 | 850598 | 89 |
| 57 | 850621 | 74 |
| 58 | 850819 | 74 |
| 59 | 850610 | 82 |

SEQUENCE LISTING (280 sequences)

SEQ ID NO: 1 - DNA, 144025 bp, Homo sapiens
agagagagagagagagagagagagagagagagagagagaaacgagctggcggagaggagcagaaggcaggaggggaaatctggcacaacggctgggagaggaaacttgatgcttctgggccaccatttgccagggcctcgctcgaggtaagcacactggggtcccgcggagtccgtacctgtcagggtccagcccccgcccatagccgagagatgggcacccttacctgggctattcaaataatgatcaaaatggaacggggatgggatgcgggtgagggagtgctccagccggagggcccggggcccagaggatgatgtgcgcctggaagcttggaccccgggctcttgcccctgggcaccttgtgcctccagccaaggttccgagcgactgcgtggggctccagctatccgatttcccttcctaagtcgcgcgttcgacagctccctcctttacacacccgcgtgcaaatgagccgctgctctgtcatgaagtgagaatgtgagcctctttcaaaccctagaaaaggaaagtttggtaaggcgggggctgcgcagatctgctgttctctggaacctaaactgggaaccctagacttgcgcagaaaattaatagttttccatttttctttaaaaaaattaacttcaacgaaaaattgtgtgtattcaaaaaaattattggattaccatgtctgatcagctgctgatgacctaccaataagcgttttaaacacacatgcacattcacgcgtgcgcgcgcgcgcgtacacacacacacgcgcgcatacacacacacacacacacacacacacacacacaccccaggggctatgtgcagtgaggaaggccgtcataagtaactaagaattcagagggagtcgcaagggcttttaagtgtgtaaaggctgtgtacgtgtcctccttgttacagagagcagagggagggggcagagggaatgagcgtcggctcggcgttttcgctgtgcctgtgtgtttcgcgtgttgtcagctggctctggtttctaagggctgagcgctgccaggggcgggggccagcatccaccatccacctcggcaccctagtggtgaaacaggactcatttgtttggtgcagagcggtgacgacctagaagagactggagtgtggttaggtcggccccctgccatccattacacctgcggcagatggctcaagtggtagaatggttttgtttgccgagatcaagaaaggaggaggggaaagctagagcctcgccccactcaaaagaagtaccataaagagccaaagaaatgaaagaagccatattcgtaccatcaaaagcaagaatgttgctgccttccaggagttaacctggacacgttagtgactttggtacctggcccgaattgataacgactgaattttagaaccaacatttttcaaatgtatttttgatgaaatgcctacttctccctacacacacacacacacacacacacacaacacacacacacctatctccaggcagatgcacacaggtgtccttggagctctactccctgaagccaaatgtcagtaagatcctgcggatttccagatgaaggaagcctcttgtctccccccacttttttcagtcggcctgctagcttccacacacaagcccctctcgcaagacaaccacctggctgaaatttagccaggtgtcaaatgtatccatctcattttcacgtgcaataatgtgcctttctgatcaatcttcacatccttgcatccattccttcctccctgctactcaagaagcaagaaaggagcacacacatcctcccaggcagtccagaggaaaggcaggcgtgacaaagaacacagacacagtctaatgacaatttagcctgtcttctattccttgactttcttgttaaataagaggaatgaaaagaaaaatatattgagggagacctaaacagaaagccttgtaagccttgtctcctcccttacttcacacagtcatcacgataacacccatatacaaattacctttatgaatatgcttattcacatttaatgtgaaataaaaaattattttgctggcctaattttctgtactgaacagtaaacattccttctactagagtttaatacactaatgctttggggatgactagcatgaagagaaattccacaatttttgaaacagaaattctatttttctatcttctttaatgtcaaatcaacattttttagttagtaaaaccaaagaatatcaaacaatgagagtcctttctagctaagattttggagtcacaaataaagctacatcctaaaaagccaaaaggaaaggaaaaaaaaatcaacccctgcatttatcaaggtgctttaaatacccaaagacacctctgaactgggttttgttgatgggtgcttgttgtgtgcccagtgtaattttttaataaatattttcctgtgctatgaatgtttccatttttataaggagaaagctgactttgaaatgcagtgggaaacaggatttgccaagaaaaaatgccagtaggataaagcccaattttattattaataatataggtttatttgtatatcatacaaactgctaagagtctcttcttcgatgtgaattcctgtattatcaggacacagtcaaatccacttgtaagaaaatttaaaaagaaaaaaaatacttgcagaacagagttgaaatacaggtttcctgggccttttagtgatttctttttaagagggagagagagggggacctgacctaaaactcctggctttagagacactaaaagcttccaattgtatttaaataaaacagaattagcaaacttttgtgactgtagagaacgaagacaaaaatttagtcctaataagctctcccaccttccaggcaaaatcttttagaccctagttctaaccggtatgtaaagctaagaaaaataatttccaaaatgaactcttgaaatttgaatggaaaaaaactgcctttagttctgaggtttgttaataagcaatattttacatagaaatcttaaggaatgaaattagctccgataccccagtgtttcgaggaaagggaatatgttttacttttgagcaggttagtataagaatcacactcagccaggtttcttaggcccaagtgagcctcagaacctgaaaaggggaaaaagaaggcatcttggggcataatggaagctgaggttcccccctcctctacccgctgctgggaccaacatcacatctccttcccatatgaaatggctatatgctattacagaaaagactagataagagaaagtgaatctggaatacatgaattgcttttttgccatccccaaccttgctgagctttcatcagacctgccatgccttcacaacctcttaccttccccaacataagccaacaaccgaagccatgtcgcagaagatatatatgtaaatgtatgcacacatgtgtatgtgtgtgagtatatatgtacacacacatatgcatatactttatgtatatatttgctttggtatatatgctttaaatatatatatttatatatgcatatatacctgtagttctcaaaaatatcaccagtagcccaaatttgcctttatttcaggagtaattaagaagattgtaattcttaaagaagagctaccaaatttcactccctggcggcagtctcagggcgcactaaaggtgcccgaagctggctagcaggagggctcggccggttcgtgtgcccggcgccaaccgctgcctgtgagtctgtgtctttgactcactcatttccccgcttcagggaggataatgaactcttttcttttcctaatttgtaaagatatcttctttagtcagtgctgaactgggaaaggcggtgaagaggcctgggtcatgaacctgaggaggtcaaggctccgacctctgcttgggtctctctcataaaaccaagggacggtgggcaactgcatctgagggtttatccggttccccagaaaaaatgggcatgcgtgtgtgcctgtgtgttcagttccatcctacagtcctcccaggggtctccagaaagcgtggctttgtcttctccagggcggacgagtcctagagcagtccgcagagccttcggtgaagtttcccgcggcctcccaagtccacggagcccggcaccccgtcccagggcagccctgacggcccgggcgcggtacccatgcggccagtaggtgtcgctgttcccctgccggcgggagccaggagccccgcgcgggcccccagcgccactcagccttccgctcccggcaggttcgcagacccaccggagctcccgagagagggccgctctacccgcccccgccccgggactgtgcccgtgctcacctggctaccaccgtagcgacactgccggcctaaggaagtaccttcggggagagaaaggagagacgggtctgttggggcgaaacatgggccccgacggaagcggctccgagccggcttctctcgtggctcccaactctccctcctttctcttcacgtgccatgggcggcggtggggcactgagggcctcctggtaaaatccgaagaggggagattcaaccggggttccatatgggctttacgaataaacaagaggttgaaaatcccagcttcgtgggagctagctacagaaagagtggattggtttcaatattcttgcctcaaaaaaaaaaaaaaaaaaaaaaaagaaaaagaaaaaagaaaaagaagaagaaaaagaaaagaaagaaacctaggcctggctacatgcgtgggctacataccaccttgtacacacatgaacacagaagtgccgggtaaccgcgatcgcagtcccctccccaggcccaggaaggagccagtatttggaatgtggttgtctttcccaaaagcgttgcttgccaaatattatttcctcttggaaaacctagcagttagcgaatctttggaatctgcattgaaatgctaggtattgagaattctgcgcccttctctggcgtcctgcggctccctgccttcggcctcagtgtgccgcgaaagagattattaatcagaggcgttctttttgtatgtgtttcaaaagaagggcgtttggcttatgaatacctaaagggacatttacaatgggtacatcctctaggtgactggagattttagtatgattctgattgttttgtacagggaaatcactgctctgatttgaggatagggagagggagagtgagttgaattggctaaattcagaatcaggtgctattcagagttagtttgcaaaatggaactggctatgtgtttaaattaacgtctaaaatcatatcttcagtcaaaatgtgacattttgcagtaaaattttttaaaagattcacatattatctgtaaaatttaggtaaaaggaataaattcgtgaagaagaaaaacgtaacaataaaatttgagacaggaagaaaaaaaattttcacttaaagtccaaaatatttcggaacacctcttgttgctggccctgggccgccatctcaccatttcagaggacatggttggacaactgccgagtcgttaaggcaagccttaatttttaccgtgaggtagccaacatcatctttaaatgtcatatatttttcgctatgtttcataaaatgagcttctttctgctaagtcctatatctgttatacaattctaaataattatttctgattgagacggcaaattaatcattcggtgacgtggtggtgaggggagaaacacgtgtctcattggaggttgtgaagttcagtgaggtggtatttttagcttgagaagtccaaattcagatatttgggtatttctccccctcccaccgtttccccacccggtccccattttactctctctttaactcaaccctttgggttctctttctcctttttctctcccattctcgcttctgttttctctctcccctttacagcgcctctccctttttctgtctcttctttcctcttctcttctctctcctctcatttattgtctgattctatgtcaagttaatataaaagtagcaagtgggagacccagtaccctcagcagaccctctctccaccgcgcgcagggcactttggggagttgtctgtcgctgccaggttaccggccagagtggtggctcttggtgcagggcatgctgctctcggaggagttggggtctgcgcggggttgcggggcttattcaaatacctcccgctgctgctgtgattcgcagggactcggcctccatatggtaatgcggggcggggggttgggggaggcgcagaagggaggggaggggaggatgggggtgagggcggggtgggagggggctccgacactgcgcgctcggctgccgggctgggacagagcacccggacccgcggcggcagcggcagcgacgctacccaccctcttccccaacacccacctagccagcgagtcaccgagccaccggccctcggggtaagccacagcgcgcacacggcagcgacggtgacggttcacacgctttgggttactaccatgcgccaataagggagattagaaacagaaaaggagattacagagagatcagagataagaggtgtacctctctgtgttccttgtcacatagcgcgcgcgcgcacatacacacgcatctgtacacacatgcatgctcagccgtacacgcacgcgttccttgctactgccatctaaatatatgcaccgacactctatgccctgcaacgtggccggtgtgtttgtcctgatcctacataaaggtaggcaggtatgtgggagagtccaggcaggaacaaacagccacgcgcaatttaactgcagccaaactcaaagagaccttgagcctgccgaattgtttcactcagccaggtgccccccagaaaccggctattctgcaatcagttgtggaatcctgcaattattcataaaatgtgctgaaaatgtattttaggaaacgtaatcttgctatatatggcaaggtaaaggcgaacctgaaggatgaatgtgtttctgctttttaatgtcatacgtgtagccatctgaccactttttattgggtgacatatcatatgagcactttggtgtaggcttggaaaaactacagccagaggtaaggctggaaattccataagagttaagggtgctgaaaatggatgctggatagtccagcatgaaagatggcataccgctttaggtttgaaatagggggaaatacatgtgaatatttatacatgaaggccattggggagggctgagtcttggcctgagtatctgtgcaggtaagtcattcataagaaaactaattacctgtgcatgtacttggacttgtttaattgaataagctgcatgtgtgcatacttgctgttctttcagggtttgcaattatagattgagtcttttttaaatgatagcttgggggaattaaaaggtggaaaaaagccatcgtgctgcatagctatattgccaagaaagagaatccgatcctataaacaagattaccattgcttgaaatctaactcaaggcctgtatattttaagccacatcaactggtttaatatagccaattgttttatttgtgtatttgctttcatttcaaagtcaggaatcaaggatgcttttcagtcaagataatgtgccttgtttccagccatattaagataaaaatgaaactcagtaaattttgaatgcagccaataaggtacaacatacaacatggttgaaaatgtcttccttgcagaaggctgtccattgctgtgtctacccattttaaaatatatatatttttttcaataagaaatgctagaaagcaatagggcggggaatgccgcacctctcaggcaatcagcacaaaaattatttagaaatctttggaatcacttcacttatacatacattatctcgaaagcactggccccgaactgtgtttctgctaatatgaagttaattagacaatcaaactttgagccttgagcgatgggcactacagcccatcaaggtatgtcaagaaagaaaaaaaaatgtgtattttcctttatgaccaaaccaggaggttatacagctggcattgcatacatgacagatgtgcatatttgtaaccttaaataaacagaagcagggaggtaactgtgtatattatctagcaagagacagcagcagacactcgccaaaaaagacagaaagggacaagagagacacatagacataataaaataacaacaataaaaatcctccaaaaaaaaaaagagggaaagggaaccaataaaatgacaaaatctgaaattctcgcaaattaaaaaatgcaaatatacctttacatatgcatcagtattaaaaataatacacgctggaaccaacaggagcgagagcaagaagaggaggaggaggtggaggagaaggaggaggaggaggagaggtggaagaggaggaggaggaggaggaggaggaggaggaggaggaggaggaggaggaggaggaggaggaggaggaaagaatggaggcgccgcggagccctgattatgcatgggctggagctgcctcctctaacctgttcttctccgagccgggcagccggcggtcctcagccgcccacagaacaggagccgaaacaaccgttctcgaaggctacagcgtttatttttctcttttggggggttttggcggttgtttcaggggctcgccaactggcccctttaattaaaagcttcaataaaaggcgatcgcgccaggaatgcacccgctcctcttcgcgcaggatttgcatatttttttaatgccctaatttccttgatgtatgtaaatgtagccggacgtagagggagacagggagctgacgtcaatggacgtgacctcgcagctaaaccttgaacgtgaagccgggatgggggaaaacacggagcggcagccggcggagcccgagagcgcgggcggcggcggcagtagccgagcccaggccggggtgccaagggaccagtgccggccccgggggaggacaagccgccgccttctttctgcaccgcgcggctctcagactcgccagccttccggccgcacacgcagactcttgccctgagcttccagccccaccacacacacgttcttttgcttccctcagaaaagcaacactccccaaaacaacaaaccaaaatcaacagataaaacagatgttttagaccaatgctcgggtagcttatcagaaagaagactctgaccacggaacatatatattttttggcttctctccacaagaagaggagcgagagaccacagacaacagcaaatcactcctaaaacacgataactacaagtgctccctgtagggagaggtaaatcgcccagccgactggtgaagtcttctggtttcggtacctatttacctgtgcactcattatgcgcctcggcttcattaacggcaggatcatgagcgcgcgttttaatgtgatgggagtgctgtgttgtgtgtgtgtgtgtatgtatgtatgtgtgttgggaggtgcttgcgctagtgagcaccgaggcaggcgctctgagcagagagagatcagtctttccatggccacgtctgggactcatctgcggagccatctaggccagggctcctagattggggttcgacttcaccccatgtaaaaagagaggccagcaaaggcttcccctgaacagccaggtccttcccatcggattgtttgaggaaggaggcttgaagtgtgagccattctgtagccgccgccttgccggatttggcctggtgttttgcacttgaaactcagcggcctcagcgcggaggtagtgcctctccgagacgcggccgaggccttgtcattcccctccttccgcccgcggcagccctgcgcgccggcgtgtgcgtgcccgcgcaccggaccgctggcacctccctgtgcacatccgccccctcctctgctcgccccctcctctggggcagctaagaaatggtcctcggcctcttctgggccggagggcagatctacgagcaggcaagaaaggggcgccggtggctgtggtggcgacttctccgctctgccctcggccgccaagtgtgccgtttcatcgttccacctcgcagccccagctttgttttcctgacatgttcgtggccattgggccccacgcctgcgaggggagtgtgtgcgtgtgcgcgggggtcgggcgcgcgcggcgggtgggggctctcccgccaaggacacgcatggctgtctgtcctccggctgcacttggcgggaaagctaggggccgccggcggggctgagcgccagcggctgtcattaccgcctccctgctccccgcgggctgcatttacatacgggccactcgtctgaatttttacggcactcttccccctcccgtacccggtcgcacgcgcgcaggctcggaactaccaccccggcacgcagacacccgcgcccagaatgcggccagccccaggcgcgcaaacaggcccacaggggccgacggcactcggcgggacggattcctgcaccgcctccccgcacccccgtgcccacacccctgacagcctctccgcttgtgttgcaggaagcccaccttcccctcgaagcccccacccttctctgtctgcatacttccacccccaccctcccacatctctccgtctctctttccgtggaaggcagacgcgcgcgcgcgcgcgcacacacacacacacacacacacacacacacacccgctttttcttcctcctcaaatagatgacccctatggcgcgtccctggtacatttagaatacctctagagtttagagaataaaattctttagaatgcattgcttgtctttagctaaacacatttaacaaccacgacacaaacggggaggagtgaagaagggggacttgaaccaaaagacctttaaaaaaaaaaaagtctgcgagtcaaaaggtcattctccaagtttgtaaataaaattgcaaagggagtccttaagaaaggagaggaaagaaggggaagaaggttaggaagactcacaagttacataaaacagtgcattggaaaaacgacagggagattctgtaataaaaaaaaaagaagaatcttaagaaaccaagagagagaaaaaaaaactggaggaaaaaagaaaaagagaagaaaaggattttaaaaaaaagaaaaaagcaaaagaagtttccaaagaaatgtgtgctttgcatcctacaataggaaaatgtagccattgccttccttcagacgagacatttctaatttgttccgtctgtcaggaggggactatgagaggtttgggtgcaaattcattatctctggcaacgcagaacgtagtgtggggactgaaaaagaccgtggcaatggatgaacaatagggcttcagttcatcagtaacaaaagcagtggggaaattggttgagtttcagagcacgtcctcctcggcagagggggctggactagaccttggacagcccccccaaaaacttgccaagcctcgcacacaccacttcactctccactccgaggctcagggagcaagtgcctggcatggggggtaaaagttggctttttttttactccttggtcttttgcgcccttctccctctccccagaagggaagacccatttaaactattttagacgcaatcaaccaagaatcaccatgtggaattgagcggcagttttaaatgtgttgagcaggggagaggaatgatgagaaaaacatttttttttttttttttggagacgccgaaagaagcctgtttgtgtgctgcggccgtgctgtgactttggatcttgtctttcagccggcgcctcggttcctgcccagctggatttggggggcagcattgcctggcgcagggagatcaagtgagtatcgtggcggccctcaggctgcagctcgcccgcggcgcgaggccagcagtgcccgccgcggccccgcgcccgcactcctcacctcgcccgctagccggtgcccgcagagtcccgctgcgggccgctccgagggccagtccggggctttgcttcagctaattgattgtgtgcctcggatgttaaacctgttgatctcgtgagttttcttagccagtactgttaattatccagcggcttgacccccaatcgcagagagatgccaggaaatcttcgcgttggaaaagggaatttttgtatgtaattttgtggtggtggtggtggtggtgtgtttgggggggcttttcccttttaaacctagagcaaaatgcacttgtattttgcacttctgtattcgaattcgcattttgaagaattcgcctccctttaaccgccccaaagttgcaattacctggcaaggaagcgagggtctgattagattttggtggaaaacttagtacagtagctaagtagatctggtggctttccacttcccttttctctttgccttttgaattttgggaggtgagaggccgctttacagggttatcccaagttcagattcatcaagatgcaaccatcatggttagttattggtacttggagcggttcagcttaagacgcttctggtatccaaacggagctaggtctttgcggtttgcttagagtctagacccggctgaggaaggcaagaactcctttctgtggcctggaattatctgcaggaacccagggtgatgggaactcgggcaatgtatttgcattagtgtctgcggcgttttatcttgcaaatgtacccgcggtgcttgaatgggggactgtcttgaggggtcaggagagcagtggaattgatcagaagttagaccggaggctctgtcaagtcacggccacggccgggggcccctttggagctgtggctgccttgggcccagcaccgcagagtcgggttccgtttcctccctttcttggtgtccacctctgtctaccaccctcctttctccaccttggcaccggtaattagggcgctgtctcaggaagcgagctcccacagtcagcataattaaaccagggcaatactttcattttgcaaaaccaatagccccacccctccagtccaaaataacaataagcattaaaaaatcataaaagaaaaacaacctattttggggagtattgaattcctgaatgttggatcgagagggaatgggggaagggaaattttcaaaaatccaccactttacagcaatcaggttttacattattcattgatttactggaggaaagagccaatcaggagccatagatatgaatgcacatctcacggtgctgtggccttacagtaaactatttgcatctttctaatggagtagatatttatccagggattgccattgttcgaaaggcctggaaattcagttccttaaacatttagaaaataagactttgttccagacttaaaatccttacatggaaggactctcctcttttgtatggcaggttacaaggttcaagtccctaatgtttttttaagagtccctcttccttccaagctaaaaataaaagaaaagaagaaagaaaaattaatttctcaaacccctccagattctgcatattttgcattcacattatcatgcatgtctccatttgaatgcaaattagcatatttaaccccgtgggtgctgagacctaggatacattgtactggggttttatggaatctctggcattttaaggaatcatgttaatagcaatattttaaatgaagcaatatctatatgacttcatatgtatacatatatataaactgtgatcatttgttttcttgactatttttcagatgagactgcaaagaagcataaaatgaatagacaatccaaccaaccaaaggtaattttaaaatttacatttgataaaatccaagtgatgtacaaaatagagtattatttactaggcggtaggcatgcagtgggttgcatatctcctaattcatgctctaagtttctatatgtgcagccttctcctctacagggagcctttgtatattatatatcaagcataatacaaatataacctgtaactgcctataaaaaagaaattcaagatacagagtaaataatagaatacttttgttagaaagtaagccagtcaggtaccttgcctgaactatacaaatcactgtaaattaaatggcttttatgtagaaaatggtagtcttgactgtactagtgcactgtggtttacatgcatttgaatcatacaaaccaaatattaaaaggggatttcagtgataggccagttcttcatgtgctttgcagtaatctgaataggattcagaggtgttctaaatatggtgacaaacctaatgtatttgaatttatgaaatagcataattctgatccaaataatgtggaaaacgtaacttttcacttttaactgaaatagagattgtctactcccaggtaaaccagaatgtttcaattcatgtttcagccatctggagatctataaaaagattagaaaacaagcatgacaatcacgtcctaatctactggccattaatgggaatttattagtgaatgagcaggcaaaccatttaaattcagtatatccttcagaatgcagatttcaaaactggtattctgctcagcttaatagctatttgaaagcaaaaatatctgatataacatgtaggtgttaatagttgctcttaatatgtgacagacattgctaggaatctttagggctacacaattgtttcaacttgtctcacatcctatataataatacagtctttgaaatatgtataaaccatcatataaaccttggcaatattcaaaataatcagatgctctgtgttaagccttactgtgtagtttttatttctgcatatcctgagagatggtggagagtaaaatatttagttggctatctggctaatgaacagactgctcataatcctaatgttggttcctttcacttattgggactcccatgatgagtctatgttatatatgccagacatggggaccaggcccggagtccagttgatatgactatgtggcattgccctagaagatgctgttttaagacagtatcttctatagcttttaattgtaaaagcatctcaaatgttcagtgtcttggctttcatgatggatactttggttctaaaaatgcatttagttgctaagtgtggaaatatagccatgttactttgcaaattcacacagatatgggggtgataaacatgcacagacaaatgcatgacatctctttgcttccaccagcccccacccaagtatatataaagcaaaaagatattctaaaaatacctgtcatctgaccacatgcttgctttatgtaatacatgccaaatcactaatgattctgcatctgtgtcttggaaagcaaggccacaatactctcactcttccaaggcggcagagctcattagtgttttatgtaatgtctaaggtggaatgtgcctcagtgatgtgttacatttttatttagtagtgtatgttgtgaccagctagttcgagaaggaacagtaacttcatggaggtgtgtttctctgagttagtttttggtttgcttgtgcattttatgtataacccaatgcagccatttctgattgtacctcttgtaccataatttggtaagaaaaatagatgaacaatttcaacagcttagtcttttctaaataatcagtactggaatgttcaccaaaaaaagtaaataaataaaaaatctagggaaaagttggcatctatgttactaaatcatatctttaattggtgtaatattgtagtttaaactcttgattataagcttttcctaactattctgattttcttgctagtcttttttatagggtttacatatatgtgctctgtatataattcagtaagcatgttcacattcatgtcataaatgaataagtcactgaattaatgaaagagtgtatgttaattccaaaagtgttttagttgttggggaaaataatctatagaattgagagtattgtgataaagtagtcatgtgtgcaatgaatattaagattactctaatagcatatattttaaagaatagcaatatgaccaaacataacttgaaattttgaaaagcagttcataaggttcacccttggtaaatatgaatttaatgtagactatcttagatgttctgttgagggacatttgaatattacaactgcatgtattatagatgagttagacatagattactcattactaaggagagagaagaagaaaaggactctttgaagtgatcatattcacactttgaaaagttctaagaaaaggaatgaggctaattaattaataaaacaacattcccctctagatagaagaaaggtgggggttggagaaggggaaggtagggcagagttatgctcttaacatccaggtgttttatatgtgttcttcacgaggtaacaacgttttttttcatagtttcagaagcaagactattacattatccttttgtatgaaaattgatgtttaaaacaatagacaaaggctcaggattttcattacagcagagttgtgtacagcattagaaactattgctgcaaggtttacctgtgctgcattctaacgcacacaccctacatatgtagtcattttttaaaaaccacgatgaagtccgcttgcttagagcattcagttcgaacttacagaacaaaatatgctgccctatcgccatggtacatagatacaaaacatgactgagctgtgaagccattaaaaacacaccaccagagcaaattgtcaatgtaatcacacatcgactcactgcgtaatacagatctgattcccagccccagaaaacgaggccctgctttaagcaatagcaaagtgccttccatctgtctgcctatgcaatctgccagaagaaaaatgcaggcaaagacgttccccagatctgaaatgcttttatctgtccttagagagagatttcttccagtctttggatactagaacgatctacactagcacggaggaggtaaaaggccgcgggttgcttttccaggagcagtcggtagtgctagcggaagagatgttgattgagaaaatagggattgttgcaatgctgccgctactgctgctgtcgctgccgctgctcgggcagcaggcgtggggcagttggctgatcactgatgcatatcaataaccatgtacttgagatttctcatgacatcatcattaccttggtctcccgcggtctcgaacctttgaccttgccgggctggtccacaatttggcagtgaaagcccctccaatgatggcccttttctccttctttcagaccgggggcagcagcaggccagcaagacggcatcttctccttcccagcctagaagccctgtgaaatcgaggatcttccccctaaaacacatacacacaagatatgtgcaatcaagctgccaccgcttggtaaaaagccatggtgcctaaccaaaaaggatcaggaacagatccttgaatcagctgtcacttctatagaatgggatttttttttccttcctccttaacctgcgctggaaattgccgttggctttatacatctctatagagagaggctaaagagtcttgcgtgagaaagaagcaatttacaatgcaaatagaggcctgtgaagggacggatgctgctgctcactcgtaacagcttgctgcaccttaatagctggttttattttctgatattaatagatgaattgttggctaacgctgccggagattacttgctgaaaggaaaaagaaaagttcggaataaactctgaaggcaacagatctcgtttggatgttttagccgcgcacacacacaaacagaaaccaggtcatatttacataaaaggaggaatcttaagcgcggcaagtatcctggacgaccactcttcggtactgccagaaaggatcaggacctggagtctggcaagaggaagacagaggcctgtgtgggaagcgagttgttatctttggttatctagctgtatgagtgtattggtcttcataaagctagataaccgaaagtaaaaactccttcaagatcgccggggagcgtgtgagaatgaaagactacagccgagagacagtaaaaaccagaaaggtcaggaatacttattgaatctaactttgtttttgttttgtttttttccttatgattaaaggtgggatgagagaaaattaaatgacacacacatgctaaaatatcaaggttccagatatgtcttgagaggggttgttgcagctgcaaaggagaagtgtatagtgataatgagtaaagatgcatgtgcagtttgttctattttaaggcaaaagttatatcagggatttttttcttagaaaggtgttgcagagatgtctggtacctagtttaaaaatgattccataatatgtagacttgggcagttcctttgggaggcacctccctctcaaaatttgaagattgtgcttggaaattactttacatgtatttgggctgtatgtcaatttgtacgaaattagactttcagaaaagtttatactggaaggttaataatttgtatctactgaggacttagagctagcaggcaaaatgaaaaaaaaaaaaaaaaaagcaagggctgatttttattcttctattcaaaatacaaggacagatgcttctctgttccaagagggtttccttgaggaagctactgaagcagaaagacatgatggagacgagatcgcctcccctcttgtcaaagtgttaaaaaaatgttctgtcttactctgcgcctagcattggaaatgaaagtgacatttacgccacaacccacgtgtgcgcctcctctctttttgtttaaggatgatcaggtctatccaggaaacagctctggcatcccaaactgaaataattaggacgtatatagacctgacaaaaatggaaagggggtggggaatctgagggtctgtcttgcctaattgattccgctaaacggaatgcaggagatgtgaacggcaggacgctccgattcccacgctcgggggcaagtgataaagcggggccgggcagcctatgacagacagccctgttggggggtgggggtatgaaaaaaacatcaagtgcacacaccatactcatctccatcgcttaagaaagtaaaggcatttcccacccacagccatctgcagcttcccaaatggcagcaccaactggtctgtagctgctacatagtctgcttctgttaattttttaaccactgtttaatctggccataattaagtttggctttcttcgttgtttgagattttcagaattcaaggcaagctagtagaaagcaattccaagaaagtcccatgactgcctgcccctaatgtcaaaatctcagtccatgagattatggccttgtgaccacatttttgcttttgttttgggtgggcaaatgtgtatagagataaaatacatatctctatataacagtcgttattataatttcatgaggctttttacctcttaacatgatacatctaggaacttggtctaattgtgctagtagatatacactagaagtaaaactataaagtcattagcctgtagaaagttgattatgataacaatatgataaaaagtttgttttggaatagtctcagctagatgggtctaaatagccattttaatgtaatctaaaaataacactatgcctagcagaaactttggcgctttggaggtccccattgtcgccttttcataaaagtccttaagttttccatatgtcaccaagcaaacatttgtataggcatttacacagaaatataaccattgcaattagaaaatatccaaaatagcctgttatcttccacgtggcctagattattgacaatcccaaatatacaatttttctttaaaagtagtacaatttcctttgtagcttcaattccttatatgacttcagactggagaagcctgttaaaccactgttagtttcagttagaaagtctgagagactttatacataaattctcaatttggctgctgtacacgtgccagagttttactactgtagtgaccgttgagaagacccttgtttatttacatttgaagcactgtttgtgcaaacaacctttcattgttaagtgcctgtattcctttcatttacttcatgtccaggggtgctatttacctagaaccattgtctactacaattaacatttacattacaaagtgtgtggttttctttttcaaggaggttcaattaaggcaataagatgtttgctggagaaacctattgtttactgaaagcactcaatgaagtcaaattactgaagcttttgcctacatcttggtcttttatgtaaatatgttaaatataacatctaaggaaaataaacaatattataattatgtgtttgccattgtcatatcaaacttgctttgtatcatactaatgttacataacttatcgatcaataaaaatacatttcaatgttattattttcattttattttttgctgttccactgcccttggtgcaacatgtcccaatttttcttttttctattacacatcaaacttctgacattttgttttatttgtgtgtgttgaagagaggtactgtatctgagcataggtttgaagggtgttggaaataatctgtacattgaccttataataaggtgatatttctttgaaacccgtaatattccaaaggcatgtacatttaagtcaaaagaagtgtaaatatcagttaagtagttctttgaaacctagttttaacattggcagaaaccggatcaagtttatttagcataccactgcattgtaaaacagttggagtgaagttgcaggttgcgtgagtatgcatgttaactagtgggaaccaagtgcagtctttgtgaaaggggagcagcagattgctgtgcaaggccaatgttaaaaaggcagctgaatttaacaccatctggaagaaaagatcccttcacgactttctcacaccgtcagacaaaactagtgtctcttgttccgagcccttgtctatgcaaccatacaatactgagtcattatacttttgctgagagaaaatttgagaacacaatatgggtaaccagtgaatgaccaagtttcattgtgcccgcttaagtcgattgaaatctacgtctagagctatgaatggtagtattgttttcctcaccagggctgtactaaatgtcagcacagtgtaaagaaaaactgtaaagaaaagtctgcaaataacttaccaaatctcaattataatattttcccacactagaactaatatcattgcgaggggctacattgcagaaaatacaaaaagaaacgaaaagaaatagttcatttagaagttattttatccagacaaacattttaattttctgatgggaacttcaattcaggcttcaggctgggatgagaggtggaattcagtactggcgagttcaaattacaaaaattctgcttctgcaattaaaataccataaaacaaacacctagccccacctgaagttctctattcttaaatataaatggactctatgtgggttttactactttagtcctgcatagaattgttagtgtgaatctagcttaaattttgctttaaattatggcacactgctctttcaaagtttgccactgtgattgacattgcaaaagaacatcatttcccaaaatatttaagaatattctggcacctccctaggcggattctggcgtgcccaggaatacacttcctttttatgttatgcccctccccctactttctaactttttccccctcatgatgtgtgtaaatcagttatccttcggtttaacattcacgaaatctatttgactgtaaacagtcagaaaaaggaaacaaaacagttcaaaaaaagtaaatggagttggttgtgtatgttttactaggatgtctattttaaatgtaattgactttgcaattttgttattgtgtcaccaagtgtctcatagttcttaacatgtaagtgcaaaacaatgagtaattgctgttttgctgaataatacatctgagttgccaacgtcaaaggtattattttgcgtatttctaaacaggaacgttaactgcaggttttgacatctagaatcttttcatgaaatacttagaaatagggtgataaaatgatacctgtaaaagtaaatataaagatagaacccatttattttctttaccctactttgttataccagaaaattaacattgaaaagtcactcactaatcaaataataaaggatataggataaacatagtcatacaaaaaatacaaaacaacaacaaaaatgaaaattggataaaggttaaaaaaaagattcaggaagacttcttcagtgtccttgctgaatgtgaatgggtattttcactagtatcaatcccttaatgaagttgctattatgcataataatgagacatgcattatttacattcaaaatggaatattttccaaagtgactgttctttaggtcaccttgaacagtaaattttccaccacaagagttctttgtgtttatttttaaaattaaaataattttcttatttggaaaaatataaaattctaatttgatttttgtgtagcctgatgaaaattaagaaaccatttaaattataaggaagccatatagatggatacatataaatattttaagatattttagcattttaggaattttgacttttcaaaaatggagagatgaaaccaaaggctttattttccaatgtggctagaaaatgaatgacagtatgtaactgtctatgtatctatttttttcctatgaatctatacatctggaaatgtcactgtggtttcagaaaattgataccctttcctccctaatgtgctacagttaagtaaaacacaccataatatgttgcatttagtgggaactgggggtggcagtggtgagatgggcaacacaggacaaggtgttctttaagactaagaactaattagaatcagttattgagtaaaaaagatatctataatgctgggtcgattgttttaacatgactacttcgagatagttaaacaggtcctacagcaattgggacatgtaaggcagttcttcagtgtctctggattttaatggatggctttgttaaccctgtttctttgctcatcggttcttaacacaacttaaacaacctagtacagaaatcagcagaaccctctattcctgtttgctcagagaacccatttcaccccttctgggaactgttcgacttatttgtggaattaattctaagatggtgaatggaaatggaaagtatatagttgtgattgatattaaggaatatttatctgccctcaatcagggctgcgagagttagtgcacttccttagaaaggtgatgaccatgtttgaggtgggagcgtgtggctttccgcttttcagccaactgccagaccacagggggtagggcttttaaaaagtgcagataatcgactttattcagggaaatacggagttttgagccatatttgttcaaaaagcagcacatcactgtgcttgatggtttgacttggttttagttgagcgcgggcatagcgcattctggagatctaaaattagccaggcttagcagccgccttgcaaggtacttggcgtgggcggtgcaaagaggagacagccgactctgtgactggctgcagatgcggttaggctaggcagtggcagcagcgaaggcggctggcccgccgcggggcaggacgacgcctcccggtgaccgccaactgcccgagtcctcctgcagctgctgcggctcgcggccctcgcctgaaagcgggcgtctgattggtgtttcccgggagacgggctcctctagctgatggagctggtgcgccggcgcgcgcgctcccgggttggcgcgcgactgggaggccgggggcgcgctgcggcccgggtagcaggctgggaggccgcccaagtttgcgctagctcaagttcccgtgcccgcgctcggcgccttggaggctgctggacaccggcgccgcgctgcggggctcggcaggggcgggtcgtcagactgtcctttgcctggcacgctgagctgcgtccgcgaaggctattccggttttttttttttttaaaattattatttgccagcctctcggcccctaatcagcgacctcggtcactgcctctgcgccacctccggtctgcggttgcttgggaatccctgagttgagcttgtgaatgggggtggcgtcgaggtttagtcacgcctggacgtcggttagaggcaggcatctcccagcggccaccccctgccacagggcaccttcctcaggcggcacgcaacttgtggttaagaagctttcttttgctgacactcggtgtctctagttttgcccaggcttcttccctggacgtgatcaatatcattgatatagatattgtgtaacccccaaatcccccctccccgccaccaccacacacacaccgttattaacttagtgaaaagctgctaacggaaagggtctccctgcggggaagctgggtggggggcgggggcggggaagttttgctcggtggccggcgttggtgagcgcttgccactctgggcccttccctggggcaactcccacttctacccccattgcccataggagctcagggcacatcttaccccatcatcagatttgctggaaatattaatctccttgttgggtggatacagtagaacttgttcagagattactttaaaaagagatctgggtcttaagcacttactaaagccagttaataacatcatgcatggacatttaaacttgttgtaagttgcagagaggattagcgggaagtcacgctgtgcgcagctaatgataccatcttaactctaactgggctaaatccaactcgcccggcacaggtccggctctgcggccctcgggtgaggctaggaaagagcgccttggaaagaggtcttggaaagagggccgaaactggcggagccgccccgatccttactgcgggtgacggtcactggtcctgggaggccgcgggcggtcctgctgttgcgtaggcacgagcccagggactgaggcccaggcctcccggtgcacactgacacaccgccgtccgcgggctgagcttcagtgacaccgaagggcactggccaacatgtcaaaacagttttgattccatgaaccaaagggcgcacaaggtctattgcaagctcaggtgaagtcgtgggactccaaaggtagtggctttcttgctgctggtcgatttgcattacagaggccgtttactttcaattccacttttacaaaagtagtcaagctctgtatttcacaggtaaatttcgaaggatattattaacaacttcctgtcataggcttcctcaactactttcggtctgattactgttttaaagcagtttgctaccactttatgacagggccaatgagaaataatcttcagaaaatgcttcgaaaatgctgcgttattaaaacacttacctaacaatattcatttaattctgtcactaagtagctgtctgacagatttcgtgttttctctgagtttcttttaatagtcactggccctcggaaaacaagttatcaggagaattttaactgcaacctggctcttggcttttttaagttttaaattcaaacttgacaaggttaagattttttttattatatcattaatagctagtgggagattggaaaaaactacagacgctaatcactttaatagttggtgaaaacctgtgaaaggaaccacttgagaaaagagatgtgcgtaaagaaaaaaaaaagatagacaataaatactttctctgaatcaggccacaaaaaatgatctacagaatattacccagaatgtctcttaaatctttgtcttttagggaaaaatgtcttcctacacacacaaatgtatacatatgaatgaaatttactgggatggaaaaatttctaacaagtatgatttagaaatattttcaccgaataagtatctcaaatataattacgtatttatcaacactggcctaattaaaaatacttcatataatatatttggacataataccttcatgaagacaataatagatgtaatatcattgaaattcagaatctatggacttacttcctgtcagggttaaatctcttgtatagtaataataaaagtgtacttagtccttatttttaattcaatgagcattataagttcttgaaacttgcataaatataatagtctttgcgaggagctcaaataatagattttaggccttattattagaaagtacatagtttgtacacagtcactacccaatatatattactttaatggattgagttacccttgaaatatatgatgtacatacaaagttaaattagcattgactgatattgggaagatgaagttgagggtattgagtggtttgtggtatagcttgaaaactgtttagacaaattcatggcaatgaatgtatgacaaattcatggcaagtggagtttgaaatggatggaagaaaaataatctgataggaattcatctttggggtttgtaatatatacctcttgagtggttccagtagcgaaaatacctagacagcaaggatataggaattaattgacaaatttgcatttgcattgttttataaagtaactcttatgacaatttctaggtacgtagattaatataaaaataaaaagtttagctctccccaaataaagttaaaaattgctgagtagcttagatttccacactgaagactcgtgctcaattatagtctaaaatctcagtttgcaggtatgacatgggattccagtgattcaaacagcacagtacaaatactgcatatacttctgccaaatttgtctcagatggactagctgctaaggaagaatctatagcatgactgagctaacagagagtgtgttacctttccaataggtaatccctccatttgcatgccgtgttcaatgataggaaagaggagttgaatttctgtcatttttctggacttcagcttaaaggtctatattgtcagttcaaaaatatatgaagtgaacactatttcttgttagccaatagttattgttataataaaattattttcatggtcattgaaaattttttggctttatttattaaaagttaactagctttatttcattagagattgtctaattcaattttgatttttcaaattgcattttatactataaagagcccttctgcataaaatacagtttgaaaagagaaaaatatttatgcctttatcattttaagtgatcaaatactgtagtgctagatattagaatatcatgtgcatcactacattattaacttaatctaatactcggagtcattaccacattcatgggtgtctttctgatatctctccagtccactggattttgaagtgtgattatgtaaattttctactgataaataaatgactataattgtacttgaaataccactcaaattcttaagaccatggcatctaaataatgtattatggattccttaattatttatcaagactaattcaaaataactgtagggcaaagcatttatttttaaatagccatccccttccccaattttttctttactgggttaaaaaatattccagatggtggaactgtaggagacgagaaaagggttgatgagtggagtgagtaagcagcaagtttatccttcaagtaaacatctctggtttgcccaataatactgttaccctaatgcaattttttataaagcatatgatcctaatgtcagttcagtaagagtatttgatgatagaaaaaacatttttaaatgttaaacattagtccagaaaattcttcaccattatttgacaaggaaaatgggaacagttagcaaacaaaatatttcacacatggttatttttaaaagttcttttataaacatagtagggaaattgtaaaatttcagtaagggttatgccaatcaaatgatactaaatttaaagtatggctttccttcatttaattatagatgtaaaaaaatcacaataattgaatggtgccttttcattgtttaacaattgcaaggctgtattcagaacttttgttgcactgtgcctttaaaggaagcacatgtgtgttttacctacataaattctaattgcagaatccactctaatcaccacgtagaaatcatctgaagcctcataagttcatgagctacacacttttctttttttattctgcagaccacaccttatctggttgctaatgaaatacaggagattgattgcagaaaatcttcaagggaatatttgctgtaccacatatagtaagctccatttggtgcattagcatttagccattttatgcaaatttagagaaaatgactcatgtatatgatttaatatgcatcagcgataactcatatcacccttataagaaaacagaaattaaaaattcattagaaaactaggctagtgtcactacatggttaaaacattattaaagcatatttcaatgttttgcttacactagtgttctcatcatggtgccaccatttcatgacaaagaccgtagaggagaaaacattcaacttaaaatgtctgctggcacacatcgctggatttgtgtgtcactaaacaatgagcgagcatagccttgaataccaactatttaattagcacttttggaagccatgcatagaaaatagctcatttacatgcatctgcttagcgattagtcccataaaaagctaccatttctttttttgttgtttaatatagtgagcattttgccattcggccatgaaaaaaaaatcaaaacatatgttattattttcaaatactgaaattcagagatttaattaaaatgggcaaaagtcttcatatttctcttcaaggtatatttaaatgatttaatttaaccttaagtgtaccataaaatgctggatacaagtaataattaagaacttcaaagggcaacagaaaccctctaacagtccttcgtttaattaaaggctattattagaaagctcttgaatatacagttacatttaatgacgagtgatgactagtaaaagcagtatttgaaagttatgagtatcttattttaaatactattgatagactctagaaagtatagctatcatttcgttttgaaaataaatgacatgtatttcttgaaaaatcaaattcataacattaaaagactgtttaagatgttttgcttttcattaattctctagtctacacacacctttcatgatcataaattaattgtttgctttgtaaaaagtgtttctgcctatttaaatacctttaggagggtatatttttctaatacagtggaatgcttatgaaggcatgtatacaatgtatatggatgcattaacaataaaatgggggtttacttgtgcattttgaaatataacattttttggaatgtgaattgatatgtaatataacagtaataatttttttagaagtttctattatttagcacatttgtgtgagtagacaattggccaaaagccccaggtgattctaaataaattttggaaggtgtataaaccatctataaaataggaacagagtatttatgtaaaatttgctcttctgttataagtatttattggactattttgctttatctacatttatttatacaaggaatttggttggaatttccatagttaaaattcagggcaggtgaatgattggtgtatagatacattctcaagtgaaattaatgaacaaatactttaaacattcatttagaacatattactaattctgtttcttaattatctttattaattggcttatgtacacatctataataaaaaagctacctacttattaagcatatacaattttatcttggtgagtaatctgtcattttgaaaatgtgacactaattcctttgttcactgtgggacagggaatgccatgggatgtgtgatcttggaaagatttcttggattaaatatttggatacaaatctatatctatctagtttatccagttagctagctaaataatgtattatatgtatatagttcactgtctaggaaaagtgtgcacctggtgggctttttgtatagcatgttctttaatttgaaattattttgacatcaatttcttattctatccaccttgcaacgagtatgattcttcatttgcttatcattttccccggcgccccttcctgattcttaggcactcataaggtttgtagagtaggggacttacctgtcttgttcactgctgaatatcctatacttagaacagtgtcagacacatagtagatgctcaataagtttttgtggatgaaagaatgaatacatttaaataagagatttatctttctgagacagccgttgccctctggatctaagggcttgattttgatagatagactgattctctcaatatgggagtcctgttgatgctgccctgctttgttgaagagattacccttcccaggtagactaagatcattgatttatttgcgagtaagtatgtaactgcaagcaacctctaagctagctttcaaggccatttgtaggatatttatttgagatcctattctggatgtggggaatagtcaatagttatgaaatagggccaagttaactggacacatgggaactaagtgctagaccacagaattattaatgtattccaaacaaaaatattttgtaagtaattttaatatttttatttcaccttgattaaaatatctaactcatagaagcatgctgcttataaatggcctaaaatacttataattttaactaatgatacaagaaataagagtcttcctggcttaaccttctccttgaagttaggaccatttctgaaagctctattagttccaatttttaaagctccttagttcataaatcccttgggaattatgaataaagatatggctcatgttactaaagggtactcctgtgacttaaaagttaatctctctaaatatctaacctgaaatctaagagttacatggagaatttatatcatttgttacattttggagcagaaattagaaatatggtataaacagtgaaaatttgtctttttctccttttcacacaacatgagttcaaaataacaaatgtaagaagggcaactcaaaccagtgaaatttttttggggttattttattatgttcccaccaatgagatcctaaggtccttaaaaataacgaaacagtgaagtgttgagttaataaacaacaaacaaatatattcataagaccaggtggtagaaaagtgagtcatcaaaacgtgcagaccttttctatttctgtaccattgagagggaatgttcttgatttggaagttgaaagttgggctaagcatttgattgacctcattaactctttcaagattattaaggtactattttagtctatgaatgcattttttgaagctacagtgaattctcttttgatgcaaaaaggtactaaatgataccctgggagatataatgggcttggcaagtcacctgtcatgaacattgtaactgaccctggactctcgtaaaatttggatccacactgctattgtcaacagactttattataaaataaagcagaaaattcagactaaatatctgggtcacttttaggcttttgtcttttaattacaaaagaaacctctaatgtacaagtggccataccgctttttactacattaaaggtaaagataaatatgaggaaatcaattacaaatttctgaaccaatattaaacctactaaccagcaaatttttattgattaccttctactaatatactgtgctaggggctatttacatgtttgagggtgtaggcttgagagatagaaagccttggaagaggacttagaaaaagtataagaaacgatgctcacacccggcgcggcagctcacgcctgtaatcccagcagtttgggaggctgaggcgggcggttcagttgagcccaggagttcgagaccagcctggccaacatggtgaaatcccatctctactaaaaatataaaaattagcagggcatggtggcaggcgcctgttgtcccagctactcgggaggctgaggcagaagaatcgcctgaacctggaaggcggaggttgcagtgagctgagatcgcaccactgcactccagcctgggtgacagagtgagaccctgtctcaaacaaacaaacaaacaacaacaacaaaaaaagctcactctaagaaacctaagatcaggttcaagtgactaacaaattgtgggatacctattaatgagtatattaatagaaatccacagtaaagacaaattagtatgaatgacaaatgaaggattatttggagaaagtaatatttgcatttttgagtcggggctttgaaagacttgtagaattaagatagttagaagaaacagcattattggttagaaaaacaaaatgatcactgatgacctgaatgcatgaaggagcacagcacgtttttgagaatgagaagacagtagagttttatattcagtagtgatgattatatttgtggatagatggaataaggccagattatttatattcttgaaacttggccagcagggagacttgatgatagaaattacagatagttacttcagatttcttctttgatatattcaacaaatatttattgaacagctactgtgtgcaaagtgctgcaccaagcatgggagaacagtggtaaaccaaatccaattcatgccctatctcatgaaatattctagtcgggaagctagactttaaacagcaattacacaattacacaattaactaattagttatggaatgatacattttgtaatgaagaagtacataaaattatgagaatatgtaactagtctgagacaaggactggagttaggaaattttcccttaagatgtaacgtttgacagggttaactagaggaggagtagatgactgagcaaagggaaggggtcaggcagacctttatagataaggagacaacacatgtcaaggcccccaggtaggaagaaggctttcattttgaggaactttaagctcagtgtgattagagtacagaaatatatggaaatcaggtaggatggactaagatgaggttagagagggagacagactttgtggggttttgatctttgacctaagtgtggtggaaagccactgaatgattataaacaagggagtggcatgtttggatttatttacactttaaacagatcattctgtctgaagtatgaagagcaagcttgtccaacccatggcccatgggctgcatgtggcccaggatggctttgaatgcaacccaacacatgagattcttttggtgatttttttaaaagctgatcagctatcattagtcttagtgtattttatgtgtggcccgagacgattattcttccaatgtggtccagggaagccaaaagattggacacccctgatgtagagtaagaaaagtgtggttgagggaaaagtagttatgtagcagaggtaattgttaaaagatgattgtgggttggactagggtgtttgtagtgaatcttaaaggtgttatgatacaaaatatgaccacataaacaaaatgaggtaagtagcatttaaagaagtttcaccgtaatcagtattcaggtgagccacaatgggcctagtagggaattagggaaatagttggagactgttgaaataatctgagaaggtgatgaaacctgaagttgggaacaaagaagagaagacatgtgatagagacattttaaaaagaacaacatgtagattttttgacctaacgttttgtcttagtaccatagtggctttggtggctagaagaaggagggtggaaggaaaaacaatcaactcctttcagaagtggggagtttgcagtatcatccagttaatcagaaagtccagatataggagtatgattctatttggaaggcatcaatagacatttgtgattaggttaaaatgataaaatatgtgaagtttgccaaggaaagtatagagagcagagaatagcaagcccaagtatggacactgacactgggggaaggaataagcagatgtcactcatggagtagtttacatctggaaacagtcactctttgtaatttccttttgaaaacaacttattttagctgtttgcaatttgcttttgaagacaacttattttagctgtttaatgtgtgttcagttattgaaacaagtcctcacaaaatgtctgcagtttgccacatttaagaatatgttatgttgaaagaaagggaggagagactagttggagactgttcatataattctagaaataattggaatgtaagtaatgcttcataaacacataaattaaacatgattatcaagttatccattatatgctcaagttcataggaattccttttaaaaaatataagcttatttcttcatttaataagtatttattgagaacctgttactacttttggtcctactgatttctgattatggaatctacattttaaagaggaaagatagtaaacaagtaaataaaagaaaatatcagatagttatcagtgttatgataaataaaacataaaaggggacttactttagaatgggtggccaggcaagacttacttgaggaagtaatgcttaaagtgacaccttaatacatgaaagcataatgattacatttaaaaaacctataatgagatacatatacttgtccatcaatttacatgagattaatgaacctatttgggtttaatagaagctaaaaatcttgacttgatttctcttggttctctattcaagactataaaagacagaagggtagagggcaaaacactgtgatatgaatgtgattctttgcatgcttcacttccataattatgcatccaagttcaaagaaaaagctacaggaaataatttcttttctttttttaaaaaaaattcgatagattttggccaggtgcagtggctcacgcctgtaatcccagcactttgggaggctgaggcgggcagatcatttaaggtcaggagtttgagaccagcctggacaacatggtgaaaccccatctctactaaaaccataaaaatgtgctccagcctgggcagggtgagactctgtttcaaaaaaaaattagccatgcgtggtggcaggtgcctgtaatcccagctacttgggaggctgaggcatgagaatctcttgaatccgggaggcagagattgcagtgagctgagatggcaccattgcaccctaacccgggcgacagagcgagtctccatctcaaagaaagaaaaatcagtaggtttttgggggaacagatggtgtttggttacatgaataagttctttagtcatgatttctgagattctggtgtgcccatcacctgaagagtatacactgtaccctctgtgtagtttttttttatcccttgcccccccaccctttccccgagtcccccaagtctattgtatcactcttatgcctctgcattctcatagcttagctcccacttatgagtgagaacataaaatgtttagttttccactcctgaattacttcacttagaataatatctccaattccattcaggttgctgcgaatgccattatgcaggaaataatttcttagttgcttatttggcctacgttttattagtttttgtagagacggaggtctggttctgttgtccaggctggcctccaatagtgctgggattacaggtgcaaagttttaaaaaaaatttcctgaataggcactgactgtcacgtacctgtaatcccacctacatgggaggctgaggtggggggatcacttgagcccaggagctagagtccagtctgggtaatatagtgagaccttgtctctaaaatataaaatttcaaaggaaattttatattcgccaataatatattgatttttaaaagcccctttaaaatgttaattttactaccaatatagtgagaccctctctctaaaatataaaatttcaaaggaaattttatattcaccaaaatatattgatttttgaaagccccttaaaaatgtcaatttgaaagccccttaaaaatgtcaattttactaccaataacattaagcatgtatgtaaaaatttatatttttgaattgctatcacaagtattgattgataactagagttattcaacagtactgattggaactggggctgtgaaattttaggtttactattaagaaggtaataaacaagaaagggagggcttgagctatcaattaattgtcctaatttcttattatgtactggctataactttacagagattgacaggatagttccttttcacatattatgatgttttaatttcattgtactatcaaatttttaacttatcaagtaaaatttactttttcttaattgcctatatcatatggttttgagaaatactggtatttgaaagtcacatatccttaacgtagttttgggaattcacattaagtcttgaaattattgtttaacaacaacaataaaagttttttttcaaatagagtctcactgtgttgcccaggttggtctccaactcctgggctcaagggatcctcctcagttgctgggagtagctgggattaaggtgtgtgccatttgtttttttttttttttgaaattttgtattttagagacagggtctcactgttgcccagactggactgtaactcctgggctcaagtgatcttcccacctcagcctcccatgtagctggaattaaaggcgtgtgacagtcagtgcctgtttaggacatgttttttaaaaagcttgcacctgtaatcccagcactctgggaggtcagcctggacaacaaagccagatcctgtctctacaaatactacaaaaacattacctggatgctttggcaagcacctgtagtccattactcggaagactgaactgggaggattgcttgagcctggagttccaagccacagtgagctgtagtcaccattagcactccaatctggttgacagaatgagaggctgtctcaaagaaagcaaaaaaacaaaaaacaacaacaaagtttcacagagacagaatgataaaaagtaaagctctggctttcccgagttactctctctcgagataaccagcagtttcttgatgtttggaaactgttttcaaattaaaattgaaattattttgcttgtgtgaaagttttccaaattatagttatattggacttgggaacattttctgctattttacaacattctgaaaagacaatgtcaaacgtatgcaaggattagattaaacataaatcattaaatatcttagaacctttgaggttatctttggtgaaaactaagctcagtaaattaatattgtttattctttgtgaaatttgtacttgggagacttaaaggaatgtaatggacaattttcctccaaaaggtatttatttttgcctcaaaggatttaatgaactttattgtgaacacaaagagtccacaattacggtttagtttacaaactctctcacaacctcatgtacttgaccaactttcaaatgtgtggtttcccactcaataagttagccagtctctaaactgtagcttgagccatcatcaataaccttcttatcaatttccaaacacttgtgaatcagttaaaaacttcaggccaggatgttctcatggaattagaagatgctgcctaatccctaaccactgtccaatgaactcctgagactacaagaacagcaacagtagcctaatgatcagtcagttattctgttaacagaaagattagtaattgctgcctattctgctgaaatccctgtcattcttgctgtttcctccatcagaatttatgttaaatcacacattctgtgaagctgtcaagttctctctagttctaaagctagcccttcagtttaatcatccaccttggagcaactgtggctgctaaagggaaattttacagcagctcaaccatgaattatctcctggcaacatggagatggaacattacgcagttaggtaagtgggtaaaagtcttgggttttctccatatcctataatgaagaaaactcttaacatcaaatattttgttaaccagtacccaaactgggaaatgaatcaggggtgtgatggagcaaatatttttttcatccattaaaatttctctgactgttctagaactgagaagaaaacaagaagtaagaagaaaataaattagttattgaaactaaataaaaccactgtactggaagctttgcagacattatctcatttaatcctcatgaaactctgttgtttggcctcatttttcagaggcagaagctaggcttggagaaattacttaaaacaagtaaaggaaagaagggacaaaaggagaaatgcttagatatcacagaatcagggtcaggataagcttatatttaaacaaacaaaaagctccaattaaagaacattatgatttatttatctatctcaataattaagaaaagcagcaagccagtaaaactccagcactttgaattcataaattatcaaagtagtagatcatttaaggggaaaaacagaggacatttgaatggggaaaaaaacacttttgtgtgtttgtactgaaaatgaattgaatattcattttgcattcagttgctatggtatatgtaggcacaatttataaatatgcacacttgctgcttcaaattttacatatttcaaaattaaatctacatttatatgttttcagtatttgaatttcttaagaaaactaccaatttttatgtgtgaaattttatctttaattttatagaaagaaaatttgcattgaaattatgttcactatatgtgatattgttaactatctaaacatattaaccctaatgttaatatgtgacaactttgctttaccttaagtctaaatgtgtgtgaagaggtgtctttgatgtaaagaaaattaaaataacataactcacatttagcactcaagcattgtttgaatcaaatatatgctaactttttttaagcctctgaatttagtaacaaaaatgagttaatggttctgcgtgctctgcagaagaattgagcaggctgtgttgctgcagtttcacattgcctaatggcatggatggcaaattgatactgagcaaagttgtaaagggagggacatttgtatcttgtagtttagtaatagacatttttgttctgagccttttaccttcacagttgtttttctgttttcacatcctttttccttttagaagatatccaattttttcttgtcctctccgatttggccctatttatccttgctctagggacgggattgaaatatactaatccctcaagtgaaaattcctattatggtttaatgtctgtcttagtctattcttgctgctataataaaatcccttagtctgagtaatttataaacaatagaagtttatttctcacagttctggaggctgggaagtccaagatcacagtgctagttgattcggttcctggtgagggcttgtcctatctatagcctcttcttgagcgtgtcctcacatagcagaaaaggcagaagaggaaaagggatggaaaggcaggcacctctctgaagcctcttttataagctcattaatcctattcatgagggaggagccctcataatttaatcacttcccaaaaggctcctattttttaatagggggtctattttaatactattaatactattttaatagtattaatactattgcatggaggtctaagttccaacatatgaattttgcagggacatatgcattcaaaccatagctatgtcttatttcttaaaacatactgtaggttgaaggaatgaaaattgtgttaacattcactcactgttctgtgtgttttataaacattaactcatttaacctctcatgataacctatgaggtaggtttttaattgtggaagttcaggtaatcaagtaggggaaagcttgggaagcaattgatccttttatctttgaaatcataataaaacaaaattccatctgtatggccaggccatttgttactcctatgataggaatcctgagccaaggccaatcaagcataaaataatcttgcggtcagtgtgatgtggggcaatgatgatagggcttatggtaagatcccattagaacctcaggacagggattttattgactcatactacgagtagaaaggttcacatctaagtttaaaaaagttttatggagatatgctaattcttgaatttttactgtaattatagttgaaatgtactgttttgttatacgtaatgtcaacattttatgtctaatattttaatatgttacttttaaaagttaattttttaacttttggaatatcacagtgattttaactttaaaatgagttatccataaataacagttgctttcagtttttaaaaacacacttcttagagaaggctttcttcataaaataagattcagttccattcattctttgttacagcgctatgcagtgctatgattattttttcaggatatcacacattgtttttattttatttaactctgtttaatgtttgacaatgtttaaatgtgaaatacacagtcttttaaactactgagtaatactctatcaggattctctaaaaacctcctataaatacataaatgaatcaaaggattgtctattttagttaaatttttatctgactttttagaatatgtggaagaatcactaagaaaaatatgtaaacagtaaaaacaacaaggaaaaaagtactaatgagtagatttattttaattaagtataaaattttaaattttaacagcaaaaattgtttaatatttttcaaatcttacatgataaattgataggaaatatgcccactctgaagctgattattatatagtagttcaaattatcatttcatttcttaactagtcatttcttaaagaagtctttgagaaaataatataattttttgattaatattgtattgatacagatgcctgtgagagtaattctcatacccggttgagaaacttttagaaactaccaatattggagctcaacccttaaagtttctcatttagatagggcctcatcatttaaaaataaaaaacaaaaaataattcccaacatgaatttaatatgtagctacggaattaaccactggactacacaatttttatacaattatttctatcacataattctgtttcctgaatggatcccttgcccttaaatgtagaaattttaatatttcgtaatgcgtcaattatatcagtttgattcaacattcttgaaatgtttaatcaaatgtattatactaaatctgttacaacataacttgatataatgaaagagtcaatttacaaattagggattatccattgttttctactattgtgatggctgaagtaagtagaacaaaaaaattagtgtaacttgatttatcattactcatttaaatggctgagtcatattctatgaaacattttgttgacactgtgacattcatgactcttagggaactggatctactcaatatctaagttccagaacaaaatctacagatttgtaagagttaagctttcttttatgaacattgtttaaatttagaaaagcatcatctgtcttgcaacctcactttgtgcttaagagatacagttctagaactagtttttgtaatttgtattttgttttggttctagaagtagtattgatgcttgccatcttactatttagtaaaagttgaattctagataattatctttctttttcctacctaccacgaggaattagagagaagggaaattaaaaaaaatcagtttactataatgtgatagctatgaaaaagattacaggccttgttattttctcccaaatagctatacatttaggacagtcaaaaagaatttatacaaaatcaaagtggaaattaaaacgttctcttttttcctaaggaatttggtttcagtatctgtacagtgcccttaatacatgtaaaatcagaacagagtcaatctgtggcttagctacatacaaattccttgagaggcagtgtacaattgttggtttgaaataagcattagatttatcatttaaatgttagctcccaatcactataccagacttactacaaagtaagaaagatgcttttttcagtgattcacatgagagtttatcacatttgaaaacatttttgcaatttattactggtcatcctttcttatacaattattggtaccaatcatattttacaggctaggaaatgagttggatatatactaaagaaagtctaaataaagtagaatgattttgagggtattttataaaaatgggatttggggttggtttggaaatgtccttaggcttgaataaaatgctgaaatttgtaccaataggatatgagatgctggtaacccatggcatgtagtaacatcaaaattaatcaaattatcacctatagttgactgtaattaagtaccttctgagacaagcattttgggagactaagcaggtgccactcttggccactatggctatgttaatgactaaaaggaccttggtatgggatgaattcttttgaatgacctggaaatttccagaaagcaaatgagaagcgcaggtttctaactcttggtttaaaacatggtgagagaacctgagagcttctattttggccttaaaataaccttatttctcgtagcaaccacatctatattgctgaaaattaagcacaggtttctaactcttggtttaaaacatggtgagagaacctgagagcttctatattagccttaaaataaccttatttcttgtagcaaccaaacctatattgctgaaaatttaacaccaaatttaattatgcagactacacaattctaacataagttgaattcacggttttgccaagtctgtcccataaaagtaagggcatcaattggaagatgtgggattctgaaatggggggtgaaggcattgttaatggaaggaaattgtcttttcatgtctaagactagccatcccctattgaaaatcctctgataaccctaccctgggcagttgctttgcaagggaatgccattcttctcaagacccaccccaaccattctttgttgtcactagactcattactagggtcatatctcagtacgctccaggaatacaagtctgaagtttcagcaaggaggaaatagcttatgtgctaagagaactgcaaaattttgctgatatgtgttggatgaaatctgggaaatacagccaggaatgaattcttaagagtattggaccaaggaagaagtactataacattgggttgggccacatttattgatatggatactcttactagatattctgaatttaatgcattagcttgtgcagctggaagtgactctaaccatttatttgtttggttgactaaaagttagactcaatggtggcctatatatataatgaggaaaatatgccagaatttctttggaatagtagaagccaaaggtttatgatgacaggaatattggagtggacttatgcatgttgtgcatagctattacctaactacatcacctcagacagcccagaggacactcactttacaaaggcttaaagaagtgcattagtgaaaggagcacctgcatccttgaacagctttctggtaattgtcttctttcggtcaaatggcagcacttaatttccaaaaacaggttgggcatatttgttgttaagggctgcagcgacatagtggtaattagaatgttttgatctacaggaatatttaacgaaaggcaatctttctagtaggcagaatttcaagccgtccattaggctgtccattttgtctgacttgagagatgagtagaactacactggtgtagtttattaaggctgccatattgcagtactacagaccgggtggcttaaacaacagaaatttatttccttacagttctggagactagaagtccaggatggaggtgtcaacagcattggtttcttccaaggtctctctccatgactgatagatggctatcttctccttgtacatttatatggtctttcctttgtgtttgtctttttcctaatatcctcttcttagaacaacaccagtcatattgggttaaggcccacccatatgacctcagtttaccctaattatctctttaagggccctatctccaaatgcagttacattctgaggtactagggcttaggacttcaacatatgaattttgaggagacacaattacacccataagatacatatctacatgaatttatgagcagttgctaatggtttgatcagatgatcagaaactcagaaagaacaggacaaggaagtctggggaagaggtacctttcaaatagttacagggtatgaagatatttatgtcccacatgaatgctcgtaaaaaattatccactgcagagaacactcagtaatcacatggatagatttactcatttattgtctggatgtcagacagcctctttccctagccgtcctggttcttactcaatcagtcgatatacaaggtggccatggtggtaggaatggaagctcagcatggactcaacatctttccctctctgaggctgatctggttaccactactgccgattgcttaatatgctaacatcagatggaagcaacagtcaccagtcagaaccagggtggctggttctccccaaagactcagtgttgtttctgattttgtcctcactggaataagaaatgcattctgggtatagatttagttcctttgccagcaccaccaaacctggtcttagagaatgccttcatggtattcatgctcatggtattctgtataacattcttcctatcaaaaggaattcatttcatagcaaaataattgcaggaatggtctcatgtccaaggactcaatgatcttaccatatatcccatcatctagaaacagttggcccaataaaagtggaatggcctcctaaaggctaaattagacttcagatgagagacaacaccctgaaggatggggctttaccttagggaatgaagtatgtgctttgaatcaaagatcaaaatatgttgctttatctccatagccagaatatatgggtctgggaattcagggttggaagtaggagtggctcctcttacaattacagttaaaacccacttccagaatttttgctttctgtttccacagccttgggtttggagttcatgcttcctaaggaaggaaggtcttcatcacaggatccatatggtttcattgaattaaaggtgtgaatttcacctggctattttgggtttctcaattcactgaaccaatggcctagagttataattcccaaattatcaaaggaaggaagaaaatgtgcagagccaatttgttttaatttttgtaactagtcagagacagtagctgatgtttataacttccttctctcattacttattccatgtttcctttgccctctctcagccaggacctcagctggtcaaagtcctttacatgacagagttacccaaattttcatttgtgatgtgtctgaattctgcccttttttaattgtagctttttattaacttttactattagacatgctaaccctaagaagtgcccaaagaatcccctgaattccagacaaggtctcctcaccctgttggatagtttcaacacagtcacaattaagataatgaacatatttgtaaccccaaagaacttccttctgcccctttataattcagccctcctgccccttcctgccttccccaagttactcaggtagcttctaatcttcctaagtataggttagtttgtgttttctagaattctatataaatttgatcacacagtatgtactctttgtatttggcctagcttctttcactcagaataatcattttataattcttccatgttgttgagtgcatcagtagttcagtcctttttatttctgagtagcattacagtggatagatataccataatttgtttatccattcacttattgatggagatttggattatttccagtttttgacaattaaagtctctatgaacatttgtgtttaactcattgtatgaacataggctttcatttctcctgggtaaatacctaggagtggaacggctggattatatggtagttgtacgtttaactttttaagaaactgccaaatattttttaaagttgtactttgctagtatttatttccaccatcagtatatgagacctctaggttcacatcctcagcaacacagtgtgtccagtcttttaatttaatttaaagttgttttgtttttgtgagacagggtcttactctgttgcccagcttggagtacagtggtgcaatcttggctcactgtaaccactgccttccaggttcaagtgattctcctgcttcagccaccagagtagctgggattacaggcgtgcaccacaacacccagctaatttttgtgtttttagtagagacaggggctttgtgatgttggccaggctggtcttgaactcctggcctcaaataatctgcccacctcagcctctcaaagtgctggaattataggtgtaaaccaccgggtctggccctttttaactttagacattctaataggtatgtagtggtatctcgtcgtggttttcatttgcattttcctgatgattgatgaagccatcatcacaatcaagatcgttaatatatccgtcactttagaaaatttcctttgtatgtgctttagtgacatttatatatcttctttggtaaagtgattgttcaaatcttttgtccatttaaaatagtagattgttggttttattgctaaggagttttagtttttgacttatgtattctgggtacaagttctttatcaaatacatgttatttgccaatattatctcctactctgtagctttttttgcattctcttgaccatatcttttgaagagcaaaagtctttaactttgatgaagtaccaatttttcctttaatacgtcaggattttgaatctaagagatctttgcttaacctaattttacaaatattttctcctattttttcttctagaatttttatggttttaggttttcctttttggtctatcctccattttgtttttgtatttgtttgtggtgttaggtatgaatcagtttattttttgtatatagatagccaatagttccacactatctgttgatggttagcagtttcactcttgttgcccaggctagagtgcaatggcatgatcttggctcactgcaacatccacctcccaagtacaagtgattctcctgtctcagcctcccaagtagctcggattacaggcacgcgtcaccacacccggctattttttttgtatttagtagagacgggatttcaccatgttaggctgtttgtgaactcctgacctcaggtgatccacccgcctcggccttccaaagtgctgggattacaggtgtgcgccaccacacccagccttcaagtttgtacttctaaaccaactgcagtctgtgcattcacctttacaacaaccccaggtttaggacatgttgtgaattaatgaatatctatatggttatgacccagcctattacctaatatagaaagaatatcctttttaagtgaatggtttgaaaatacacataccataaaagtgaatcttaaattttgaacctaaataaatagccagttatgctgtcttttctgcaactggactaagcattcatttgctattgtacaatgaggaggaaaaaaggtttgtaatattgagagactttgtaatgagaccctaaagagccagaatctatttaaaatactgacagtgaatcccataacagtttttagaccaaagaatgaaggagggggttggttgataaactactcaaaaatagaaactgagttaaaggtgatgttttggctgttaggctttcttcaggccataatatataaaagtaatatttttaaatttcttcttctgcccaaggaaaacctcaaagatagaatgttatgtttaaccttattgtacattccacagagtattttaagaactagaaaaggattgctggggcaaaaaatgattgtagtattgaaagatcagaaaaactctgtcataattttaaaaaataagcaaacactgagaacttcatccgcaatgttattctgaattcagtattctatcgggggacttttgaggtaaataaataagactaacttagagttcacagtatttttggatctgagtgttactttcttctacatagtattacttgaaactttatttgcttttctataatagtattatttagcttcaagtcaagcattgaattgtaaaatgattttaattgacaactgaattgttcagtgcattttacttatgtatcccttcctaataccttaaaaatattgtttaattatatgaagatatcttctagaagttattaaaatcacaatattttattatatttatgattgaattttgtttatacaattttttgaaataaatgagttaacaggttataaaaaatagacatgatagaaatcaaagcattaactccaaaaaccactaacaggttggtcttaattttttttgtctaatgaacaaacaaacatgctctgaaaaaaaatgtttatctttgacagatatggccaggttcaggctagattgtgatattcactgaagattgtgtgacattgttctaaaaatataggtgtctgtcaaaaccatcaactgtattggttagttgttaatatcttaaaaaatggaataaatgtctatgcatcctaaggaaagagagttgcaaatgagacaaacactgttgattgctagaagctgactctgaaccaagtgttttgcatattttgtcttatttaatccttacagtaacctcatagaaataaaaacaatttgtccattaccataccactagaaagtggtcatatctagcacggatgtatttgctctcaaagcagttctttccattacgcagtgctaccttttaaatatataccaggtcatagtcattcattaatgtggcagaaagcagcaactttataaccaggtagtattctatgtaatactatgatatgtattaaatactcatgaaaagttatatatgtttactataaacttttatgtattctataaaaacatgtagatttcttactatttcttattacatctatattagattttttaaaaaaattcacatttcatgtcaaagtttacttttgtcttcattatgataattttcagtgctgatattttacaatattgatgtacttcatttattatatttttttctgagagaaaatggattaatgtagcctaaatgactaagtaagataacaagaagttcttctgcaataaaaaaatcattcagaagctgttataatttgcatgggttcatggcaattatagtcttttgttaattttctttttattctcttaagtatttagtgaagttctttttgaaaattgccaaagaaatggtcatattttgtttcattcactgatagtattaaactaaaccatagtgagtggactcgaattcaagtaagattttcaattggattaagactgggaatcttgtgctattttttgctatcatagtttctaaagaacagcacaaatctcagggacaaatttcaacgcaatttcagcatcacatatatgagggatatacaacttaggagttcactcctcatatcatctgtaggtgatttactgatgaaacctaccagaggatggcaaatattttcctactacttgggtgatccacctgcctcagcctcccaaagtgctgggattacaggcatgagccaccgcgcccagtcttttttttcttagaatgaacaaaaattttgttttgaaaatgtaagaaattttcatggtaccaacgaacttgggaacattccgaagagttcaaaaataaaggataggaataagtgacttagagctacactgacaaaataaattataagatgtttctttgtgatgaattctgaatatgaaaatcccatcccaatgcttctgtttgtgactcaatggatcaaaaggctataagtgattactaaaagataattatgaagctaactttgtaaaaaccttcttacatggttattctcattaccaatattagagcaagttcagtagtatttgcaggagaagacaaaaatgtacttgtcagtatgctcaaatacttttttaatccgaagaaaaatgtttattaaattgatactacttttaaatacttctgtactgcatttagtattgttctgtaaaattagtttttggcaaatgcttttcttcaatcatccctttgacaaactactgatagttttgtaacttggcaaaagaagggaaatgtagtatgttgcatgtatcaaactaccttgtctgatttatgtccaaaatacttatttacctctctaagaaggacttcaattcacgattattgaacaattactgaagaattaactcataagtgtagactgctagggtcaaattagattactatctgaattaacatcatcatttactacaaactgagctgctaaattgccaacctatagttcagggttttttgtttgtttgtttgtttgtttgtttgtttcttacagagaccgtctgagccttttatatttgcatcttgacatttttcttgcatttattttttttaaatagagaattccctatttttcttcatgtcattgaacaaaataagatttataaacaaaattaaagcccaaagtggtttggctgaaaaagtatttattttccaaaaacgaaataaaacaaaacaacaaacaatcctgagacattgtgacaaatatctgttcctcaggatgtgctcccaattcctccaacccaatctttagtaaccctgtgaacctgtggaagccaggtaggagtgggactgaggatattttatttgaagaacaaattaagaaggtctaaacagtagagcaaagctctcaggaattggtgaaggcttttgcatgaagcagcagcaaggaaaaaatatgaaatgcatgaaaactctgcacagcagttttaaagctttgataaaatataaaatgtctttaacccctttgctgttcttgcaaacgcctgcaattcaagaattttattattctggggctaacatattttaaacctcaataactgaatgtttcctttgggataccttcaggcaaactatatattgattttctcagaatgcactgtatttttcattagcatcaaggtttggtggatatccagtcatttgttcaccaaattcctctgaaaattaaaatggactactccattttggctgtggaggctttggagcatgggcattcattttttcctattaaacactctgccaaggtacactattttgacattcatcttgtccaggacatatgataccaaatcaccttttaacttggtctgccataccattccctatttgccactcgggtttgatgacacatttgtcatagctaacatcagaatgtttctctgatttatctttttaagctatagagctatagatttgcctatataatacaaatgaaatagtcttctctgatcatactttcatttgaattagtcaggaaatttagttattttaaaatgcaagtcatattgactttgctcaatattcattgtttcatttggtggtagaaacttagtccatgatgtagataatgtggttttcacatttggaagtagaattactcaagtaactttgttgtgccttccactctcatcttttatgaaccacgtctactttcctgagtgaagacagactcagcttttcttcaagggtacactgctcaccaagctgggtgtacattaagagatcatgtattaaaggaagcttatcacttattttgtcatacttcattgtttttgttgttgttgtttttaaatgagggtcttgctctatcatccaggctgtagtgcagtgacatgatcatagttcattgtaacaccaaactcctgggctcatgcgatctccctgcttcagtctcccaagtcgttgggattacaagggcatgccaccatgcctggttaatttcttaatttttaatttttggtagagataatgtctgtcgatgtttcctaggctggtcttgaacttctggcctcaagtcatcctcctaccttagcttcccaaagtgctgggattacaggtgcgaaccactgtgactagcctgtcttacactttttgataaccagcacattttttattctaccagccattactcccaaccccacccaaaatgcatggtttgaaatagtagttgataccttatattttaattttttgggagacacgatctcactctgttgcccaggctgaagtgtggtggcacaatcttggcttaccgtagcctcaacctcctgggctcaagcaatcctcctgcctcagtccccaagtagctgagattacagacatgtgccatcatgcccggctgatttttgtattttttgtagagacagggtctccccatgtttcccaggctggtcttgaactcctgggctcaaatgatctacccaccttggccttccgaagtgttaggattacaggcgtgagccactgcgcttggccttagttgataccttttttgtatagatatttatatcatgcattttgccagtaagccaactgagccctctgcatccacacaacatggatttgctgttctttcttaattttcgtgacaaccttctgaagtaggtgcatagtagtataacagttttataattgaggaaactgatgaaattgtatgctatggtctgttaattcagtgattttagaggaagttgggtgtatcatttagaaatatcaagtatttgctatgacaggaataattcaaggagccaaggaagggatcagtgcagacatgcacttgctgtttcatatttactatatgcattctcagattttttgaatgccctctgtgagtagaacactcagtattctaggcatgggagatccaaaagtgaacaatacaggaaaggcctccactgtgatagaatttacctccaatcagggaagaaggggagagagtcaatataaaaggagccaaataaatgaacaagataatttcaggtaattgatgaaggctttgaaaacagtgagacagggttacataacaagagagactagaaagggtaggaattgggctgggagtgttgagagctactttaaattgattaataatttcactaaggaagtgatgtttctgttcaggcctgaattatataaaggcattagccatgtggaagtctgggaacaaaggaaaaccaatgaaatggccctgtgctggtgatgagcttgatgtgtacaagagcctggaagaaggcaagtgtggttggagaatagagagtgaggcggcagcatcattagtatgaaatgaggtcttttaccctggattaaccaaatttgtaatttggctataaagaaaacttcaggattcagaatttaaaaaattttaggtcaaaatcagtgttaatttacaatgtattattataggattttggatcaaatgtcctttaaaaagaattcatgtgagaagatttaaaatgcaacttataatagcaggggaaaaaaaccaacttaatgaagtattgagcacttctatgtatcagagtctgagctaggtggaggtagatgaataagacatgatcctacatgatcctgccattaacaacatctctgacaggtaaaatgcaggttaaaactattacctatcaatgtatgaaagaaaagccaaccaacctcagaagttatcctcttgtctgaaattggacaaaattaccttctcagttacaactggaatttcttgtctagtgtccactgtatttaattgaaatccagtttaaatttaagcaacgtaaattatatgtaggtgcttcttaatggttgatttattagttttattaacaacacttgagtcaatgtatgtaacttatataaacaattactacatcaatgctataatcataacagaataagatataaatgtagatgcttagtccacttcttcaaattatttccacatgtcctctcagttacaatagtatgtacatctgattttctaaatctgacaagttattttattctaaattttcatctgaatttctaaaactaattcattttagaaaaaatgtaggctgacaaattactagagccccttatttttcctcctttcattatttttataaaaagcaaaacaaaagtaatgcatgcggccgggcgcagtggatcacacctgtaatcccagcactttgggaagccaaggtgggcggatcacctgaggtcaggagttcgaggccaacatggcgaaaccctgtctctactaaaagtacaaaaattagccgggcctggtggcgggtgcctgtaatcctagctactcaggaggctgcggcaggagaatcacttgaacccgggaggcagaggttgcagtgagccaagattgcgccactgcactccagtgtgggtgacaacagcgagactccatctcaaaaaaaaaaaagtaatgcctgcttattaaaaagaaaaaaataaataatacaaagattcataaagtaaaaagtcaaaatcttaatatactgcctctccccacaccaatctcaaacccaaaaggcagccataataaataatttggtgcatatcttgcagatctctttccatactcaccccattccttccctacatatgtttgattttttgtttatgtgactcgatcatactatgtatgttctgtgacttgcttagcaacctatcgttgaaataatttcaagtgaatggacatagatttacactattcttttagagtggtgtggaatttcatagactcaatccatcacatgttttttttactttttaagagtattcatattacaaaatattcaacatccagacaagagtagagaataaaatgatgaaaatgtgtgtacaatctttactatttgggcaatgagtacactagaaacccagtccccaccagtatgccatatacccatgtgacaaacaagcacatgtacgccctgaatctaaaattttaaaaaataagataatgaaaataatagaaacccatgtccatagcatgcaacttcatatatctaacaagttccctattgataggtctaaatgttattgctagctctttgctgttaaaaaacattccagtgaaaaaatctgtacacctaacattatgcacatgtgcaaataagttatgaaagaccaaattagaggtggaattgttggaacaaaaggcatgtgcatttgaaaagttgagagtcccagtaaaattgtcttccagaatggttgtgtttatactcccatcaataatagatgcacgtgaagccttttactggaacatagtacacttgcagaatgaagaatgataaataataagatgttaatatgaaagcacaatttttagaaaaatcaaattaaacctccaaaattatattatcaaacatagaactaccaaactcttgttcctttattaacttcattatctttttcagtaccttaagttggtgtctgtttgcacatatgttcaaattttttaaaaatgtagaagcatttctgcacagagcaaataaacttcattccaaaaatttgctaccgaggtttttatttgcatactctttgctcctactattgtatttccactgtctgaagtattcttatgtggtattaccacccaatacaagagatagcaatcaggattttttcttgaactattgtaattggaataactccaatattgccattttatcttgaagaactaggtgaaaaatgttttccttgattataattgctttttcagaaattccagcatttatttcatttacttaatcacttagaaatgctgaatttaatcaaagttacaaacctatagttcaaacacagcaaattctaatcagatttcaactaatttttttttttttttttttttttgagacggagtctcactctctctctgttgcccaggctggagtgcgatggcgcaatctcagctcactgcaccctccgtctcctggctccaggcaattttcctgcctcagcctcctgagtagctgggattacaggcacgcaccaccacacctggctaatttttgtatttttagtagagaaggggtttcatcatgttggtcaggctggtcttgaactcctgacctcatgatccacccacctgggcctcccaaagtgctgggattacaggcatgagccaccgcgcccggcaatttcagctaattttaacataaattttgcttactgaagaatggtctgaaaattaagtacgtgccactctttatgaagttaattttatgtagtgatttgactgggctaatggatgcccagatagctagtaaaacattatttctgggtgtttctataagggtgttagggaagattcacatttgaatcagtagactgagtacaaatgatcctccctcaccaatgcaggtaggcatcattcagttcatcaagggctcaaatagaacaaaaagccagagaaagggtggatttgctgtcttgtattgatctggaacatccaccttctcctgccctcagacattggtgcttctagttcttgggcctttggactcaaactgggacttccaatattggctcccctggttctcagacttttgagtttggactgacactacaccactggctttcctgggcctccagcttacagatcgcagatggtgggacttctcaaggctccataaccctgtgagctgataccacaaaatatatatatatatatatatatatatatatatatatatatatatatatatatatatatattttgagacagagtctcgctctgtcgtccaggctgcagtgcactggcgcgatctctcctcactgcaagctccgccccctgggtgcatgccattctcctgcctcagcctcctgagttgctgggactacaggggcctgccaccacacccgcctaattttgtttgtgtttttaatagagacggggtttcacagtgtttgctaggatggtctcaatctcctgacctcgtgatccgcctgcctcggcctcccaaagtgctgggattataggcgtgagccactgctcctggcccacgaaattcttttaaatatctatagatcctactggttctctttctctggagagcctgactatattctcttgtaccatggatgtgccacaacaaataaataaaacaaaaataactcttcattcctacatatatttcaggactctaggaatcttttaaaattaagggggccctatagtatatgtgctgccgaagtgagcactaaaattaaggaggccctatagtaaacttattttaagaactttcttgaactattttcaaggacaacagaatagttaagaatttataaagtgaatatatgatgtcaagtcaacaaatatttattgagctctgctgtatacacagtactatgttagatattgtggaattcaacaatgaaggagacaggctcctttgaagagcttacacttcagtcaaaagtggactttgaactctattctaggtggataggacttgcacattcctttcacttttctaactaagacaataagttttaaagttgatcaaaccaatacttaatactatattaaaataaactactcattgctcctgttttatactttccagcgaaaatcttctgttaagataagaatcaggaaactttgctttcagggtagccagtggtccagactaagatgagttgttcagtgagcaacactcttacaggttttaatacttttgactatgaggaagtggtttaatgctaagaaaaaacatgggaacagaaattgtgcatattctggtgaattatcagatagataattgaatgaatcactatgatatttggggtttatgatttccagtctcccactgttaaaacaggtatactcatcctcatctacttacagaaactgtgttaggattggtttcaaaaacaaaagccaggtctccaaaactgcctctttagataaacttgagtccttaggatgctccagttgtaaatagattaaataatctcatgttcacagaatacatgaattaaatatgttttcctgagtcccaggtgccatttatgataatatcattacatgctaaacgcatataaaaagaataaggtgaaaaaaggccaagcatagggtctcacacctgtaatcccagcattttcagaagccaggcaggaagatccctttactctggaagttcaagaccagcgttggcaacatagtgagattggcaacatagtctctacaaaaaatgaaaaaaagaaaattaggcaggtgtggtagtgtgcacctatagtcctagcttctcagaaggctgagacaggaggctggcttgagcccaggagtttgaggctgcagtgagctatcatcctgccattgcactcccagtctgggtgacagagtgagaccctgtgtcaaaaaaagaataaagagaaatgaagtccaagagtaactcgaacattccttagaaacagcaaattctaatcaaatttcaactaattttaacataaattttgcttcataggtatggcccatgagtgctatgctcaataaaaatgctcacagtgtgtgtggctcacgcttgtaatcccagcactttgggaggccgagatgggtggatcgcttgaggtcagctgttcgagaccaggctggccaacatgatgaaatcctgtctctactaaaaatatgaaaattgtccatctgtggtggtgtgcacctgtagtcccagctactcaggaggctgaggcaggagaatcacttgaacctgggaggtgcagtgagctgagatcgcgccactgcactccaacctgggggacagagcaagatcctatctcaagaaaaaaaaaatgctcacagacatcatcctaatcatacttctttctctgtcaaactctgtaccccaaaattaagccattaaaccattctaattaaaccaattgaggcataatatgtgtttaatcacaatgttagaatagatgaattcaaataaaatttgtggtttgattacaatatactgaaattagaactaaatattttaagtttttatgtcaaatcttgtaaaaattacttttccttatctatgtggtttagttccattgtgagctcgaagtaaaatgcccttctttatctctgtgagcttaaattaacctcaaattaacctttattattattttttattatttttctatgcttccaaaattatagaacgtgtttgggtatttatcatttccagtatgctgaatgacatcctgattgtctgagagagttatatgccttgtgtaaacaagcattttttttccctagagagattatcacaacttactatagcagcacttctgcacagttgtatgtaagattacctgggcagcttattaagaattcagattgccaggcctcttcccctgtgattcagattcagtaggtcaggagtggcattcaggaatctttatttttctgtcgtcccttgccattctgatgtaagaggttgggtcaaagcttgcactttaagaacactgctagaggccaaagtctaaaatagatgtagtgaaatattcatagtaaaacataaatgttttcttcctttctttcctgctctcttttcattactttttactaccccaaacttaatgtatcactttccccattggcttgtttgctctcaaatccacaattaagcaatatgtctgatatctttctaacagcctatgtttttcttgtggaaaatattactttattcattttataatcctctggtaaagtttgtgctcacacaactggtagtctttatgactagagatggggctttctaggttgtgtttttcttctgaatgtcttctctcagttgttctgtctcagtaagaaagtgataaggaatttataaccttattaataaccctgctttgtaaagaggcagttttcaaaatgattgtgatttttcagcaggatgatattgttactatgataaagctctttggtttcatggacataccctcttggctctttccttctgggtgtctttgtgggagagttgcagttttctgtttcctctttagtgtaagcatgattttgaaaattaaacattcattgttcattgcacaaatattaattcagtgtcaattaaatgccaagcactgttgtgggccctagggacaccactgtgagcaaaattaaactactctttgttctcatgaagacttcagtctaaattatggcctgaaataattggtagtgttatgaggtgggtcaggtggctaaagtgaactaaagttgacagaaacagtgaaacgtggttgctgaagatttgtagagcaggatgtgtctttaaatattatttattttagtcttctgagtttaaagcgggcaaaactgagaatgcaggaggtcaagaggcttttcctaaaatgtacgtaggtagtgaaacagatcttgaatttatctctgataaaaatgctggaatttaaggtctgggccttggagatcatctactgaactcctcattttaaaattgagaatacagattcaggttccaaagctatgcggctgctttgtggcacagtcacaatctgtagctgagagttctttatgacaagcagtatacttgaaagaagatcttggtgttgactatgagttcagaagttttccatctacatcaccctgcctgtctcatggacagagtatttggctgaaattgctaattactttttaaaataaactttagattttagaatagtcatagatttatagaaaaattaggatggtagtactgagagttcccatatactccacacatgatttctcctattattattttatatttatgtggtctgttggtcaaaattaatgaaccaatcatgacatgttattattaactaaagtctatagcctggttagattttcttagttttaaccttatgtcctttatctgttctaggatcccatccaagacaccacattacatttaattgtcaagtttccttaggatctccttggccgtaatagtttttcagacttttcttgttttgaagactgatatttttgaaaagaactggtcaggtattttgtggcatgtgcctcagttgggtttgttctgatgtttctctcattattagtctgtgggtatgggttttgggaaagaagaccacagaggtaaagtgcccttctcatcacatcatatcagggatacatattattaacatgacctatcactgttaattttaacactaattcgttggctagggtagtatttgtcaggtttcttcactgtaaagttaagcttttcttcacctttctgtattgtactatttgcaagacaggcaccatgtgtactctacacttaaagagtgaggaattataaaggaatagaagatggccaaataggaacagctctggtctacagctcctagcgtgatcgacgcaaaagatgggtgatttctgcatttccaactgaggtacctggttcatctcattggaactggttggacagtgggtgcagcccacagagggtgagctgaagcagggcagggcatcgcctcacctgggaagcacaagaggtcaggggatttccctttcctagctaagggaagccatgacagactgtacctggaaaattgggactctctcacccaaatactgtgcttttcaaatggtcttagcaaacagcacaccaggagattatatcctgtgcctggcttggtgggtcgcttgcccacggagccttgctcactgctagtgcagcagtctgagatccacctgcaaggtagcagcctggcagggggaggtgcgtccaccattgctgaggcttgagtaggtaaacaaagcagccaggaagctcaaactgggtggagcccactgcaggtcagcaagacctgctgctcctgtaaactccacctctaggggcagggcatagctgaacaaaaggcagcagaaacttctgtaggcttaaacgcgcctctctgacagctctgaagagagcagtgcttctcccagcacagtgtttgagctctgagaatggacagactgcctccttaagtgagtccctgacccctgtgtagcctaaatgggagacaccacctggtaagggccgactgacacctcatacaggtgggtgcccctctgggatgaagcttccagaggaaggatcaggcagaaatatttgctgctctgcaatatttgctcttctgcagcctgcgttggtgatacccaggcaaacagtgtttggagtcgatgtccagcaaactccaacagacctgcagctgagggaccttactgttagaaggaaaactaacaaacagaaaggaatagcatcaacatcaacaaaaaggacatccacaccaaaaccccatctctaggtcaccaacatcaaagaccaaaggtagataaaaccacaaagatggggagaaatcagagcagaaaagctgaaaattctaaaaaccacagcacctcttgtcctctaaaggattgcagcttctcaccagcaatggaacaaagctggatggagaatgactttgatgagctgacagaagtaggcttcagaacatgggtaataacaaacttctccgagctaaaggaagatgttcgaacccatcacaaggaagcaaaaaaccttgaaaagagattagatgaatgactaactagaataaacgcgtagagaagaccttaaatgacctgatggagctgaaatccatggcacaagaactacgtgatgcatgcaaaagcttcaatagctgattcaatcaagtggaagaaagggtatcagtgattgaagatcaaataaatgaaataaagtgggaagagaagtttagagaaaaaggagtaaaaggaaacaaacaaaacctccaagaaatatgggaatatgtgaaaagaccaaatctatgtttgattggtgtacatgaaagtgatggggagaatggaaccaagtaggaaaacactcttcaggatattatccaagagaacttccccaacctagcaagggaggccaacatttaaactcaggaaatacagagaacaccacaaagatacacctcgagaagagcaaccccaagacacataattgtcagattcaccaaggttgaaatgaaggaaaaaatgttaagggcagccagagagaaaggtctggttacccacaaaggaaagcccatcagattaacagtggatctcttggcagaaactctacaagccagaagagagtgggggccaatattcaacattcttaaagaaaataatttgcaacccagaatttcatatccagccaacctaagcttcataagtgaaggacaaataaaattctttacagacaagcaaatgctgagagattttgtcaccatcaggcctgccttacaagagctcctgaaggaagcactaaacatggaaaggaacaaccagtaccagccactgcaaaaacaggccaaattgtaaagactgtcgatgctaggaagaaatggcatcagctaacaggcaaaatagtcagctaacatcaaaatgacaggatcaaattcacacagaacaatattaaccttaaatgtaaatgggctaaatgctccaattaaaagatacagactggcaaattcgttaaagagtcaagacccatcagtgtgccgtattcaggagacccatctcacgtgcagagacacacataggctcaaaataaagggatggagggagatctacgaagcaaatcgaaagcaaaaaaaagcaggggttgcaattctagtctctgataaaacagactttaaaccaacaaagatcaaaagagacaaagaaggccattacataatggtaaagggatcaattcaacaacaagtgctaactatcctaaatatatatgcacccaatacaggagcacccagattcaaaaagcaagtccttagagacctacaaagaaacttagactcccacaagtaataatggaagactttaacaccccactgtcaatattagacagatcaatgagacagaaggttaacaaggatatccaggacttaaactcagctctgcaacaagcggacctaatagatatctacagaactctccaccccaaatcaacagaatatacattcttctcagcaccacatcacacttattccaaaattgaccacatacgtggaagtaaagcactcctcaacaaatgtaaaagaacagaaatcacaacaagctgtctctcagaccacagtgcaatcaaattagaactcaagattaaaaaactcactcaaaactgcaccactacatggaaactgaaaacctgctcctaaatgactactgggtaaataacaaaatgatggcagaattaaagatgttctttgaaaccaatgagaaaaaagacacaacgtaccagaatctctggaacaagtttaaagcatgtgtagagggaaattgatagccctaaatgcccacaagagaaagcaggaaatatctaaaattgacaccctaacatcacaattaaaagaactagagaagcaaaagcaaacatattccaaagctagccgaaggcaataaataattaagatcagagcagaactaaaacagaatagagacacaaaaagcccttcaaaaaatcaatgaatccaggagctgttttttttgaaaagatcaacaaattgatagactactagcaagactaataaagaagaaaagagagaagaatcaaatagacacaataaaaaatgataaagaggatatcaccattgatcccacaaaaaaaaaaactaccatcagagaatactataaacacctctacgcaaataaactagaaaatctagaagaaatggataaattcctggacacatacaccctcccaagactaacaggaagaacttgaatctctgaataaaccaataacaggctctgaaattgaggcaataattaatatcctacctaccaaaaaagtccaggaacagagggattcacagccgaattctaccagaggtacaaagaggagctggtaccattccttctgaaactgttccaatcaagaaaaagagggaatcctccctaactcattttatgtggccagcatcatcctgataccaaagcctggcagagacacaatgaaaaaagagaattttagaccaatatccctgatgaacatcgatgcaaaaatcctcaataaaatactggcaaaccaaatccagcaccacatcaaaaagcttatccaccatgaacaagtgggcttcatccctgggatgcaaggctggttcaacatatgcaaatcaataaatgtaatccagcataaacagaaccaaagacaaaaaccatatgattatctcagtagatgcagaaaaggcctttgacaaaattcaatagcccttcatgctaaaaactctcaataaattaggtattgatgggatgtatctcaaaataataagagctatttatgacaaacccacatccaatatcatactgaatgggcaaaaactggaagcattccctttgaaaactggcacaagacagggatgccctctctcaccactcctattcaacatagtgttggaagttctggccagggcaatcaggcaagggaaagcaataacgggtattcaattaggaaaagaggaagtcaaattgtccctgtttgcagatgacatgactgtatatttagaaaaccccatcatctcagcctaaaatctcctttaactgataagcaacttcagcaaagtctcaggatacaaaattgatgtgcaaaaatcagaagcattcctatacatcaataacagacaaacagagagccaaatcatgagtgaactcccgttcacagttgctacaaagagaattaaaatccctaggaatccaactaccggggatgtgaaaaacctcttcaaggaggactagaagccattgctcaatgaaataaaagaggacgtaaacaaatggaagaatgttccatgctcatggataggaagaatcaatattgtgaaaatggccataccgcccagggtaatttacagattcaatgccatccccatcaagctaccaatgactttcttcacagaattggaaaaaactactttaaagttcatatggaaccaagaaagagcccacatggccaagacaatcctaagccaaaagaacaaagctggaggcatcaaactacctgacttcaaactatactacaaggccacagtaaccaaaacagcatggtactggtagcaaaacagatatatagaccaaaggaaaagaacagaggcctcagaaatatcactacacatctgcaatcatctcatctgtgacatacctgacaaaaacaagaaattcggaaagggttccctatttaataaatggtgctgggaaaactggctcgccatatgtagaaagctgaaacgggatcctttccttacaccttatacaaaaattaattcaagatgaattaaagacttaaatgttagacctaagaccataaaaaccctagaagaaaacctaggcaataccattcagggcataggcatgggcgaggacttcatgactaaaacaccaaaagcaatggcaacaaaagccaaaatagacagatgtgatctaattaaactataagaaattctgcacaggaaaagaaactaccatcagagtgaacagacaacttacagaatgggagaaaatttttgcaatctacccatcttacaaagggctaatatccagaatctacaaagaactcaaacaaatttacaagaaaaagacaaacaaccccatccaaaagtggtcaaaggatatgaacagacacttctcaaaagaagacatttatgcagccaacagacacgtgaaaaaatgctcatcatcactggtcatcagagaaatgcaaatcaaaaccacaatgaaatatcatctcacaccagtcagaatggtgatcattaaaaagtcaggaaacaacagatgctggagaggatgtggaaaaataggaatgtttttacactgttggtgggggtgtaaactagttcaaccattgtggaagacagtgtggcaattcctcaaggatctagaactagaaataccatttgacccagccagcccattactggatatataccgaaaggagtataaatcatgctactataaagacacatgcacacatgtgtttattgtggcactattcacagtagcaaggacttggaaccagcgcacatgtccatcaatgatagactggattaagaaaatgtggcacatatacaccatggaatactatgcagccataaaaaaggatgagctcatgtcctttgcagggacatggatgaagctggaaaccatcattctgcacaaactgtcacaaggatagaaatccaaacactgcatgttctcactcataggtgggaattgaacaatgagaacacttggacactgggcagggaacatcacacaccggggcctgtcgtgggatggggggcaggggaagggataatattagaaggaatgcctaatgtaaatgacatgttagtgggtgcagcaaaccagcatggcacatgtatacctatgtaacaaacctgcactttgtgcaggtgtaccctagaacttaaagtataagaaaaaaaaagattgagaaattatactccatctcttgagggtggagtatctacataaattatttggaatgtttcctcatgagaaatttataatccccatttatttatttagtaatttttaataatttgtatcagtatggtattataattcaacagtacttaattttattgctcaaattgttccaactttgtccactaagctctttcatttggctcctgtatccctttgacatactcccattagtgtgtgtgtgtgtgtgtgtgtgtgtgtgtatgtgtgtgtaacatttttttgcattccagtactgcaagatgctccaggctcatcttatttatttcctgcctgagttctaggatcagccattccccccaaggagctttggtcccttttattggaaaatggtattaaaaaccaaaatttggacactaggtatgcttatcactgctgcgatgtcattgcttctaagccctctcacctgaaaaatcaaggaaatatatgtgtgtatgtaatccctataaatacacatatctatgagtatttctatgtatatccaatctgtgtctgtattaagctaaacagaaatttatactgtctttaattttcttttcttttttatatatatatataatttattattattattattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacccttcccccctttctattccacaaaaccgccatcgtcatcatggcccgttctcaatgagctgttgggtacacctcccagacggggtggtggccgggcagaggggctcctcacttcccagtaggggcggctgggcagaggcacccctcacctcccagatggggcggctggccgggcggggggctgacccccccccacctccctcccggacggggcggccggccaggcagaggggctcctcacttcccagtaggggcggccgggcagaggcgcccctcacctcccggacggggcggctggccgggcggggggctgacccccccacctccctgccggacgaggtggctgccgggcggagacgctcctcacttcccagacggggtggctgctgggcggaggggcttctcacttctcagatggcgcggctgctgggcggaggggctcctcacttctcagacggggcggttgccaggcggaggggctcctcacttctcagacggggcggttgccaggcagagggtctcctcacttctcagacggggcggccgggcagagacgctcctcacatcccggacggggcggcagggcagaggtgctccccacatctcagacgatgggcggctgggcagagacgctcctcacttcccagatgggatggcggccgggaagaggcgctcctcacttcctagatgggatggcggccgggcagagacgctcctcacttcccagacggggtggcggccgggcagaggctgcaatctcggcactttgggaggccaaggcaggctgctgggaggtgaaggttgtagcgagccgagatcacgccactgcactccagcctgggcaccattgagcactgagtgaacgagactccgtctgcaatcccggcaccttgggaggccgaggctggcggatcactcgcggttaggagctggagaccagcccagccaacacagcgaaaccccgtctccaccaaaaaaatacgaaaaccagtcaggcgtggcggcacgcgcctgcaatcgcaggcagtcggcaggctgaggcaggagaatcaggcagcagtaccgtccagcttcagctcggcatcagagggagactgtggagagagggagagggagaccgtggggagagggagagggagaccgtggggagagggagcgggagagggggagggggagggggagggagagggagagggctaatgtctttaattttcatccactgttatatggatcattttagccttctccctgtgcttatctgtaatttcgcacttcagcagtgagaaacctggcatttgctatctgccatgcatttatttaattttttaattccagtatacatatacaatgctttaaacaactttatcaactagagtacagtgcttgcatatagttccttttgcctttagtgttacaggctccaaagttaattaggtcagcaactttttcttccactcccttcggtgcagttctgttatacttatatacatttatacatttgtaatatgattcaattattttgtcacagtctgcattccttcaaatgatttttttaaaaatttgcatgtattatggttcattctttgtgatctaaaattccattagttttgacaatgcataatatcatgtgttcaccatcacaatagtatcactgctctaaaaaaattccctgtttttcacctaataaactctcctcatagccccaaatccctgataactattgatctattaatcatttttatagttttgcctttcccataatatcatctaaatggaatcattctgtctgtaggcttttcatactgacttctttcatttagcaataggtgttaaagatcaatccatacctttttaatcgaattagatattaaaatgtatttacttcactgtttgtgactttagttgtgttggaattagtactaattgcaataatagaagcaagaaaagaacacaatactagtagatgaaagtgattcactgtgttgagagaggttaggaaaaatttcacagaagaggaagaaaaacctggattagactttctgttttaatggtattcattgtaaaggcagtgacacacacacacacacacacacacacacacacacacacacacacacacacagtctcgataccttaatggaaaaggtgtattcattttggtatatagattgcggtacacatacactgttagtaaaattttatgtttttaacttgctaatattactgaaacatttttcatgtttacatatactcttcacaattatagtcttgcatatgttttaagcatagtttttatttttataaaaattatacatgccagctgtggataattaagtaaatacaaaaaagtataaaaaataaagaaatgtataattctattactcatctgcaaaggcaacattttagtgtatctcctaccagactttaaatggtttttaaaattttgtgtatttttattttacctaacattataatattctgttatttaagactgttcacaatcataaatttaatggctgcataactgtaattatttggatattcccctatgctcatgtttttattccactattgtaaataatcgtgataatactgtaacaaacatctttgtaagtgagttttctttttgtttgttttttttttgagatggagtctcgctctgtcacccaggctggagtgcagtggcatgatctcggctcactgcaacctccgcctcctgggttcaagcgattctcctgcctcagcctctcaagaagctgggattacaggtgcccgccttcactcctggctaatttctgtatttttagtagagacagggttgtgccatattgtccaggctggtctcgaactcctgacctcaggggatctgccctccttggcctcccaaagtgctaggattacaggcatgagccactgtgcccagcctgtaaataaatattctgtatattttaattaattttctccaggaagactcctgcaaggaaaaataaatcccaaatcccatatcagttgtaatttcagctgtaagtgacaataattctcagctaaaaaagcttaaacagtaagaaatctattatatcatataaaaagaagcccaatgttagattcatgattgcttcattcactgatacagtgatgcaatcaggaatccttgtgttcttctttaagctctttcatcctcaggattttggttttggttgcaggcttagaccctcattgctgcaatatggttgctgtggtttcaggtatcataccattacccaaatgccaccaggagagatgagggcaagtcaccagatactgacccaccatggtgagggctttggattttctttctgcttgataaacttccgttagccattcttttacagcagttctgctagtgaaaaattcttagttttccttcctctgagaatgtctttatttcatcttcatttctgaagaacattttaactggatatagggttctggattgagacttcttttatttcctcttgaaaaaattttgtgccacttccccatggtttctaatgagaaatcctttgttattctaagaatttttcaagtataaagtatcatttttctttgactgcttttaagctttttcttagtgtttagttttcaaaatctgattataatgtgtttgagcctggactgtttttttagtttattgtgttagagatttgctcaacttcttgaatctgcagtttatgcctcttgttaaatttagggagattttagctattatttccgcaaatattttttcagccctgccctctttcttctgtccttctgggactcagagagcacaaatgttatatttttttatcattcagtaggtttttgaggctcttttcattttttttcaatctttattcccctgttttcagattgaataatttttattgatatatcttcaaattcacggatttttaactctgtcatattcattttgctcttcagtcaataggcgagtgttaaatttcattcaattttttttatttctaaaatttccattttggtcttcctgatatcttatgtttctttgctgagactttgtatttcttcatttgtttcaagagaattcaaaatcacttgttgaaacattttatgatggctgcttcaaaatccttgtcagataatttcaacatctgtcttttctcagtgtaggtgtcttttgattgctttttctcattcagattgagattttcatggtttttgccataatgggtaattttatattgtatcctgaacattatgaatactaagtataagactctggtttctatttaaatcttctattttagcaaggattcaacctgtttatataaagaatatacatcctagcctacttttgtgggctgtgattcaaatgccaatttagatttcaaagcctttgcagtgttgttctggtctgccccagttgtgtgcttcccagagaccaacttgaattctgggcagtgtttcagaagagtgttcaattttcaaaccttttgctatgttgtttctggggctacatgcatggacttctaagaagttttctcaagatttcaacagctcctttctttcattggaaggaggagtaacaccatttctttattgtatggcagagatagaagataaggctctgcccacagtctccaggctgcagcatctggtgaggaagggaaggtgtatggctgcattgtttttctcttggtgttcaactggaatagagcaggtatggttaaaatatttatgtcctgctggacttctttttcctccatcttctggctagggctttttgtccttttgggatctgtgtgtgtgtgtgtgcgcgcgtgtgtatgtgtgtgtgtgtgtggttgctggtgttttaggttgtgttcctctccaagactaggatacgtaagaggtaaacaaaacaaaacaaagactaggagattcatagctatgccattcttcaagtcctggggaccctaatctgtctgctttctttcctccagttttgtcttcttttacttacgttatgaatattgtccaggattggtttgttttgtaaatagtgggaggaataggatgaatgaaatgtgtttactttatcttgttctgactgaaagctcaggactttggattctttgggcaatgggatacatttggatgtttttgagtaagggagggacatcatctgagttacattttagaaatatgctgcctgttgtttagggaactcactggagcagtggtacatgtggggaggatggtgcattgaactagagactggagaaatgtgagggatttgcagaatttttacagaatttgctgataagagaaagaggaatcagtttttccaagtttttttgtcttgagaaactgagggaatgattgtatcatttattgagatagcaaattccagggaagaagcagagttgggattagacatgcaaatcgagagtccaaattttagatgtgtccagctcaagatgcttgctaggtacccaaacggagatattgagtgggcagttggctattcaagtcaagaatttaggggagagatcagggctgcttatgtataagtttgtaaaccatgagtcagaagatgatatttaaaaccaaaagaatggttagattacttaggagtgagtgtaaacacaaatgagaaaaggtctaaaacactgagccctgcatctccctaacatagtatcttcattgacacctcagtggagtttgacgtagctcattatttgcttgttctaaaatatcctttctcctcatttcagtgacatcacctgctctctaggtttttctccagttttttaggatgtcccttcttcttcttattggcaggtcttctccctgccctcctgacctatcccttaaaaattgttttatttggggccgggcacagtggctcatgcctgtaatctcagcactttgggaggctgaggcgggcagatcacgaggtcaggagttcgagaaaagcctggccaacatggtgaaaccccgtctctactaaaaatacaaaaattagccaggtgtggtggcgtgtacctgtaatctcagctgaagcagaagaattgcttgaatccaggaggcagaggttacagtgagccaagatcataatactaccttaaggcctgggtgacagagtaagactctatctcagaaaaaaaaaaaagttttattttgttttgttttgctttttctcctatggactgtagtctctaaatgccattttccactggggcttaccaaaatggctgattccaggtctgaggcaggaaatatatgtaatacaaaccaggtttatctttcatgctaataaataggaaagctactgatgaccactggggttatgtcaaagggacacagggtccagctggaaagagctcttattgcatagacttgggacaagttgaacatcaaaaataataataattacaatgggttaaaacacatcaggtatattgaaatctatgtgttgatgatagtaccaaaaaaggtcacttttcaaggatgctaggaaatcaactcattctgaaaattggtaaataaaaggaaagagtcaagtatttgttttgtctttcatatgagaactgtacctcagggtacttaaagatttaatgtagtaaaattcttctttgtggaaaaattccagctaataaatgtggagggaataatagaatatcaccattttgcaaactctaatgaaataatggattcaggcaatgataataaatggctgattaaagatcaagttgactacatctgaatccactgattaatttagtattgtaaaaagaaagacaagacattctgtgtctcctgataggcactagccacatgtggctgttgagcatctgaaatgtggctatcgaactcatgtgctataagtgtaaaataaacactagatttttaagacttgatttgaaaaaagcaaatgtcccattaatgttttaaaatttgattaactgttgaaatgttaaaatttggatatattgggatgaataaaatatgtaattaaaattattttcacctgttttgttttacctttttaagatgtggcttttagaaaatttaaaattgtatacatggtttggattgtatttctgatttgttcacaatggaatcttcagtggccaatacagagcttgacacagttgtataaatgaatgaagttgctaatagttaaaattatttcattatttatttatgtgatttcatctactagaaactcagccccaaactgggaggagcagtggggaatgagagtggtggaaagtgtatcagattatggcgagattttagagaaaagcagtaggtatgtgcctgtagatgttctgtagtgggtgaagactgtaaaaattcttggtattgtattagttcattcccacactgctgtaaagaactacctgagaatgggtaatttatgaagaaaagaggtttacttgactcacagtacggcagacttaatcagaagcataactgggaggcctcaggaaacttacaatcatgttggaaggtgaaggggaagcaggcatgtcttaccatggcacagcaggagagagagagagagagagagaagggggaaatgccacacactttcaaaccatcagatctcgtaagaacacactcactatcataagaacagcaaaggggaaatctgcccccatgatccaatcgtgtcccactaggttcttccccttgcatgtggggattacaatttgacatgagatttgggcagggcacatgagccaaaccatatcatgtataaaataggtctgtctcaactctctttccccaacttccactctagtttatctctctacctttcttacttttctcactttttcttcacatcctgtaatcttttgtggttttttttgttttgttttcttttttcagtttaaaaatctattgagccattgactaagaataaaacatataacttgaaataaaaagaagccttataactaaaagaggtcgtggaattttaggtaatttttcttaacctattcctctttgttttggttcattctggctgctatacgaaactatcatggatggggtggcttataagcaacggacatttatttctcacaattctagagtctggaaaatcctagatcaaagtgccaacagagtccatgtctggagagcacccacttcctggtttatagacaaccatcttcttgtgtcctcacatggtggaaggggcaagagagctctccggggtctctttttaagagcacaaccccatttatgaaggctctgccctcatgacctaatcatctctcaaaagccccactgtctaatcacattaggagttaggatttcaacatatgaatttgacagggacacattcagtctatagcactctccttcccccaaattaagaggctggcgattatgttttttcctggtgctcattttgtaataaatgctataattggccaaattagattatgaatgcatttaatgacactacctaccctttcatacctacgtgtcatctaaggcctattaaaagactttttaacccccaatacttgaaaacttccctttgtttattggtaatatgagaaatatatgatatcatgattgtagcattaaacatgttttagggtgattaaaaaatagatataagtaatactctcagggggtggaggtggaagccacaaaatggtttgagaaagaagccaaagggtgaggagtgtgtgagtgaatcatctatcactgaacctgcacattctcacgttcagtaaatattaatccacctcttatgagtcttatggtgtgattttattaatgatttgaaaagtttagaattcatgacatagaatgtagattttcacatacaaatatgaaactatattacaaaaaattttgcaatacccattctttcagcctcctttagaacttagaactttccctttcctttcttacctggtaattctcccaagctttgctaggaaaccagctggatagttagttgaccctcaaatgttgatgagtatattacttattcaagaaactaatttttattttaacaggagtatttaaacacagttgtttcccgtgaaacaacacattaatactgaattattgttggtgagaggggtatttttggactgccttaagtttcgcccacaatatttaaaggcactggtgtttggactgtcccaagtctactgccccaggcttggctttatctgattaggccaggttcatatgcaagaaaacaactatatctgcacaaagaaaatggggtcctgagtctaaacattataatgagctctgtcacagcaactatgtatgagtagagtatcctggttctgagatctaacagtctggatctgaatctggggcacattacttactgtttgtgtgacattgggcaaattacttgtctcttctatataactgataaaatgttaacatctgtctcaaaagattattgttgaaattcaatgcgttaatgtctatcaagtgcttagaatagttcctggcccttagtaaatgtttagtatcagctattattatatgagatataccaatagaatatgtttggattgctcatgtggatagcctcaggtctaattcatttatttgttcctgccacgttacggtcaatttagaagcagtttaaaacttgactcacgttaggtattattcacataatgaatgttggttaacagttatagttttccaaattatgcttatgaaattgaaattctggacagggtatccgggttacaataatataaaggtattataaatagttcaaaataatctacttctagggacacattttggcatgaatttcccagtgaattttagaactaaatgtatgaaatcacattacatgaaaaaagtgaccctcaatatttctgaaataaaaatgattatgaataaattaaaataaaacattcattgtgcacaatcatcctttatatgagtcaaaatatttagtattgttccaccttctatagtttcttgcctcatacatagctgggttactagatatgaatttaagtacatgagtcaggactcttttggttgccagaaaccaaaacacaagtcaaaatggcttaattcaaagagaaattatttatttactcgtgcaactcagaaatccaagggactgacttcaggtatggttgtagtagtctttcaattcttctttcctctatatagaattcatactgaagtagattatcctcaggttatgattacagcatatttagacttacattctcatgcctaaaaaaaatcacagctaaaagttctgaaagttcactgaaatgatttactttcaacagactgacctacctcacatacctatctttgaaaattcactttggccggtggatagattggctgatttcagtcctagggtgttttgtctttggagtaggagagggtgagatggtgggggtcgtgcagaggggtgtttatccaaggtaaaatcagggtcttgctatcagaaaagggagtactgggcaggcaaacccaatagatgctgcagaggtggtagatccctggcacttttccatcgttgcttccttctgcatccttggaagacatcctaaattgatcatggtactctttacaaatcagcagacttacccttggaatcattttcaagatgatacttcaagcagttctaacctgtggatataaactgacactcttattgaaatctatttgccagacctagtttagacaaaaaaaagaaccaggctataagtcttaatatttgatttaatgggcttgtatctcctgccttaggctgggtttcctagacaaagaccctgaaatgaagatttgagtgcagtacgtttattgggagtaatcttgggaagcaggattgggaataaggaatcccattgaaagtgccagaactgggcttgccctttagagttgtctcaaactgaggcaaggggccaaggcttttatccatgttggccacctttgtgtgcaggctgtcatcagggagggggtggaatcttgggagaggcagctgcccttgtcacaggtgatcccgtatggagggacacactgtgagccgccagcagtcaatactgcaggcagttggggttctaagcacagctgactagtagagatgaatgagactagttacatggatttaagaataattataaattttcagtgtttttttttttttttttttttttgagacggagtctcgctctgtcccccaggctggagtgcagtggcgcgatctaggctcaccgcaggctccgcctcccgagttcacgccattctcctgcctcagcctccccagtagctgcaactacaggcgcccgccaacacgccccgctaattttttgtatttttagtagagacggggtttcaccgtgttagccaggatggtctgtatctcctgacctcgtgatccgcccgtctcagcctcccaaaatgctgggattacaggcgtgagccaccgagccctgccgattttcagtgttttaatgaagatattatttgcctcaataactactgactttttgttttattttcgtttaacccaattccttgggtattgtttttaaacatgcaatttgaatagagatgactttgtcagcaaatcctcttaagtatgttccgacaaatggtaacgttagatactctgtaggcacctttcctttgaggaattaagagttatcaatctctgtaaaaagattgttcaagactgaatagacaatgtgtacaagtactatgtaatagcaatattgaaggtaatcagaattactgggttagaaggacagaattaggcatttttgacaagaaagcagtagaattttacacaagaaaggataagaacaataagagaaaggttaaaaaaagaaaagaaagaagcaagataagtgggattgctaaagtctaattgtgtagggagtggcatgacacatagtcaagggctgctataaatgtaacacaaatttttgaacgacataagcaaggttcattaatatcataaatctaaaaagccagttaggactttagccatcagggagtgatagctgtaagacagatgaaaatatttaaaggattcctcccaaaacattcctagtaagtctcagagcaagattttgtttgaataaggaccagcaaaactccacagctcattactatcaacaaacacaattttgtgttaagagaaaatggctataagttaaagagcatttgtaaattataataaaaaatacatgataagtttaaaaacagaagcatctgggagcatcgatgacaagtttgataaactctgatggaataaacaaaatagtaacttacagtagcatttagagttatacattttagactattagggctggaaatggccccagagatcaaccagttcaactctgttggttttttggttgaagagagggagaaaacaggtctagagatgttagatgacttacttaaggtcactcagctagcgggaaagcctggacaaggaaactgatcacagtatatctagtgtaagctcagtgcttgtcactgtgcactgtataaaagcaaaagtgtgtgctacctttcctgtcctcgaggagcctgaaatcaagcttgatctttgccagacaaacatatatattcatctctgggtatgtgtctcaaaaattgaaggaatggcaaatgtgggtgtaggacagttatgaaattacctgtagcctctttttttttttttttttttttttttaggcttaatgtgttttcatagtaaacttacaggaacagcacagaagacagacaacattaaaaacatgtacttgcatgtagtacaactcagaaacatttggtgaatggattaaatctactgtatgataaaaatgctacaaacaccatttagttgcagtcagtaggaaatttacttgttttttaaagaatccaaatgctggcattgtccagaaaaacttaacacgtttatttataattattataaagttgaaccactgacacctgttcactgaaacgttttgacttgcattaacgctttgtgtttccgcataatattaaaaattcacatacgaatgaaaatggaaaaactgccaatccctgatttctattccctatttttccactcgcaatcataaatttaggtaccttcagaccccatggggccgggggagggggcgggcggggagaaatctaacattaagaactaccaataataacaggaagaagataatttttttttagaatgaaatgtttcccatcatagtggatttttaagcacgttctccatgtgctagcatgtgtgcggcatgctagctggatgtcttttggcataattgttacacgtttggcatggatagcacacaggtgggtgtcttcaaaaaggccaaccagttaggccttaattgcctcctgtaaagcaccaatagctgcactctggaagcacagatctgttttaaaatcctgagcaatttctcacaccagacgctggaagggaagtttgcgaatcgtgcctcactacgaggcctgtaacaatgaagcttattcgcccgtccagtagagggcgcactcttgcaaaaggcttttgtagccagttgcttcccgggtgctttaccacccgtggatttgcgtgcagtccgctttgcaggcaccacggtatgaagacctccttgcttaacccccttcttcggctggagctcagccaagcgagaggcggcgctagcattagagggcgacggcggcccggcggcgtcatctgtagtgagtgtagaaagtgttatttacaaactctgaactgggcacaggaataaaatttgattaccccaaaagttttgggaattgatgggtatacttggaattttgaatgtttaaatatgttttttcctttctttctggattctcagaactcagaatccacccaaaaccagtctcccaaattggaattttcaatgtggctcttgcttgagaaacataatgccttagagctatcttaatgcttgttcatggtcagtgaattttttaagtgagaatgtgggaggaagtatcatctagaaatatacctgaggaaagagaagaggtctttggtttgtgaaagaaaaaagtcagtactttatttgaatttcttgcatatgagaaaatattaagtgctttgaaaatctgttttttaaagtttattcattcatttatttataaatatttattaaggcagacatttttctagatgtcaagaacacagcagtgaaccaaacagatatcagtatcttccctcagtgggcttatattccagttggggtgagagacacaataaacaaataaagaagttaaacatatagtatgtcggatggtaacaagtgctatgtagtgaaggggatcagggctttggagcagagattgctatttaaaattgtgcatgagggcagttcatcttcacgagaagatgacatttaaagacaactaaaagaggtggggaggcaagctgtgtagctctctgggggagacagcgtcgctggaggaagagtgctgccggcagaggaacagcaagttcaaagctccgaacggagcatgcttcaagtgtttgaaggggccagtgcaggcggtgcagaatgagcaggagataacatcagaggaaaatgaagcatcatattatgtaggaccttgaaagttatgtaaggactctggctttcactttttttttctttcttttttttttttcttgagacagaatttcactcttgtcgcccaggctgaagtgcagtggtgcaatctcggttcactgcaacctccgcctcctgggttaaagcgattctcctgcctcagcctcctgagttggcttttactttgattgagatagtaaatcgttggagttttgatctaaaaaaaatcactggagaggaatgatgtgggctgatctttatatgaaaaagaatactgtgggctgctgtgttgacaatatcctgtcccggtctgggtcagaaacaggagaccagctcggaggctactacagtaagataagagctaacagtggcttgaagccagctggtagcaattgagatggcgagaagctgtcagagacctggacatactctgtaaatagagctgacctgttttgttaatggattagatgagagaagtgagaaagggagaggagcccaggatggttctaagatttttgtcttgaacaattgtaagattggagttgccgcttgctgagatgggggcactgggaggagcagtttgggaaggtggaaggctagaaatgtggtttgcaaatttggctttgctttgtcttgcactcaacaatgttgaaaaccaaatttctcttgccttgctttgcgattaaaagtaattgcaagaaccacagttacttttgcaccaacctacctaatatttgttcttagtgtggcttgcgatttgctgtgtgtgtgactatgtgaaaaaacaacaatcttaacaacttgaaataaactaacttcatatcagaggcttttatttgttatttattcttttccatttgatttttaaagggatatttactctggatataaaattctgagttgacagaattcccccaacacccccctgccatgctcatgagtactttaaagacattttcattgtagaagcttttattttattttgtttttctggatagtgcaataaaagatttgggatttacaatatttagtatttacatttaaaaggaaagatttatattttatgcaaatcaaggtcttttttaaaaaagcccagaatgtggccgggtgcagtggctcgcgcctgtaatcccagcactctgggaggccaaggcaggcggatcacgaggtcaggagatcgagaccatcctggctaacacagtgaaaccccgtctctactaaaaaatacaaaaaagtagctgggcctagtggcgggcacctgtagtcccagctactcgggaggctaggcaggagaatggcgtgaacctgggaggcggagcttgcagtgagctgagatcgcgccactgcactccagcttgggcaacaaagcgagacatcctctcaaaaaaaaaaaaaagaaaagaaaaaagaaaagaaagcccagaatgccaggaaaacttttaaaatgtacagttattaatggtaagatagaaaaaatagaatcagtcaaatgtcaaagggtttaatgataaattaatttttattgtatgattttaaagtaaatcccaggtagtaaatcttttcactcctaaatacttctgtgaaaatgtttatgtctgaagaacatgttttattcacttatttatctagctacagtttttagttgctatccatgtactaccacttagaaggctttatctgtctacaatgtaggtaaaagagattcttaaagcaactcttaagagttgctctaagtcaggggtcccctgactcccaggccacagactggtatacccactcctctccaccttccctgccctggccatcatgcatggaataattgtcttccacgaaaccagttcctggtgccaaaaaggttggggaccacggctctaagtgacagcaataaaattacataaaaattcttcagtgaggttacactatacatattaaaataaaacatttcctcattcagtcttctgtgaagtacttgagttttataggaatatttgtgtaaatataagttatatacatctttgaaaaagtatggcttttgcacaactaattgaaatgcagctcagcctatgtctgcaaatgaactgaactgggagatttaaaatattttaatattctgtttaagaaagcaataaattttaagtgatccaaagagaagtttctagatgagagatatttttaaaatatttaagtggaaatgaatttttagctattatacaactttggaaaattaagagattactaaaaaatattttgcctaatagattgattagtatatatttatctttcagctgcctacacagttcagttgcgcagattatcatcacatttttaaggcctataagagaaatttgttttagccaagaatattccaaaagatattgaaagaagggcattgatttcagctattctcagatacttcaaactgatctttgtggtacatcaaggatttattttggaaaggacatcataggcttgcaggtctggaagtgcccataagggttcatctagttcatcatgtcagtccaaggattattaaaattgccagatgcaaaaccagctataataggctgattttccaacctgtgaactctggataactcttctaaaggcagaatctccttttcaaagatattaaaaatagggttcttcctcatttcacttttgctgagtccccaacagtggtggtgtgttttaaagggtctcctcacaatactttaaacccttaaaagagtttagaacttaaacttcaaataatcttctctttgtcaaggtcttttggtgttcttcaaataatagtcctttgtttaaagaaaatcagacttaaacttgtgcattaagtgattaaagtaaaagctcattattatgttttccctgttacttcacctctgatctttcaactatgacctctgcttttgatccatttccaaagtattaaaatataactattataaagaactagcctctgtaatagcacaatcaccaacatgtcctttggctatttccgattattcaggccttgttcttcagttttgagactacctagtatttttttggttcacttcgtatcagtgattacccaactttctctctcaagggactctttcagcgtctaattactctgaatgttaaaatcattaaaacattaaaaacattctgatttttacaactatgcttataaaagaaaataagcaaaaaaaagaaaaaactgggtagaggataagtgattatttccaaaatattcttgaatattgttgcaatgtcaacagtcacaaataagtatatatacataaatctacataaaatactacaatggattaaaaatagcaagcatgttaaaatctcaatgattttaaaaagcatactcattagtcactcttgataacaaagttactgttctgaaaactgatccaaaaagataaataatgttaaaaaatctatttctcaaatttgagaagtttgaaaatgctttctgtcaatttccaccaaataccaaaaaagctcctttccttcatcctcagcattccacgtgttttatatatgccacaattgtagtgtgctggggttctagggtcttataagatcaattttggaacatttagggacttattaataaatattattattagtaatgtatttcaataaaacattagtggtgctacttttaaatgaaaacatgaaattttttttcaaaggctatgtatctatggattaaaaaaagtagggccaaatgtggaagagtaaggatttcattggtgttttcttccagtgctcactagaccctcaaaaggtctttttcattccttgaagcctggtcccatctcaaaatatcttaaaaacgccttagcgtcttatggaggaatgcattttagcttaaatttgcaacaaactcttagacattaaattactagagctttggactatgcacttccatggcaccagggcattgctatacatttttgtttgtttgtttgtttgtttgtttttgtaaatgggtgatgttgacacctcctattccaaatcaaatctacattaggatgattcctgatccaggacgtgtctctatcctaatctacctagctgcctatacttcctcttactgttctccttgctggttttggctcttatctcagcaggaattctatggcaaacttcttctagaacacacttcttctttaaaaaggaaaagacaagctcctactctacttttgcccttccttgactgtaaacacattcacttacattcaacaagcatatgcatttaaaatatttatgtctgcaaactttcagatgtagctaaaatactcctgtcttcaaggagtcttcatctatccttacatggagttaactgctccattctcttgtacagtcgtggaacttgatttataactgtattacagcatttactgtgctctttagtcacttattcactttatggtatagatctcattggatgtgagctgttcaagagcagaggtcgtgtcttatttatctttctctttagcatagtcctgaccccttggtaaatattcaataaacatttgtcgaaagaataaaagaattaatgaatggataaataaataaatggccttgtatgctttggttgcctctctgccaaataatttcttacttgttgttatggcatttttgtgtgcttgttttcatggatactatgcttttacatttattacgtaaaaatttggtctttaaataagtagccctaattcttaatttccctttaaattctacttaaataacccatgctttagtaaagcactataggaactaattttatgtttgtctacactagaaaatcctgactgaattgccacaaaaaggcaaaaattagggttggtcaaggaaatgaccaaatcatttagtttgttttattagagcttgccgtccacacaaacatttgatttctagtttatttgtagtagctttttccccctcttagtaaacatctggtaatcagaaggaaagcagcaatctcgtaagtaatataaatgtggaaatgttttccaccaacttgataggtggggagtctggggccaaatggtgatacttattttttgacaacctctactttattctgcctttccttccctactgtcctggctagtctttccttagccctcctttcccctcccacttcaaaggatctcattttggtttagtggatagtgtgggttgggaggtctagttctgtgagtcatagtttcctcatctttaaagagagataatagatccagatgcttatgaagatcaaatacataatgcataagaaaatcctctgtgaactccatgaaactacataaatctgaaggactgctatttttaatttattagaggcatcacctgtagagccagaattcggtaacttctatttgtatctttctgtgttcttatgacggtaactaatgcaataatctggtcttgttgtaataaggatgtgtttagggcatgcccttggggcattttagcaatagccacttgaagagggtgtctctttctctgttttctaaccctgaagagccaggcttacaggcatggaggacagtgggggtgacaatgactgtggagcagggaaggataggcagtgagggcacatggagacacaggtagaaagccacagaatacacctacaccctgagatggctctatggtcaaagtaccaaggcagtaattagacagttttcttttaaacaaaattaatgtatacagattaaaatggaaatttatgttgtaaaacagccatttaaaaggtttaaattattaggttagaaaaacatctcaaattaaaataagctttgttcatagaattcctaaccttacaattgaaaggagatgccttcagttgtaagtaggtaagttgaaagtagattacttttcaagactattcatggaaagccaagggtgaaatctaacatcctaagtgggttgcctactagaatatatactgtgctgtcttcacttttaggtgagaaactatatgattaaagaaagatgttaaagagacacatgatgcacacatgtgtgtacacactgcacacatacgtactcacatatataaggcacttgttaagagatatgggaatgattgaaattttatgttaattaagctcaacttttatgttcttccagatgatcttaattatttgtgtactataaaattaataatatttctattgtcaattttaaaacaaatattttggaagaaactaatttggggagattgcagaatatcatggaaaatatattccttaaacttcagtacactagacagttcaagaaaggtggaaaatagcaagatgataagagtgataaacacaaatagagaagcagagaaccccgatccttaatctttgctattttgtcaagaaattgtttctttatgtttagaaatgtcttctgggctagttcatgaatgttgtaagcattaatattttccaatacatttatttagctttactcttctcaaaaatgggtgctatataaagaatattagaaacaaatggtttgaataaaaggaagtggaaaagtgggaagaatcacttaaataaatgtcctgcctcctaggtgaggtcagggaaattttgcttattccagtgtcattctttaatgttatggcactgcagttcattgcctttttaaatcattttgcttctagactctaactctcaagtaatgaatggtcagtaattattcaccagtttattagtcactttttatccttagcattttgcttgatgcatagtaggtgctccattaatgaattttaaatgaatgaataaataatcttttatatacttataccaattttatgcacattgtgtcagtttttcttacctcactttgtatgtgtgattatcatcctacttttgaaatggtaaaattaattttgtgtttcttccaaggtatcctggtctgagatgggagttcagactaagatcagttcaaactaagcccagggtagattattgtttagtctcagaggaggcagacacatctgctggtggccatttcagccttcttcttctctccctccctacttgaaatcctgtcccttgcctcccatgacctctctgatctcaccttctaccagtatccctcttgctcactccactccagctacgctggcctcccagctgttactaaaacactccaggtatgctctggattagggtttatgtaagttccttatatggaagctgggcagatgggcaggagatagatcacagaggactctgaatgccataccaaggagtttgaattggtggtgtgcagcctattgaaggattgtaagcaggagaatgacagaatcagatcaattgtatttgcattttagaaatatcaccctgactgtgatgtagatgctagggagactgacggagaaagtgaaaggctgttgaaatggtccaggtaagagatgatgacagccagagctaaggcaaaaacagtgggaagtcaaaggaagtgacagtgacatattaactatctggaaggccctagaactttcaaagtagatgtttgaacttttaatattattattattctaatgagcatgtgaatcttggttctatttatccaaataggtaaataggaggaagacatattattgcattgaagtgactatgaaatttcagtaagtaaaaacccactaagtcattggatgcataggcctggatctatagattttggtagtcattaatccataaaggtagttgaagccatggatgtagggtgagatgtaggctgctgaaggaagaaccctacagaatcacaacatgttgggaataaaaaaagaagagatatatgtggttagaaaaagagaaggcataatccaagacgaagaaggagaaccagagggaatgggtctgtgaaagctaagagaggagagaatgtcaagggctcatacttgtagtatagtttgacgttgggtagcgtgatgcctccagctttgttctttttgcctaggattgttcttggctaggaaagcagctactggatttgacttgtgggagttcactggggcctttagggagagtagcattgctctactaacccaagtgtaaggaaattctcaagtcttgcctcagtgaccttgggctctttgagggaatggaagaacccagagtgacttgcataggatcacacagctgatttgtggcagagttgagctgaaatcccctctgcatttcctgttttgttatttgccttagaactaaattgttagatatttgaaaggactcaacaaaccaggcctaatagatttagtaataggacatgtccttgtttcctttcttcctcactcccactctgacccgaccatgtttgattcatctgtaaattctgttgactattcctccaaaaaaatatccttttaatcagttaactttctctacttccaccaccacaactcaattttctcttgcccatgttattgcagtagcctcctgacttgtctcaatgcttccactatgccccttctattgtccatcttctctttcatgatcagatcttgtcactatcttgcttaaacattccacaagatttcccataacacttagaatgaaacccaatctcttgaaaagccctacacggtcccaggtactgtaactgttgcccacattttggaccgtgccaccttccactttctgcctcattattgtaccaggtactatctttctttctatttcttaaacaaggcagtgcctttctgcctcgtggcctttgcacttctgtgtcctctacctgagtgttttttccccagattttcatttggccgctccttttcctcattcagctttcagattaaatgccatctgcatagagaggtcttccttctcatcctaatccctccatttggtcgtattaccacaaaatctgtagcacttatcactttttgaaattacattgcttatttgtttttgtattttactttattgtatttatttttttttccttcaacttttatttgaagttcaggggtacatgtgccagatgtgcaggtttattacataggcaaatgtgtgccatggtggtttgctgcacagatcatcccatcacttaggtattaagcccagcatccattagctattcttcctgatgctcttcctctcccaatgccccttccaagaggccccagtgtgtgttgttccccatcatgtgtccatgtgttttcatccttcagctatcacttgtaagtgagaatgtgcagtgtttgattttctgttcctgtgttagtttgctgaggataatggcttccaacttctgacaataggaacatgtcctatgttcctacaaaggacataatctcattccttttaatggctgcatagtattccatgggtatatgtaccacattttctttatccagtctatcattgataagcatttaggttgattccatgtctttgctattgtgaatagtgctgcagtgaacacacatgtgcatgtatctttatgatagaatgatttatatgcctttaggtatatacctagtaatgggattcctgggtcaaacgatatttctgcctttaggtttttgaggaatcaccacattgtcttccacagaactaatttacacttccaccaacagtataaaagcgttcctttttctctgcaaccttgtcagcatctgttgttttttgactttttagtaatagtcattctgattggactgagatggtatctcattgtggttttgatttgcatttctctgatgatcaatgatgtcaagctttttcttcttatgtttgttggctgcatgtatgtcttcttttgagaagtgtccattcatattctatgcccactttttaatggggttatttgtttctctcttgtaaatttgtttaagttacttgtacattctggatattagacatctattagatgtctataatgtagacataatagattatgtagacataatttgtcagatggatggattgcaaaaattttctcccattctataggttgtctactctgatgatagtttcttttgctgtacatctctttagtttaattagataccatttgtcaatttttgctgctgttgcaattgcttttgacattgtcatcatgaaatctttgcctgtgcctgtgtcctgaatggtatcacctagattttcttctatggtttttatagtattgggttttacactcaagtctttaatccatcttgagttaatttttgtataaggtgtaaggaacgggtacagtttcaattttctgcatatggctagccagttctcccaaccctatttattaaatagggaatctgttccccattgctagttttggtcagatttgttaaagatcagattgttgtaggtgagcagtcttatttctgagttctctattctcttccactggtctgtgtgtctgttcttgtagcagtaccatgctgttttggttattgtaggcttgtagtagtttgaagttgggtagcatgatgcctccagctttgttcttttttcttaggattgtttttggttattcaggctctcttttggttccatatgaattttaaaatagttttttccaattctgtgaagaatgtcaatcataattaatgggaatagtattgaatctataaactactttgggtagtatggctattttcatgatactgattcttcctatctatgagcatggaatgtagtttcatttgtttgtgtctcctctgacttctttgagcagtggtttgtagttctccttgaagaggtccatcactttccttgttagttgtattcataggtattttattcttttgcagcaattgtgaatgggacttcattcatgatttggctctctgcttgcctgttgttggtgtataggagtgctagaggtttttgcacattgattttgtatcctgagacttttctgaagttgtgtatcaacttaagaagcttttgggctgagacaatgaggttttctatttataggatcatgtcatctgcaaaaaagataatttgacttcctctctccctatttgaatccctttatttccatcttttgcctgattgccctggccagaacttccaatactacattgaacaggagtgctgagagagggcatccttgtcttgtgctagttttcaaggggactgcttccagcttttgcccattcagtatgatattggcttggttttgtcttttattttgaggtacatttcttcaatacctagtttattgagtttttaacatgaacggatgttgaattttatcaaatgcctttcctgtgtctattgagattatcatgtggtttttgtctttagttctgtttatgtgatgaattacatttattgatttgcttatgttgaaccaatcttgcatcccagggataaagccaacttgatcgtggtggataagctttttgaggtgctgctgggtttggtttgccagtaatttattgaggatttttgcatcgatattcctcaaggatattggcctgaagttttcttttgtttttgtatctctgccaggttttgctatcaggatgaggctggcctcttaaaatgagttagagaggagtccctctttttcaattttttttagactagtttcagtggaaatggtacccactcttctttgtacctctggtagaattcagctgtgaatctgtctggtcttgggctttttttggttggtaggctatttattactgcctcaatttcagaacttgttattggtctattcagggattcaatttcttcctggttcagttttaggagggtgtatgtgtgcaggaatttattcatttcttctaaattttctagtttatgtgcatagaggtgtttatagtattctctgatggctgtttgtatttctgtggagtcagtggtaataaccccttatcatttctgattgtgtttgtttgattcttctctgttttcttattagtctagctagtggtctattttttttaattttttaaaaaaaccagctcctggatttgttgaattttttgaagggtttttcgtgtctctctctcttttagttcagctctgatattggttatttcttgtcttctgctagcttgggagtttgttggctcttggttctctagctcttccagttgagatgttcggttgttaacttgagatctttctagctttctgatgtgggcatttagtactataaatttccctcttaacactgctttatctgtgtccctgagattctggtatgttgtctttttattatcattagtttcaaggaacttctttatttctgccttaatttcattatttacccaagagtcattcaggaacgggttgtttaatttccatgtagttgtgtggttttgtgcgaatttcttaatcttgaattttaatttgattgtgctgtgtgctgtggtctgagagactatttgttatgatttcaggttttttttttgcatttgctgaggagtgttttacttcaaatgatgtgatcaattttaaagtaagtgccatatggctatgagaagaatatatattctgttgtttctggatggagagttctgtagatgtctttcatgtccacttgatccagagctgagttcaggtcctgaatatctttgtgaattttctgtctcaatgatctaatattgacagaggggtgctgaagtctcccatcattcttgtgtaggattctaagtctttttgtaggtctctaagaatttgctttatgaatctgcatgctcctgtattgggtacatatatatttagagtagttagatcttcttgttgaattgaactctttatcattatgtaatgcccgtcttggtctttttgatttgttcgtttaaagtctgttctgtcagaaactatgattgcaactctggcttttttctgttttccatttgcttggcaaatttttctccatccctttatttcgagcctatgtgtgtctttggatgtgagatgggtctcttgaagacagcatactgatgggtcttggctctttatcagatttgccattctgtatcttctgattgttgaatttagcccattttacatttaaggtcagtattgttatgggtgaatttgatcctgtcatcatgatgctagctggttattttgcagacttgtttatgcgattgcttgtattgtcacaggtctgggtacttcaatgtgtttttgtagtggctggtagtgttttttcctctccatgtttagtgcttctttcaggaactcttgcaaggcaggcctagtggtgacaaattacctcagcatttgcttgcctgaaaaggatcttacttctccttcacttaagaagcttactttggctggatatgaaattctgtgctggaagttcttttctttaagaatattagggtgggcagtccaccatgaggtgagccactgcccattcacaaaaaaaaaaaagaaaaatgaatgttgagtattgtcccccagtctcttctgacttgtagggtttccactgagaagtcggctattagtctgagggactttcttttgtaggtgaactgacccttctctctggctgtccttaacaatttttcattcgtttcaaccttggagaatctgatgattatgtgtgttgggtttgatcttctcatggagtgtcttactggggttctctgcatttcctgaatttgaatgttggcctgtcttgctaggttggagaagttctcctggatggtatcatgatgtatgttttccaactttgttcgattctccccatctctttcaggtaccccaatcagttttaggtttggtctatttacataatcccatatttctcggaggttttttcattccttttcattcctttttctctattcttgtctgcctgtcttatttcaaaaagatagtcttcaagctctgagattctttcctctgcttgttctattctgctattgatacttgtgattgcattatgaagttctcatgttgtgtcttttggctccatcaggttggttatattcctctctaaactggttgtactggctttcagctcctatattgttttatcatgagtcttagtttctttgcattgggttaaaatatgctcctttagctctacaaagttcattattacccacctcctgaagcctactgcttctttcagttcagtcatctcagcctcagcctagttctgtgcccctgctggagaggtgttgtggtcatgtggaggaggagagacactttggctttttgagttttcagcgtttttgcattgattctttctcatctttatgggtttatttacctttgatatttgaggttgctgacctttgaatggagtttctgtgggttcttttttgttgatgttgatgttgttgttggtttctgtttgtttttcttttaacagtcaggctactcttccatagggctgctgtggtttgctgggagtctgttccaatcatagttgcctcggtttttcccattcccagaggtaccaccagtgaaggctgcaagacagcaaagatggcagccttctctttcctctggaagctctgtcccagggggcactgacctgttgccagcctgaacacacctataggaggtggctggagagccttcctgggaggtctcacctagtcagcaggaatgagatcagggacccacccaaagaagccatcttggctgccctttggtagagcaggtgcactgcattgaagggacccttcttcttcctgaccatttgtattctccagaggcagaaggctggaatggctgagtctaccaaaccacagagatggtagcttccactctccctgggagctttgtcccagggagagatcagagctctgtctgtagaacccttgctggagtggctgaagccacagggaggtctcgcccaatgaggaggaatggattggggtctcacttaaagaagcagtctggctacgatctggcaaggcaactatgctctgctgtgggggaccctttcttgtccagaccacccgtattcttcaaagctgacaggctgaaatgattaaatctaccaatccacagagatggcagctgcccctccccctggggaactcgatcccaattccagcagacttcagcctgctgctgtaggccggctggaattctaagccagtgggtctcaacccacaagccactgtggaagtggggcccacagagtgatgccatttggctccctggactcagcctccttcctagggacatgcatggacatatctcttgccttgccacagagcacagggctggaatatgcaaaattttgggttctctgtgtgtgcctgggtggccactctgccaactccacataactccatgtaacggacccaacgccctggtgacatgggctcatgaggtgatctcctgatctgcaagttgcaaagatctgtgggagaagtgaagtttcctgtgtggggtcccataatcactcacgcttcttttggctgggggtgagggttcccttggctctgtgccactcctgggtggggcatcacccagcactgcttctctttgctctccttgggttgagctgtttgcctcatcagtcccaatacgagaacccaggtatctcagctgaaggtgctgaattcacttgctcctttcattcctctctgtaagtgctgaggaccacagctgcttccaatcggctatcatcgtttcttctctgctgcttatttgtttcttcatgttagtcttgtttgtgagaccagggaccatatctatcttgttcaccttggtattcccagggcctagaatcatacttggattataaaataataacctacttttaaattctgtttgccccttttgtgacactgttctctgtaccctacagatgataacgcattgaatcatattattgctatgaggtaggcacaattcaaacctacatttatgaatgagaaaacctaggcactgagttaagtcattaaggcccttgcctaagccagtaagtgacaatgccaaacttcagcacccatcagaatcacctggggaccttgttaacacagaggttactggtcccccaccttggcatctctgttttggtagatctaagatgagttccgagaatttttacttctaactagttcccaaaagatgctgatgctgctgatctaaggaccaccctttgagacccaatgcaatagagttcacagagtattttccacattagttgtattaatactcacatccccataatcaattattatgcccattttatagatgaggaaactgaagcttggagaagttaattagctttcccatggccagagtgggaatgcgtagaaaagctgcttggacccaagtctcctggctctaagtcaagttctcttagccttgccctaagaggtctttatatggtactgaatttttcagaatgctgctccagtagataaattgtgaagtctttgtgaatttggcagataaacaaagcaacctcctgggaacaaaagaacttacgtcttctgtttcaacttaattgagtgatgaagatggtttctagataagctgacatgattgaaatttatttgtattgtaatttagacatgccataaatgtgatccaataaccttcccttgttattaccatattttagtcatatggtagcattgcaggtgaggtttatctagtcatactactattaaagaacctttcttgcaaaacgtaaggagaaattcaggagtatttattgaaaatttacagtatcttaatatttatcacttaattttctaattaacaaaacacttgttctaaaagcgtttttaaaaaacatctaacaaatgagacaattttcgctaaaatttctaaagaagttcttgaatttttttcttagctagcaattctatacaccatacacaatttacagtatcttaatatttatcacttaattttctaattaacaaaacacttgttctaacagagttttttaaaaaacacctaacaaatgagacaattttcactaaaatttctgaagaagtacttgagtttttttttcttagctagcaattctacacaccagagacttaaagctacaaaactttgttttctttaggttctttcaggcattaatattctgatgccatgttcttatgacagagactaataagaagagaaaatggcacaccctgaatctattttagtgatgaagataggagtgggaaatgggaaaaacctaccttgttctcattactaccatgctaaaactgtcatcaattataatcactcactgtattcctaacataagactgttggtaatttctcttcaacacaaactcagtctcctttaattcagtttgtacatgaaatatatatggaaatatattgatagtgcttacattgatggcattttcttcacttacaaaagcatgtgttgaaaagaagtgatgtcagtacataatagcaaagtttctgtaaggtggttatttctgttttatttcccatgatcttatggcaaagtagaaaatgtttcaatcatttaccttgacccatattttatagtcatagttatctatgcagcacgtttctcttgtgtttgcccagtgtgcaaagacatcagtactcttctccctacttttacccacggtcttatgtccacttttgttcagtatgacttgacgaatttgtttcttctgtagtttactagcttttcttccctttattctccctctctttcttctccctctctttctgtctttcttttttcaacaaataattattgggtccatgatattctagattcagaaagtaagacacttagagtcatgctagagaagaaaacatgaatgaattaaaaagtcccatggttcaagatgatatattacacaatgaagaagcaagaaaaaagtccacaaaggtgcaataagcatttgattggggtagagatccctgcagacttgagatttttaggatggctgcataaaaaacatttcaggtatctgttgctgcatactaaccacccaaaatatagtaacttaaaaccataaatacctattatttgtcttaatcctaccatctgggttgagctcagctgtcttctgcttcactggttgtctgctggtgttgggatggccatgatgaattcttcagtagcatgtctggcatctcctctaaatggccggaacaggtggcagctggctgggcttctctctcaccacaaaatctcctcagtagagtagcattacctctgcatggtagctcaaggctccatgagagagcatttcaagagggcataagccacagtgtgcaagtacttatcaagatttcacttgtattacccttgctcatgtcccattggccaaagcaagtcagtgtgggaggtatgatactggggggcatggctcactgggggccaccaatccaaacaaagcattttgagggcctgactgcatgtggggtatgaggaaagaagtcacatatggaggatttcggcttggatgactagaaaacttgtgggattattcattaggagagaaaaagttacatgtgggagctaattttagatgttaagtttgagaagatgaaaagttctactaagcagagaaaatatattggaacatgaatgtaagctgagggctgaagtactaaactttggagtcatgtgtagaaaataaatagttaaagccacgtgactgaatgtgttctgagaaagacagaaattctaccaacaaactgagctatgtttatagttagaagttgggaggaggaagagagcccaattaggagacaaagataccacacattcctcatattttgtgattctgttagaatttctaaatttctaggtgaatttggctctgatttatctgtgagtaggatttaattgagaaataattcagttttattttagcaacttctactgtggaacacttctagtgccttgagttactgacttttaaatgtgtatttattaataatagctaatatatttgagactttctcatggttctcaaagggtagaatcatagtatgaaaactaaagttatgatattgcttggcagaattaagttttactttgtttattaatctctctgcatgttgtcctgcttctggaaacatcaatgaaattgtaccaaagcttggtttcaatgatgagtcgattttcttcttatgaaaaggacttaatgttaaggctggatcaacccaagcacaggaaattaaaagttaagtgcagaaatattttcttggtatccactaacaaagtaaagtcagttttcaaaggtaattcatagttttctctgaacccattgcacacataaatgtgaactgctgattgaggaactgctttcacaaattctttgaggaggtgtcaggaagttttgtatttaaaaacttgtgtgagcactgtcttgtttcactgagctactcatgtaggccttacataggtcctctagttacatgacctgcccaattcaatgtgacactcaggcccaaactactgtgggcaggccataaggaccttttacacttcagccagagaggatagggtaaatcacagaaaccatttggaatatattatttttactcaatcttttgcttttagagaaaaatgcggaggttaagaattcagttcaaactgaaattaaatatgtcttgaattgttccatggcatcactgattttccctttctctttcacttttaaatcattttgtgactatcgtatggaaaacacctatacatacttgcttatctgaaagaatataatggccgtgctataaaatgtggttgtaatgttatatgtactgtttaacaattttattaagtatgttacttggttccctccactttagaaaattttaagggtgatacaggtatgtgttatataggcaacgtcttcattaatgtactacgttgtgacttaataaaaagagacaaggtttattgagtgcctgctatgccctgagtgctttacatgtaggattgtatttgatcctcacaacatccttatgagttaggtataaataataatctgcaaattattatccttaatttgcagattaggaaactgagaccgagagactttatgtaacctgtccaaggtaacatagctagtaagtagcagagcaggatttaaacatgcatctctgaacttacagtcagaacttttaactactgtccaggcaccagaagttttatgatatttctcttcttgtgttccaattcctttattttctacctttaaaaatcttgacctgcataactgaagacgattcggccagtggagcacgggatattcactataatatttcctggctattctctcactatatgataaggggccacatctgtaatcaggtagtcattagtaataatgaatgcatagcatgtcagtactgttgtttgaagtgaatttcacattttagctcatttaattctcataacatccgtatgaaataggcattattatctccctttgcagatgagaaaacagcacagataagttaagtaacaaacccaagatcactcagctgttatattaagtagcacagtcatggttcaaatccaggcagtttaactccagagttcatgtgtttaaccactccgcctactgcctctttagtttcaatttgttttcttcaaagctacatcttcttcacataacaattttgataacaaattcaaaattagtttagtttatataaagactaagatctatttcattcctctcgcctcaatttcttttaaaagtttggatgatttatttattttttatttttatttatttatttatttacttttgagatggagtctcactctgtcacccaggctggaatgcagtggcgtgatcttggctcactgcaaccgccgttgcaattctcctgcttcaggctccctagtagctgggattacaggtgtgcaccaccatgcccagctaatttttttgtatttttagtagagatggggtttcacaatgttggccaggccagtcttgaacttctgacctcgaatgatctgcttgccttggcctcccaaagtgctgggattacaggcatgagccactgtgtctggccctgcttggatgatttagattgggatgatgaagttattcattgtattaaataattttgtgctttctcttacccctcatgaagtccttttgcttattaggtgcctatttatcaactgtatactgggtaaaaatacgtgagttcttacttgctgtagacacagaatatttgaatttagcttaaatattgtttacataaaatccactcctgattccatttgaaacaattctaaaattaggatattccatgtatcttcttccttacaagcatagaaatattgttatcccttgatctatgcatatcattctgtactagtgggttgctgtaaggaccaaaagaagctttcctcataaaacttctgtactcacaaatgagcttattgatgtcatataggcagctctttacacacacacacacacacacacacacacacacacacactccacttaaaactggatttttagaaagcaaatagtttattgacttttattctagaaaaacaattaccaaaatgatttttgggaataatctagaaattcgaccaggaggtcctttctgcaaagctatggtgacacagttgaaatggagaaaatgtccatgaaataagtctgggctactctgtattgatgatgtctatccagcaaaagttccaatgcctgaagcccagagtcagaggatggataagcctgggaatgccatctgtctatgagacatggtaaacaccaatattttaaaaggaatcttagtcaatggaaccagaagtgatataaaaaagttttacttcctcttatgacctcctgtgacaaagagaatttatcgatgattgaacatgattgctatcatactgagagttctccttaatgttaaaacgcaaatgaaataaagtgggttacctaacaagtgacatgaagtttatactcatgatgctgtactacaggatcatctactcctttctgtttattatgttgtttagatttggaaatctttcagtttttgaaattaatccttataatgctattttatgatcagcaaaatggagacccacatgtaaaaattcatcttaaagtcactgaaatagtcttttaaatctatgcagtttgaaaatatagcggaatatgataatatcacttagggtatttgtttatgattatacaatttcctccagtctttatttatttatatatttattgtttgtttgtttgcctttccagcctgcaaaccctctagtctttaaataaattggaactctcaatgaactttttgcatgaaaataactttcactgagtacttctttgattttagcattctaaatgactttaatttaaaaagtattcagaattaagtatatagaaaaactgatagtatatacatagtgactacatataccattttaataattttcagcatgcaaaagtaattatatatattatactggtagatttatttcctcattgtaggaggagtcataatacagacagctttaatttatcataaccttgagaattctttgggatttatgttatacatgaactaatgattaactaaatatactctagtcatagtctttccttcagtgaacacagagtttaggaaacattctatgtaggaatatgaatcataaagcaggaagatttttttgctagctacttatatccccatagtgatagtaggtattaagctgaagctagaaggagattccatactttcatatggtcttcaaataattttaaaccaactaaattcttttcaggcttgaatttcatgtgttccaataaccctaggctcttttttgaatcttattatcacaggatatgtgattttagaagtgtttttatttaagtcataaaataaaatatacccctgctatagcatggatatttcatgactttggatttaacatgagccagtcttctctcagctaacaccattgttagtatggggttcttgcagaatcacaaaaggtgagagctatattttatacaaaatctgttactctttctagaggaaatggtttgctatttcatagtgaatttctggagggtaggatctattagatcccattaactcaaatttagtgattagtgataaactggcagattattaatagacttgaattgtaggttgtgcctgtactaaaaaataaagtcaaggttatttggagatttgatacatacaagtacagttttattctgagttaatgactcaattcttcatttaagttggtaagcatgtcagtttggtgtatatgtaatcttttttattagatttattgtaatatcctatcaatactaattaatccattttactagaatgaccccaaaaagttggaataaaattgaatgtaaatatattcattaattaatctactctctcaataattcattcattcatttatttataaacaaacatttgctgccttcctagtatgtgttaagccctgtgctagtatctaaaatacgttagcaggtaaaaacaaacaaacaaacaaacaaacaaacaaaaaaactaaacaacatatatgattcttgctgtcatgaagcttcagacaagtggaggagccaggcattaatcatatcatcatactcatgaaagaataattacaaacagatatgtctttatggaaagcaatttgctgctcagtataacagagcaagcaggctttgtctaggggtgaggttggggtgctagggaaggctctgcaaaaggttgagtagggtggtgtatgaaggagttttccatttgtagaagaaaaagcatttgcaactgccccaggtgggaggaagatactgaggggagaaatggaaataaagcaaaagttgaagttgtttaggaaagaagcacaagatgaatcgagggccaaaccactcaaggattttttagtccatttatctaccttggcctttatcctaagagaaagtggcaattgtggaaatatcttgagaaaggaagtgtagtaggtttaatggtggcccccatgaagctatgtccatgtgctaactcttggaacctgtgaatgtagtctcatttgggaaaagggcctttgtagacataattaagtgaaggatcttgtgatggagttctcctgtgttatcccagtggcccctaaatccaatgacacgtccttctaagagacaaaagagaaggaccccaaaggagagggccatgtgaagatggaggcagagataggagtgagaagctacagtcaaggaatgatgacagccatcagagaatggagaggcaaggaacagattgcctcctagagcctctggaagaaacacaaccctgtagacaccttgatttcagactctggcctccagaactataagaaaataaattcttgttgttttaagccaccgggtttgtgggaaattgttatagcagccctaagaaatgaataaggggctgtgacccagtcagccatatgtcatcatgggtctttcagctgcagcgtgtggagacctgatccatgtcaagccagagaggactgggaggggccagggagtagatttttcactttatttgagacaagagcctggtaacttgcttggactagagggatggtcgtggaaatagattgaagaactagtaaggaaagttgagaggacttgatgatggactatttgcctaggtaagggagagaggcaaatgttagttttaagattcacctttgcttatttttggcagaaaagttggcattgtattcattcaaggagtatttattatctttctactatgggtctgacactgtcctaagttctggtgacagtggcaaataaaacagacagggtcgtgccctttcagagattatggtaaggcaagaaatgaggacaaattgtgatttgtggatgcatatatgcaaccaaatagaaaaagttagtaataataacattggcttagtttacactggacccagagtagtcatcacatcacacttatgccatacatagctgaccaggaggatgtcatgagacaaagaatataatgcaatgtaatggctttttaaaaaggtaatccccaacacaatcttcttatgtttggatgaaatgagaacatttatagtaagatgtcatagtaatactcttatatctaaacaaaataccaataattgtttttttcctccatttaaatgaggggattagacaaaccaattccctaaggtcccttttagcttaaaaaagacacaaaaacagaaaaacaactctttattttttactacatgttattcttttttactataagttcgttatcaagatctgatctttaggaagaatttaagtgtaatttaaggataagcaacagtttataaatagatcttaatttaaagaaggtgtgaatattcatgtttttcataagtggctcctaggtaagaattaaaatttttctccctgaaatattgtcatgccatgagctggagattccaatgtatttctggtctttactatcgatttttgtgtattctttttgctattttagcattttgaagaaagagaggagggtgaacattgaattgtaatttgtagggagttaagtctagtttcaggtgtcctctcttatgacctcctttcttaaatctcattccatcaattcctggctggatagctttcaattggctctttaacttgagccaaattaaaaagtggtgctgatttggccacattctatgggattttcctaaacagtgtcagaacctgaatgtaggtatccactttgtgaagtgtgtgaggttctgacactgggggagtccacaggaggtagaggggagctcagcactggagactgttgaccttagatgtgaatcctgctctactactcacacactatcatctgactaatctgtaaaatacgtattttgtaaacttacttttaagggttagcaaatctgtttataaagtatttatcacagtccttacactgtagtaggggtttaatgaatggtatcaattactatagttattgcaaaagtgttagcaaaagtcatctgacatctctgtaaaacagttgccattgtatagccactttaattaaacgctctgtattgagactgggtagctcagttcatttgagaagatagactgcagctgctccaaaggagaatgtgaaaaatttaagagagtgcaaaaaggtgaagatcttcagtattttcaaatagcctaactcgtctccattcaaatatggttagggaatggaaaatcatattgtgcttagaatagcgcattactaaaacatctgtatcccatcatacatatctgttaactttacaatgcttatttcaaatctagttacattgtaatttcctatataagggaaaaacatattctcccaagctattgacttcctagatgttccttgggtgcttctgaaagctgcatttgatgctttcctttcataagagtatgatttaataaagtattatttacttagctcatgactaaacactaacttagcacagttgaagaaataccttaccagatttctccagactgactatgttggtcagtaaagatccatttattttaaactacgtttgaaaaacacctagtttcatattttctcacattttatctgagcagtgcacagtgtttatttgtaaagtggaaatgaattttaatattgaacctcttactgctgtggggtttagagttgacttcatatcattaaatgcatggatgaattagtgtatttatttgcatgtatgatatatctgtatttcaaagcaaacatttcaaaggatcactaaaatatgtatgtaaagtttgtatttgcctcctagtaatgttcatagagggtatgcactacacagatctggttttataagaaaaaattggactgtttggaactccattactcaattttcatgggcatatatgtaggcagacttatatatgcaaattttggaagtgtttatgacataattttaaaatctgacagtaaataggtaagatcaaattctacccacaggtgacttaatattggtcaaaacagtgtttttgcttttctgtatttatgacacagaaccaagatatacagggccaagcatagtttgtgagacagttacacacatttcattttaaaatatgggcgctttacagtaaataacttgaaactgaggacatattggaaatagtgccggggattgtatgccattttagttatccataaatgtaaactcctttaattatgcacaacatgatctcatattttttatactcttttccctagattttagttcttacttttaattttatcacaaatagattttaatcagatttaaacatgtacaagagcctcgtttcactttgatacatgtgtatctgattcccatggaagttactgggggttatgaatgcatacagaggggagagtacacccatagcctccaaaacaaatttagaaaaatttaaaatgccctggagtaataaagagctagtctgagggttcaaaaagagggtaaatacatgttttaaagatgattttcgtaaaaactcttgtggcttttttgaagcccaagggagggatagatgggtgtgaatagaaaaaaagaataaactagcaattatgcctagggtaaaagtgtaaattacagtttaccttggcagaaagcatgtgcatggtaacattttttaatgagtgctatttgtagttccaagagctatgtaatcattgtttactccttagaatgcccttgtgaggtttgcattacctaccaatcagcctcatgtgacaatgacatggagacacgtttatcattctgttttcaggaactaatattttaagtgatctaccaagctaccatcaatatgccctgtgcaaatgaggaaacctcaagttaaggggggttaggaactttcctcaattacttgagagacagcatttgggttgggtttggttaggaatcattctcttgcagtatctaagagacatggaacacatttgttgccatatatcatgcctgcctccccatttttccacccattcccttctttcccacagtcagacttgttattagttatcaaggtgctaggaaaatacatgcttagaactgaagtcttgaatgctatttaaatgttggccatcttaccctctccttaaaaagcattaacaaatattaactcaactggtgaaaccaagtaaaaatttttatctttactacactgaggcaccataacaaaagtaacctaatgccatcaccagttgggtgatataatatactacctatgtgacttggcattatgccgttcaataaagaccatagaagtaaaatcacaacacctggcttctaattgagtgcttctcaactccggctgcctagtagaaatatctggtgagctttcaaaacatacagatgccagagataccctctttccccaaaagtctaatttacttgttttggggggaggatcaggcatcagtattttcacaaacttttcagatgagtccactgttctactttccattttaaaacttctaatttttgtgaattccttttaagaactcacactctcttaagcttctattcttgcatctctgaaattgggataatatatacctagtctgtctcacaccatcttgaaaatcaaatggagacttgattttaaaacctgtgaaaactgtgacatgatgtacaaacatgagatatgcttgtgatggtcaggttagctttcttataatttaaaatagtaaaatttgaaggaaacttcttgggaagaaatctccagttttccttcattttccacagtggttttttgatacaacttcagtctattttaactcaagtatatattgtgcacttggtgtgcaaaatgtatgctaatggatatttgccaactcaatggttagaatagatagtagaaagtggggtgtgtgtgtgtgtgtgtgtgtgtgtgtgtataaaagtttgtccatatagatatctgggaaaactctagatagatttaaagaaaagatactgagtaacagctataaaaaggtgattggccaaaacatatcagagtttattcattcacccaagaaatactattttgagggtatgccaggccttctgccaagacatagaaatagattacattgtcaatgtcctcaaagaatctccatagacaatttataatgacagacaaataagccaatgcttatagtacagagacatgcaggctgcagttgaaggtctttcagtatcatgaagaagtctgcaggagagaagtgaagagcccaggaatgtggtcaggtaaggcttacaagaaggcataaagtgtgaatgaactgagtcttgagggacacctggaaagaggtcagactgaggaaggggatgggtcttccaggcaaaaaacaaaaacaaaaacaaaaacaaagcagaagtgctagaaaagaaacgacagaatgtggcccattcaggaaagtgtatgaagcacatgtaacagtatgtttgggaattgctagtggatgagggaagagagaggtagccagtggccaaacacaaatggatttagaatttattctgaaggccatgaagatacattttatgttatataggggagtagcagattggcttgctttcggtaaattcaatcccataaccataatggaggaaggaagatggactaggtgagagatccaacagctcaccactgatgtagtgtaggccaaaaatgagaaaagactgaacaaagacagcggcagaaaggagttgttgactatttagagccatttaggagagttgaatcaataaaattaagtgtcagattaataataatcacaaactttttctgaataaaaccaacacatggaaaacaggatgttagaatgggactgtggtaggctgaataatggcccccaagatatctatgttccaattcctggaacctgtgaatatatgaccttaatatgctaaaagggactttgcaaatgtgatacattaattatcctgagatggagacaggcccctggattatctggtgcatccaatgtaatcataagtgtccttataagagagcaacaagaggatcagagtcattggtagttgtgacaatggaagcaagaagttgaattgatttgaggaaaggatccaagctaaggaatgtgggtggcttctagaagctgaaaaaggtaaaaggtaggaagacagattctacctttattcaaaaccatcagaaagaaaacactcttaccaatattgtgtcattttcctctagcatcagtagtgagatgtcattctcattcatatttattttaaacttctattctttcatactggaagtttttacaaaactatctggaaatcttggtgttcagaaattttggaaggaatatacagttataggtctttttaaaattcattctgcttatcatgttgtggtacatttgatctagagatgacccttctccacctatggatattttgttctacttgtttcttgattatttctcttcctttctttaaaaaatcattttcagacttagttgtatgaatattagacctcctagagtaactctgtatctcttaagtttttcttgtatttatgatctatttttctattgtactttttgtgatatattctcaacttggttctgttttttaaattaaattctttatttcaaatattatattgtaaatttccagtacctctttatttttcttctcatcttttccatagttgcatgtttttgttttatacatgtgtaaactcaatctccctgaagttttttttaatctttttttttctatttactaaatattgtcttgttccagattggcatgcaggaggtttattaggaagtatccttgggatcaacacctgaggaagtgaagagaagaaaaggattcaggactgagcagagggaaaagttgagctccaatgcaatctcagtggagttttcatccaagctttggggagttctgaagctgggattgtgaagcaggttcgctgtgctctgattaccaacttttctaagtctggtgagagagagcatactcatgtgcagaaagttacatgaagcaagtttattacttacagataggcagcaagggacaacagaagcctagggttcattatgaattggtcccccaaggctcaaaaagctacttggggtgcatggagatcccctgcacgccccacttgcatcacagctcagggaccctgggaagcagcctaccctaagtctcagggccacatgatcactgggctaaagtgttgaaggtcatcctgttctagtgggagattgggacagagcccaggctgttcttgccagcttctctccacacccatctcaggatgctgcattcccagcacattctatagttattcttaagcaagaaataggggagaacagagccaatccacagccacctagagaactatcctgcagggatgactcttcagtgtttctccacattgggataaggaggctaggactttatatatccatgcttcccagtcactggatatggtagccatcaggaaggagtatgatcttgggtgaggtggctgtcttcagccaatgcaatcccttatggctttctgggggcagctctcccagcaactggagaataaatcatttgtttctgaagagggatctgtgtggtttatctcagcatccatcacatctctgctttttgttttttaaggtttgttagattctacttgttccgctttttttctctctttgatactatcattttttcttcaaatgtttggtgagtttaggtttttatttacatgtatgcctgtctagggagttaacatgactaactccctatctgtttgccctaataaggcttttccttgagtagagggactagcagagctctctgtgtgtggttgggcgcacagactggcaggactcactttcagatgctcagctggggaagtatctggcatttccaaatgctagaatgtggacagccttattttggggtgctactatctctgttagttatcccagatgattttaacatctctttggaagttaattatctgatttaaatatggaatgtggggcaaacgctaattctgtatgccacatcaatctgtgtgggagtggcaggaatgtggttcctgaacaaagagctgtccatattccaatattgcccaaacttgtttgccataaaaatcacatgggactcttgctaaaaatccaacttcctgggttatattgccagactcactgaacgagagtcttcagggataagttcagagattctctctgtttaacaagaaccccatgttaatcttatgatcagctgaggtttgtaacactgcctgtggacagtctttcaatcaatcaccttccttatccatccccaatctttgtacctgttcctttggagtctctctgtggcttcatggtcaggaacagtgcttttctttctgttagagctttttcctatgtttgtttgaaatggaggctcctacttttgtttgcctattaatatgatagtttctacctgctactcatgttacagaacgtcatcaggctctctggtcttcctgttctcagaacagttataaatatattcccttttgtacttctttttcaatgagatgagtttttagaaaagggggaaggtaaacatgtacactcaaaataccctcttgaatcaaatctcaataatcacactttggaaaaatctcctgagctaggctattgctaatgtgcagtataacagattggatacggggataagggaggtagggcagctttggataatcctcaacagtctggctttagaaattgggcaattttttttattatcatacttcaagttttagggtacctatgcacaatgtgcaggtttgttacatatgtatacatgtgccatgttggtgtgctgcacccattaactcgtcatttacattaggtatatctcctaatgctatccctcccccttctgccgacccacaacaggccccagtgtgtgatgttccccaccctgtgtccaagtgttctcattgttcaattcccacctatgagtgagaacatgcagtgtttggttttctgttcttgcgatagtttgctcagaatgatggtttccagcttcatccatgtccctacaaaggacatgaactcacgattttttatggctgcatagcattccatggtgtgtatgtgccacattttcttaatccagtctatcattgatggacatttgggttggttccaagtctttgctattgtgaatagtgccacaataaacatacatgtgcatgtgtctttatagcatcatgatttatactcctttgggtatatacccagaaatggtatggctgggtcaaatggtatttctagttctagatccctgaggaatcgccacactgtcttccacaatggttgaactagtttacagtcccaccaacagtgtaagtgttcctatttctccacatcctctccagcacctgttgtttcctgactttttaatgatcaccattctaactggtgtgagatggcatctcattgtgattttgatttgcatttctctgatggccagtgatgatgagcattttttcatgcgtctgttggctgcataaatgtcttcttttgaaaagtgtctgttcacatccttcgcccgaaattgggcaaatttttatgtattttactgaaaagaacagagaggggaaggaaccattttgatggggaaagataaggagtttcatttttcacaagtccagtttgatatgaaggcttagggaagaggtctgatctggaagcctatctctgtgagttgttcattcatccatttatcaatttacgtaagtaaagcacctattaatgaggcatatattaaatgccacaacatggaactggaaataccttataggggatagaaacaaataactaagcaagtgcaataaaatgtgatacatgtaatgctaggggaggatcagagtgctatgagaattcataggagagacaccaaacctagacctggtgatctgggagggctctgacatctaggctgagacttacaagatgaactggatgagtctggtaaaggagcctacagaggaaagttatttcagaaagaatgaagagtcagtagggaagctgagagccaaaacagaatactgaaaaatttctgtacaacttgtttttagtagaaaggaaggcaagagaggaggctggaaagaaaagcaaggatgaggtgatgtaggatcttatacaatgggaagtcactggagagtttaaaataatcatcctaaacatggatttgatttgaaatcttggcaatggatgatatcacccagtggttctctatctttggtctgcattagaatcaccaagaagcttgttaaaaaaggaacctactatgtgtaacattgcataaagccctttacatatgttatcttttaaacctcaccatctcagcaagcgggtgctgtttattttcctagggtcacaaagctattaaataccaaaactgaaatatgaacccaagcaatctggctgtaaagtctctcccctttgtcctgtaccatgttgcctcaaatacaagcattatataaaatagacccctgcatttcacagagaacatataacgaggcctttgagaattctcaggttcacaatgccaccacagaaaacaattttgtctctcccatacctggagattttaactcaggagagtggaaatgggcctaggagtctgaattttaacaagcattaaagatgttgttttgttgcagatggtcccctgaccctgcttggagtaacttgagaatagagaagaggttgaggacgaaaacttagggcagaataatccatgaaaatgagaagaaatagctgaacaagtaggaggtaaactttaagaatattactgtggaataggagataattagaagaaagatcaataatatgatatgcaacaggcaagataaattagatcagaactagaaagtgcccacagggcatggttatcagttcactggtaagactgagaactttccctccataattcccacttaagaagacttactacttcttgttcttggtacttcatggaactatgcttagagatatttacattgtcctcatatttctccctgtctcatagaaatagttaaaaaatggattttggcaaggtcaatttggtcaggtgtggtggctcactcctgtaatcccacccactttgggaggccgagatgggtggatcacttgaggtcaggaatttgagaccagcctggccagcatggtgaaaccccgtctctactaaaaatacaaaaattagctgggtgtggtatgcacacctgtagtgccagctactcgggaggctgaggcaggagaattgcttgaacctgggaggcagaagttgcaatgagccgagatcagaccactgcactccagcctgagtgacagagtgagactccctctcaaaaaaaaaaaggtcatttctccatagcttatctttgtaggcattgaatttaaaacacagtatggctatgaatggcagactcacttaaatttcttacaaatgcttgacatactctaggatttgaccctttaaatatggaaagattaatttgtttcaacaaaatgctgctcattgataaagtcaataaaatactttgtactgaggatgctgccacccatgatgattaaacttgaaaagaagaattgaactacaacttacgaaaacctctgtgcctatttttaaatgcaagcaaacaaaattctcaaaattctagtttaaactgcaggtagataattctttgttttggattatttaaatgctatcaaaataaaaataaacaggttccgctttgaagttatgatggctatacaggcaccaacagtaactgatatctcttcttttcaacatgctgaaatgtatgtgtctgattcctgatggcttttactgaggttgagtctcacagcgcagaagcttaataaaaactagtgttaaaatctccacatagctgactgtcaattatagatgtttatactgtaatctctaacagctccagtttcttccagtaatataaagcatttcttctaaactgaattctaaacctaattaactcttcttcagacattgtcttattcttatattaactaatgtatttatcctaaattagaggtccagtttgactgtccaggagatcacttagaaattttatgataataaaaataaataacaattattgaccacctactatgtttggatttgtgttaagatcttctttaagcctcacgattttggaaagtgagtgatatttatattcccagggtcatatagctggtaagtgccaagtctgagacttgaactgaatccggctataaagtccctgccctcactgctgcactgtgccgtgtccataaagaagtattgtataaggtaggcccttaaatttcactagagctggagaaggggctgtgggaattctaagattcccaatgccaccacagaaaactatttaccctccgaacagcaagtcgtttcctaagctaattcaataccttgctgactctcctacagaccaacctcatcctctactaaattcaaatctatacctgacaacatcatagactgcacattgtaagccattatgttcatcatctgtcatctgcttaattcattcaacaaatgttgagcatctcatcagtaagacaagatccttgtctttatggagtctttaatctagtgagggaaaaccatgaatgataaatctagaactatcaagagtctagtaggtttctttgtggttttcatatacatgtaaatgtggttgagattatagaggtcactcaaagaaataagacatcttttaggatgtgagaagaggttaatgcaggaggtttctagactaagagacttcttgcaaaggcccaagagcaaccatcctaaacacgtggaaggaccaggggaaagtattacttgaaagaaatgaagaagtcatgtcaaggaaatattgtactatgaattttgagatactaagaaaataacatttggaccgcagctttctttgatttacatatttctgccagataagagttagagtaccctgacaatcattgcacatgtgtaataacttgaggtaggatttcaaacctctcgaggaaaagggtgaataatagcagttctggaatgctgcttccatctcacctgcctatccttgccttctaataccgttctagctttctgaactcttgtaaagagtgtaagtgttcataactttttgtatcaaactttgtagttaaagaaggagggaaacatatgcttttatgattattgctattagaaaccaagcaaaaaatagtaatttttagtccattgcttttattaatcatggtatagagcttaatgtttgctttttaactttaaataactctgcgttctagattaggggtagaggttttcaactgatttttaagagaatttttatgagaaacaacctccagttaataattcaccagaggattaaaacatagatgaggggctgatgggtgcagcaaaccaccatgtcacatgtatatctatgtaacaaacctgcacgttttgcacacgtatcccagaatttaaagtatagtaataaaaaatcaccagaaaatctaaatgaaaggctcattaattatttttattatagtagctgctgaaaatacaaatggattaactattgtattaacaatcactaccatccaacctactagaaatctcaagaaaagtgttaccataatactcctttttttctttaatttgaagaagtatctctaggttatttccaaggcaatctacttgagttatttaacacttagactttgttcaaatttataaatggattttttataaaggaaaattcaattaagggacacaataaagaattaaatgaaaaataaacattttgaagttcagaaagagtgattttcctcaggaatacctgcaaaaattccaattgcctatatttacactagaaatattcacctatgccctcattcactcaagctgtggaaaaacaattagttcgtctgtataatacaatttggaaatcatttcagggaaataatactgtattctttattagaagaataaaaataaacttttctatcaggttcatatcttaacagtttagaaagcgtcgtgactctggaattgattctggacttgaatttgctttccattactagatacatgttcttggatgtatctcttaacttggcagtgcttttgctttaaaataggggtaagcataataattatcttacaagttagttgagaagttcagatgggataatgtatacagcatagataatgtctataaaccagcaaattctataaaaattttatatacaaacacttattcataaaatttttttttagttggttcttataagtaggaaatttccacaaattctacatggatttctacaaaagcgggtgactcaaaaactatagaagaaatatcttatattttaagataataaactgctttaggagtttctacaactggatattatagaaaggaggaatatatttaaatgaaaatttccctgaagggcagttggaatagagcagagtccatccaggaattatgctggctagagaaatagttcttcaatgggatgtatgtgctagatgtgttctgtttatttttgcctttaatgaccatttaatatttcacagaatattgattttatagtgttaggtatatttaagttaacaggaatagtaaacctacccccactaaccagttatttattttatgacctgccaagagctctgaagttaaaagatgctatcttgttttacttaatctgctggcatttatggagtcccagtctcatgtggagcactaggtgcagtcactggggatggacagaggcaaattcaatagaaggtatcattgttactcttaaggagcttatgatccagttgaaggaatgcacatcaagaattgaaacgatggaaaacccatttatgaaccacgatgccagtaagagtaaattgatatagaaattgctggcctggaagagagataatgggcccaaacattttaaattcagattttctgctttgggatggtgtgttgcactcaggatgtgtctgtatatcaaaagtgtgatttgaaactttctcatcttacaagccctcttctattccctcttgttaccttttccctctaaattagacacattgtacatgtgtagggtgacttacagtttcgcttatgtatgttcacacttacttcaagaaattgcatttactctcttttacagaataaagaggaaaatacactcagtcaaactctaccaaagagacagttgactgggtctagactaattattatagcagttgtattaggcaacaaccagtcttttgttacataacatgaaaagtcccatctcattctgttaagtaactaaatcgtatgattggttctaactctacttttaaagttatagttttctatccagagagctccacaaatgacagagcttaattagctccagtaagctactccttgtgaaactcactgcgtcagtcagaataggataggtcaattcccaaacttttggtttttggtttctttactttaaaaattatggaggactcctaaagagtttttgttgatattggttacatgcattgatttttttcttgtatttgaaattaaaattaagaacatttaaaaatatccattaattgaaaatgactataataaatcaattatatgttaacataacttttttatataaaatacgaaattttacaaaaaaaaataaaaatttagtgaggaaaatggcaccattatacagttttgccaatccttaacctgcttgtcttagttagttcaggctgctcttccaaactgctatgactgggtgacttaaacaacatttatttatcacagttctggaagctggaagtccaaaatcaggctgccaccatggttggtttcttggtgagggccctctccctggtttacagatgactgctttctggctatgtcttcacttggaggagagagagtggattctggtctcttcattttcttatatgggcactaaccccatcacaggggctccaccattatgatctcatctaaacctaattacctcctaaaagccccatttccaaataccatcacactggggattagggcttcagcatacggatttgggaggacaaaaacattcagtgaaaattaccgctggattcttatatcaacttctgcattcaatctgttgcaatatcacacaccatgtagcctttggaaaactctacactgcatttgtgagagaacgagagcaaaaggggaaataacatcttcatattattacaaaaataattttgacctcatagacctcttgaaaaagcttcagtaaccccagggttctccaaaacacattctgaaaatcactgggctaagttataatatgataatatttaattttcaaatcctggtgactttagcagtaaagttttttttttttttctccttcctctttttcattcagtatccattatgtatctgttggatattttgttccatgtcattacagccctcactctgggacataatttggtggagcagaaactctctagaacattgatggtgactgtggcaaaaataaaagaaagaatggaagaatatggactgattctttttttttttttttgagatggagtctctctctgttgcccaggctgcagtgcagtgacatgatcttggctcactgcaacctccacctcctgggttcaagtgattcttctgcctcagcctccagaatagctgggactacaggctcatgtcaccacgaccggctaatttttgtatttttagtagagatggggtttcgccatcttggccaggctggtctcaaactcctgacctcgtgaaccacccgcctcggcctcccaatatgctgggattagaggtgtgagccaccgtgcccagcctggactgattcttgaagctttctcttgcaagacaactattacgtatttcgttagccaaagcaattcacgtatctagcctgacttcatgaaggcaggaggtataacccttctgtagtgagagacacaggatattagtcaacattaatacagtctatcatgctcattaatatttttaaagcacatctgtgtgtcaagtcattagatgccttatagactttgatcccagtcagagtttagcgaggttgtctttatctgtgcctccaacttgctccttttttaggtttcaagaatttaacaaatgcctgatatatactgaatatttagtgaacattcatcatataaagggacaaaaatggaacaattaatacaatatttaaatttgggcaggtgcctaaaattctcaggatgtgatgtccaaatactgactaggttcattttggatcttggaagggtctcgttgataatctacatcaactccattatataacagatgattcagttgaagtgtgaagacattaaataacaccattctaacgctaggtatgaaaatagggttaattgtgtccagtttgtattttggaaatggtgttgagtttgggatgtcttttaggtaagtctagataaatgctcaaatgatgccatcttacagatttctgcgttggagatacatattgcttaatatctaaaatttctaggactctacggaaaatttaagatagttacaaagtaactacagatataaaactttaatttactttatttcccttgtggttccattggggtaggagttctttgcctaatttctagctctcctgcaagcttgaagtcattttgaatgctactgtgttgactatttctcctgcagaagccattttctaaaaccagttatactcataaaagcatcttgcagctgatataagattatataatgtaaattgccaagatgtgggtgactgctcccatctctaaaaaatctaattacgcatttggattttatttttattaactctagaatcaaaagttccaaacttaagaaaaagagattggctgagtacaggcaaatctacaacactgcattccctaccatgtagtaaaaagttaatgaaaaaaaaacgaaaactttcatccttaagatacttttattctaggagcaatattttattctaattaaacttcacagtaacccaacaggggtaagtaatgggcgaatattccctttttataggttaaaaaatcaaggcacaagcaggttaaaggagacgccagccaaaattcacacaatgagtcactaacggaaccaagaagacatgatgcttttttcttccaagatggtgccctagacatgtagccactgtcaccatgattatacattttgataaatgacaaaaattagaaaagcatcttggtctaaatatctgaaatgaaacctacattgtatatgtggcaattatcttggtggaaacaagaaattgcttgtattttcaaaagcatcctccacaatattttatttttcccattttctttgtattcaaaaatatctattgtccaatgtcaaataaatgcaaatattaactgtgatacaaagtagcatttgtgccactagccactggtaccattaaaaaccttcatgtgtgaatgggtgtttaattaggctgtattagattaatcccatgtctccattggttgtaacaaatgaaaagatagtgtgcactgtcatggggatagacatttaaagctcaatgtaactttcatatttttctatgtgatcgatcagctaggacttccttttaatttaatgaaaatttggtttgtaaatcagataacctttttaattgcaagaaatgcaaagcaggaatttttttttttttttttttttaaggattgacattacctttgttgtttgatacattaaaacaagacccataagggacagctctaaacaatgaacttcatataaaatagataaaagcttgctccttgggcctacatagaaattcagacagaggtttggaaagaaaagcctaatacttctaatatgataatactgcctaggtagcagtagaatatttgttataaaaggtcttaaatgtcatttcctaatgacattttgaggtaattttaaccactcttaaaataattgcatgtagattatagttattgtataagaaaagacttgcctccaatttaaacaatattgggaagtcaaatataaatttaagtagtgaaacttaatttttaaaacagaaaaatattccagccgacacgtaagttttgctttgtcactgtactgtattctgttcagtagaacaaagaccggatgcataatgagccaatgtaaatgaggtcaaatcagcaaaagcatagtgggggaggggaaggtgtaaaatatgacagtcaatataatgaccagggagtagagaatttaaatgtttaatgcctacacattcagattcatttttctgtcatcgctttgaatgggtagactgaggagcttcaaagtccagaatgaaaacatcatcctgtggaccaaaagaattattaatattatttaatggcacggatatgatctgcacttacaatcatcttctttccatcactccccactgcccccctccacccggggtgggtcgggggaaagaaaggtggtcataataagagataattagaaaatgctctaagtatttatttggggctttctgtcttaccctcctgcactgcatgccagcttcccatctcccagccatgatggaagctcagaacacaatagaaacacagcaacgatatgaattgcaaatacatgtgtatctttccacacaacctatcttacttactcttaataaaatgagtatcttctaaaaaatttctggagctgtaaattgctttactattgatgacgggctttggaaaaataccacacatgccttacgatcaactagacagagttgtgttaaacagaattgcttagctcttgtctgtaaattactcccctccctctccaataaaggaatgaatcttgcttaataatctgtactgcttagcatgtgttgcaactatacatgtgcaaatctgggtattttatatatcccacactttaggactataacaagcctttatcgtaatgttctcatatttaacattttcctacatagaacgtgaattttcaagaatactggcataaagatcatttaatgtattgtcccctgccatcgtattttctctcatatgcaggtccaaaatattgctgtcttgaaagatattcataaaattcatttcagtgtctagccgacttaacacatagtaattaaactggagctataaacagcaaatgtacatagacttctctgatttcaatgttacattaaactagtgaatattaatccctaaaaataagtgcattgataatatgaaggtagaattctatgcggggaaggggagtgggtagatgggaaatggttagagaattattgtaaagtaagttaaatttctgattttgctgttaattaaattattcaaaagactgtttttacagcttgaaaaaaaggaaaaagagacttatttggcactggcaatggctactaaaaggctgctgttaaactagcaccaagaatgggaggggtatgtatgttgagggctgggggaacacaggaacttgaatacttgctttgtaaatatttaagttttttgcaggctagcatctaaagaagaaataaaatatttgccttttacctttgaaccctttcgtgaaatatcctaatgttgccaaatgtgaatatagtgaacttaatcagcaaatttgacttagatttatgaactttttcattctaaatgcatttacatatacacaagcacatatatgttcataaatttattttattacatccattttgcacaaacggaaccttaagcagttgaagtactaaaaaagccaatcaaaatactcttcatatatccttaagtccataaacctctttaaattgtctcttttaaaaaacagctaaattatggaaatgcagtctgcattacagaatatttgccagttatatcttgattcttatttgaaactcccacaagaatataggcatgacagtaatataaaccatagaaacaggcaaaaaaaaagtagaacacagggacttgtaaataaatccatgaatatcaagaagcacagatgctgagattatgcatttttaccagtacagttctgtgcttgtaaactataagaccagacatttgtaagatgccgtgtagcaggccctgctgagggcgggagaggtaggagagactctgagaaaggtggggcggagggaagaagggagggaaaatgagtgagaggcagagagagagagattgagaataaggagggggacacatagccagacacaataacgcataataatgttaacattcctgcatgtctaatggcttaaatatgctgagtgcctcactccagccccacaccacagatgatgtcaaagaaccatttaatattttatcaacagtccttctttgaaccaaaaaaattttttttcttttaaaagagattcaggggtttcctagcatgaaaaaaattaaatgccttgaaaggcaaaattttaagacaaaacaatatttgtgaatacctcatgttcagcaagattcacaccattctccaatgcatcttacattatttacatcttagcaatgtcaacatgtcttatttaccaaggaaacataaaatcatattttagcttcttttctttaaacattagtaatgtatggctatttttaaaatgtaaaaaaacctattgattgaattattattataatatcagttggacttttaggggttttttttggtggaaaatattgttttcttgtttgacggatactatgcctgtaacaaagaatgactgaattgtcttaacaaagaagatgaaggctgtatgtgttagttacaatagaataaccaccttccagatctcttaaatccacaatatatgtagtgtgggtcctgagtggcttttgttttcaatgtcttttgtaagcttttaggtttttttctgcatcaaatgtcaagttaatttacagggcgctattactgatatgtttccttggtttgtggttttctgtgaaaggcaggcagctgagaccaagtcttaggctgcgggggaggggcagccagcgagcccataacacatacacagtgccagggtctgtaaattggctgcctgtatgacagcgggcccagggaaacctctagtcttcatttgcatgctgaagaatatccaggattaaaccggactgattttcatacaggatttagacctgacatttattattcggttcacagacctcttgaaggaaagtttgttttccactcatagatgaaaaatcttctaagataaataaagtctggcttagcagtaacagtaaataaatatctttcctgtatttcttatgaatttatcatatatgattgccagacagatgtttgccaccaaattattatattttgctctttaacaattttgaagaaaaatatctatcaagcccccatgcttgcagtgtttataaaatgtattcatttaattctggaagttgatttttcataaataaaattcagagacagacacttgatttttagaacaaattaaaacaatattggagcggtaaaatactccaaaatgcttaattttgcatctgctttatgtgtttttatgagcacagagaagattttggttgtactgtaagcatccattacgtacttttatataaaacatgaaaattataaatgaatgctacatatgagccctatctactaaatttataacatagatagttcatttccattgccaaataggtccataaagtattctggtgtctttcaacatttaggtattaattgtttgtccagacaaacacttataatccaatactttggcaatattttaactaaaccaagatttaatttctaaagttcaaacaaaacatattttgacatgctaccaatatgaagaagcatgatagagctgctttacattttctaaaatgcatttttgatgtggaccagaataaagacttcaaatagtgattaagcaggcccagaagaaatttaggattcctcatgtattaataaacagtatagattttaaaagtcatggaaaatatactttatatatttaataaacgtaaggtaaaaataatacaaatgtcagtaattaaacatattattgttcctgtcagtgcagatggaggaaacactataaaatctgctatgtatttgaatttttaatgtgtcaatggaacttttgaaaatgtgttctggtattgatttctttatgaatattaacttattcataacaaatcttaaatatgtaaaatataagatatatttcttggaaatttgtctttgttttaatgttgcattttattataaatatacatatgaatcacatttacttcctcaaatgaatttatgatatacccagtaagaagtatatattattgaagttttagatagaatatatcaatgaattttttaatggtgagatatcagtattgtatataccaatcagtttattaaccaagcatttaataaatgaacataatgagtctgtctagttttgccttgattcaattaccatataagaacatgcacacaaatgatctgactgtaccaaaaattagggacaaccaaacagtagaaattattgtgaaaagattttggtcatcttgtgtatagaagtatttctgccttatatgtatgtaaattgcaaatgttaacataaatattattgtaaaatgtgtctacacatgcaaagtgaagagaatcaaggcaattatttgaacaattcaggataaacccctcacttttgcttgcaatagataattgaggcaaaagtgtttttcccttgaattatctggatgattgcatcaattcttcacttctctttatacatgtatatagacatggcaatcgtgtgtcttcagaaagtgtcactttaagaaacatgcaaatgcagaacacattcattgagacatcgctaacttataggcttaatataccactgaacttgtttattaatcaaattgggaccttaaaagagaggaagtgttaaatatatttttctaagcaattatttctaaagcaacatacagtgatatttagatgtaacatacaattatacatgcatcatgcaaactaggtttctccaacctactctggcatactaatgccccagtattcctcattattatttctatcagcagtatacttccacagtaggccctgctaattgtatgaagagtattcacgatggtgtgttgccaatatagtactgaggaacatttaattgcgaaggtttgaccctcagcccgaaatcctgaaagtatatgctagagaaaaaggaattctgaattcagttggttggaatgaggaagatcattttcaatcaagccagtttttaatgactttattgttaacacccttaaaaatatggctgatacaatgacttgcatgcacacagttatttcgtctttttagtgactgcatgagaaataggtattaattgctctgccatttaaaattctcgatacaattcacatttactcactttaaactcaagatgtctctcaatcaaattatggggctctttatatcttcaatgtaattaggattgtacagtattcatgacaaacatactgaacaaggaagaggattcctacttggtaatcattgtaaatatgaaattgtcaagctagtcctaattagtcactgagataaagattatatgcaagtctctaagaggtgctacagactaagaacaaaattcaaaaataccacaattagattattgtttcaaatgcttatgcttaataaagttggtggaccatgtttgccaaataattttgtcaggcaagcggtcatagtttaaaagtaattaagcaattcagcctcatcgtaaaatggcacctgcaaatgtccatgcttttgttggtttggaaatgtgtaagatgctcaataaaaagtactgcctaagaaaaaattcagtatatgatactttttaagcttcaacaggtagagaatcatttttaaacttgcctttaaaaaacattgtagtgaagcatttgattgtttaacatttttattattcaagttcttaccatttcacactactccctggagaggggccaagaaaatattaaaaatactatagaaatataaaggataagatatttgtcacactcatttaaattgatgtatgctgctgtcctataaacgtcacatcggataaccctgaaaaattaccatgaatctccataattacgcatattcatgatggtgttttgcatagtgctaacagcagactgcatgtgaggtgggacgtgaaggggggtggaagtgatgtgacagattaaaattattaccaatatcattgaaatagacatagcaacagttccattttgttaggtcttagaaaacaaaagcatatcataaaatctcatagtaattaaataactagaaatttttctcctacatattttactataaaaagttaacagcaaaaaactgactagaaatatcattgttacttgaaatgtgcttgcatttatcatagactcctaggtacagggacacagcaactgaaaggagacagagctttttaacttttttgagagacaggggagaagggagggtgatggggaatttttaagccttccaaagtacacctgtgcgacttatatggttagcaagctccgatgagctgagtgcaaatcacgtaggtacatttcttctaataagtatgaggactgagtcatattcagtaaactgttaaaaggctctaagagatagaaaagttgtctggtgtctatctcaatagcttttttgtgctgaggcagagagcagagttaatcagggactctagaagtaattatcggcagagtttgggtaatacaaatgcttgggtaaacagcgattgttctttccacaagattgtgagtagaaacaacaatactggtattgtcctccacttctcattaaggggacttggggagggagcgctgcactgcgaggcgcatgggaaactgacaggcaaactgtgctgggaacgactctctcctgatcccactaccacaagctctggcttttggcatcaggagtgccagctgcatcgggagaagccaagcctgtcataccatcttcacatcaaatcttcagggtacaagagctagagcatagttagagcttaatgaagaaacaaatacaaaagggaagattaggcctcgtgaacacttgcattcatttgttcttatagaaactgcactggaagggttgttttacagaactcattctttttcctcttaagcagaaaagttacattgaggatgcattttttatattgtaaatacacagggaaaaaaaaaatctttcagttctcctgcaactattagccagcaaattgttttgtcaaaaatgccatttgaaacagtgatgtccatgacaacagtcaaaattggtaaataaatacttttctcttttttatattaataatattgtactcgtcgccacataaagcatttccttgcatacttaagtggtactattgctttctttcgaaaaattgggatgtgaaactttatctattgttatgggataacaatctcttctttggggtgaaacatttatgtttcatggcaccacattacttttatcttcaaattaattgcatttgcagaaaaggaaccatatttttgaagttcgctataaactacccagaaagtttgacagcagaatgctaccattattttttattgttgtaagcaatcagtcaactgtacaaaggtgtattgtgtacagctgcaatgtaaaacctatttttgtttatgctatctgtcaaccacttaatatgctaaggtgcattctaaatgatattattccaaaggaaacaagaacactttaatgggataatgtactttctattctatactttgtgtgtgtaaggcctacccaagaaaggttcataatgtatctgtggctcttaaactttagctctatgttgaaagaagacaggctaattatggtaggctatgaagagaggaatgtacaacacctgtactgggattgaaatatatgatttttacaaattctcactcagtttagaggtaagctcagtgaggagatccttgcctatgctggaatacataggaatatggacagctaggttttatttcagatagaaactttccagaaatttcttcctgtagacatatgaaaagatatatacccaagcataatgtggcctaattactaaatgtaatacttttttaatgagaaaggcactgaaaataaactatactacagaaatagctgaaagccaagtcgttttatataaactgcattaacccaaggtaaatttacacctatagtcacattatgatgatgaagaaaaacattataaactaggttttgtactgtataagtaaagcttatcatttcatacaaggcaagactccacatctcagatataacttctgtattatcccttaatttttaagggatattacttgaatttacattggcctaatatgaatgagtccttcttcttttttttttctttatatagcctaaagaaaaccagtgttttcagtatgatagaagtgaatcccttttattctgttggtatctgaagataccaccaaatcagtgttatattctagagttccactgacttttttgctctttgtggttacaatgtttgtgtgacattatttggtccatggcatatacatatccaaacaacagtggccctgaaatacttagaagtatttcatatttcctagtctacattcttctcagtactctgaaatcatggatgtcaccattttgagtacatgactacatcttaaaatatggggtcatgtcgtagggagctgacctcatcacaaacacttctcagataatttgttacaatgaattcattgattaattatttaaatgacacttggtatttataagtgacaatttccatgcttttagaacaagagcagttaaatactgaatattgctatatttatttgttaattttactggcagtgtcctcagtagtttataattaaacatgacaggtagatttgcatggtgtctccaaatgtgcttagctatacaatagtattaatataactttgtgataacaagtaaaatgaaactgcatttttcgttctgaacaacagaactcctttttaggattttattagtaattacttcagcattaatgtgactacactataacattcgtttctaaaactgtccaaccaatgttagtgaatgtcaattatgtactagcaggacaaaacatgaagctagaatatttacaagagaatctttacctctggaataacttgtatcttgagtataacactgtaaaaatatacatgtttatctggatcattttaaaacaacagtatgattgaggagagtaaaataagttcatatgagaagaaaaattcccaaagcaaaatttgatgaaaacattaattgtattggaacacatgtaaatatgacatatattcttctgacaaaatgaatgcaagtaaattttctgtttgaaaatatattgctggattgaatgtgcagtttaggtgagagcagatagagctatgaatattaatatcacatgcatttaattgacggtacctattttgggttatagaatattattttaaaaaacatttatgttttataaagtttaatgttaatttgttcatatttataacttcagtgaataaaaataaaaatatacttttatttagattaggaagtattcaccctgaatttaattaaattttcctttaaaattatttgatattatgtaaaacattagctacaatacaaagaatgaacttttctttaagtgttgaaaaattttgttaggtaatgacagaaaaatttaaatgtgactaaaaaaattgaaaatctaataatattgactatttgggcacaggataaattgcttttgagttgttctttatttttttgagagagaagacattgttgatcagggctctaaggagaatgaacttgtttcatttctctcacctaccccgtggtctctagtagtgtaggactggtatatagagggaaagggaacatatataggaatggaaccatggctgggccaagtagcaacccagtgtctgctacagcatcataacctcaagctttggtaaaattagaggcacaatcccaccaagaatcattcctggtcttcactattatggcagtgatgaaaagcatagttttcttggagggaaaattgactgaaggtggagggtgtcagaattctttcagtctgagcccacgcttataggtactggatctgtgtatctttgcttactctcttttcagtaggtgtctacatacaggttaaaaaaatcttttcaggcaatttctagtttgactaacatttttactcagtatcgatactactacacatgtgggatccctgagagggctggctatggaataaagagatctgaaatagaattacagcttctccttacatggagttaatcacctcatcttattgcatctcagatatttcttccttacacggagactctaaagattacataaaatatcatatgacaaatttgctagtactgtgtctgaaaaatgagagattccccagattagtgactgtatctaaatttcaatgtgtagatagagtccaggacagattaagagctgagtggttctctaagaactgttgttttccctgagaggtgcatgggggcaggcgcacagagccccttcatcatctgtgaaaagtgacaaggccctctgttgggcttctgcttggttctgtgatcaaggttccacatttagccaaatcacgtgaaactggtttgagtctttcctgatagctgcaacttagacaagatttggaaaaactaggtgcttaaaaacagacaaaaagaatgaaagataacacagaaatccattcgtattttttctttttaacatagaaccttgcacgtaataaactaaatacatatttgctgaatgaatacacaaataaatgaatacataaataaatttaatatataagtcactgaaatttgaaaataagtaattctgagttcacccccacccttttattattatttttttacataaaaagtttaagggattttaagagtgaaggatactctgaaacgatagatcaatatgaacatacaggttcataagtgttgaagaagaactacttggcatagatcttcatggaatgtaccttaaagtacaagaacaaacccatatcaatacatgcttcttgcacaactttttccaccacaaattctatcatagtcagacatttattcatagaatgatctctcatttcttaattaacaaaagcatttattcagaatattttcttaaaagacatagccaggtgtttactaagtatactctttaactatttcgtgaagaagaatgtatttccagacattaccacctatgttagatttaatcaagattgctgaagtaggccaacaaaaatgtgtagctgagctgtaggcattgtgttgacctgttaacctgaatttcatttctgactacttttgtatttaaacttaaattccataacccgtatatgcacaggagattaattgagaattaccatcctacttaagaataactgtaacagaaaaatagttgttcattccaaccatcaactttttcaagatttggagcttgtctccttggaagttcttccatatagcagagtgaagaggccatttaaagtatgataccaacaggagtttgcagagatgccacttcataatgaatggtggcatctgtagaggtcttttattctctggtattcataaaaactatgcctctatatacattttaagttccaatataaatatgaaaagtttctaaatgatatttttctagtaaatataattcacataaatctcagtgattcaaaataaaactgggtgatgctaattttttttctggtataaaacctgtggattagaaaaattataacattatggggtcaccttaaactaaaaataaacatatgaggaaaataatttttatagctgccaactgatgctatcagccctcttataagtgataatgcttatgtaaaaagtatacattgaatgttcaaatttgcaaatgcatctataaagatcagaaagaattatctttgactctattaatcaaagggttttctatgaaacacagacataaaaattcatgcaagaaaatatttttatttcactatttattttcctcattgcactttgattttaaggcctcaaagaacctcattataagctaaatttaattttgtctatttttttccctaagaaagttaataatgttaggtcattattggaatatctgttttagtgttcactaggtttttttttggtagtttaataatctttttaacatgattttcacataataattattttaaataaaatgtggaatcatggtaatatatctttatttctatagtaccgcatagtctgataaaatacacttagagtaattattatactaaataaatagtaaattttatgtccagtattttctggacaataagcatttctctgagtagcatgtttatatttaagaaactttcctatgttttaaaatatgtgaccttatctttttagaaatgtatggaaaaatctttgccagcattcagctatttcaattaaaaagcacagatatacgcttcaaacatttttttctcctctgtatgttttaaaggacttataagaacaaatgtaatcagatagttaactatttattatataagaacttgagataaccactgagaaacaagaggatggtagtgtccaacttttatttacttcaaaaaataatatatcacacaatagtttttattaatgattaggactcacagatgtgttagttaaatgaagcgtctatatcatacctcatatcaatccacaatgacattataataacaaatttgcatttataaatttcataattgtgaaattattatttttctttatattgctcatttttaagaaaatgttacatttttcttagaatgaattgtaatcagcttacagtgttataattttaataacattttaacaccaaaacaattcttcctacaatacctgcatgccaatattcagtattcctgctcttttctgcatgaccatagttagatgtttctcatcaacaaaattcttttctctttttactatatctctctttctctctctgcttttctctatcttccttttcttttctgttttcttatttcccccctccacccaattcccttctttccctgccctcagttcttcactgcagagtacattgaacatattaagaacattcagttgtggttgggcttctaaccttgctcaactccagcattagcaaagggattcagtttcctgaattcattaatagtgttttgccacaaaaggctttgcagttctctcctgaatattgagcctagcttaataacattccatttatgttaaagacacatttaatctgtaaatgtgacctttagaagaattctcttgtttttcattaaagaaacactgcattacaaatattaattattccttgatgccatattttaattaactaatcatgtgctatttgcagcaataaagagtgtagtaatgtatgtgcagtaatgttatgcaatgcaagatcgatatcaaagaattcagtgctgcagaaaagacatgttttgggtatcttctttggatgagtttgcttacataaaacattaagtctagaatgatgccttgttttgctttgtgttttgtatttttaaatgccaatgcaagtctgattaaaatgctgaacatatctttagccccatcactaataagtgaacgttcactgatgcatattagcagggtctagcaatgtggtgaaattgtcacttaagtgcttggaatctgaacacagaaaatgacaggcaatgccgaaggtccggctccagtgcatgtcttcactgtagctggagtcactggaatggtgaaaccagtttaggttcaaggtcactgctgacattcagctgtcatggcttcattgtctgcaggccttctctccattgacacattcaagagtactttatagcaaccacaaagagccagtcaattgataccattacacttcatgcacacacaaaccacaagcctgttcaagactgttgatacagtctaacatttattcattaaaggatctattgaaaatgcaacttgctcagccccactcttaacaacatagacttacttgtttagtccaaacatttagctacgtctttttcaagttttgcacagcattctctaattgaggtaacattatctgcattttaatgctacaccatttatgtccaatgaaagattacctgaagaacccagccattaccatactagtttaaatacgggcagtcgtatagaaaaaatatacacaaaagatgtaagcggggggaaaaaggagatatttatttgttctgggagtgccacggaaatccaattgctcagaaatgaaataagagtctgaagtgaaaggagggaaaacctaagcttgggtcagggaagaggcagtgattagctccattgttaggagctctttgagcttcgttggttgtaaagaaaaacccactaatgaatctattgaagcttgccagaactttgtgtggaagacaacttaagttatgatgcttatctaaaaaaatggtagtaaagtatgtggatatataaaacacagcacatatgtctctttattaacagcttgcccataaaaacaaaaaaaagtttaaagatactgtgttgcacaaatgactgatttaacatgcatatgtttaattcagtatttacaggtcttgaaaaaaatcacctaactgatgataagatataagaaagtatgtcctatgatagtttaaatacggggaaacaggcagaaatagaatacagctaatctcttcttggttttctaccagtagttgcaaagaaagatgggtttaaaagtcaagtcagaaggctttttcatattttgcatattttaagtacgctgaaagcatttcattaagaaatgtaatcaactgacattaaaagtaacagactttggataaaaggaccaatatgactgtgtactgtatgtggtaaaaaatgttcatcatgcttccattctatgtagcgtttccaacatagagttgagtctttttctgcaggctgatacaatatttaattacattagctatgtaattctgtaaaatacatttcactgtctaaaataaggttatcattaatgtaagaattcaattaagtggctgtatactagaaaaaataattttgaccaatcacctggtcaagatcattgctagtagctggaaaatatatgctatataataagtagaggtagaacacattctgaatgtttgccctgagttgagttttgccaaatactttcaagtgtaagattggtgaagcaaagttcaatcaccaaataagaagaggtcaacccccactatcacacttatccatggttccatgactgtttcacaagaataagcttattacttgggaaacatgattctctacctctgaggacttgtctttaataaataaatgagtgttatgtcagtgaattcactcattttttcatgaccaagtaagcgttattcctccaaagcatactattttggggcatcaggactaactgctaagcagaattctttttttttataatgtcaaagttctctttacttttgacataccagatttccaactaagcccctgggagactttttgtggagattattgtgtagttatgaaaatgtctctttagactcatgtctacataagggaagatactgttgccacaatatgagcaacctttcttcaggtcttcattagttttcttcagtgatcaggctagcatgagcaaaggctaaccacaacaaaataaaaactagttatgtggtcatagtttttgtcaggtctaaaccatctggaatccattatagtaaggtttgttactaagaatgtctctttttctaagagattttatgtcaggagatttgactcaattttgaccaacagagaaatttgaggatgagaattgcaagaggtatatgaaaatattgagaaggtaaaggaaattaatatttaaaggatacattccagttattgtgtctggcactttacctatgttgtttttcctctgcaacaaccctatatattttgaaattattattactccattctactgatgggcaaagagaagcttctggatctttaaatttttacctgaggccataaagcaagtaaatggtaatgctgcaagttaaaccaaataccatattctcctaaagcctatactgtcctgaatacctgtttcagccaaaggacttaaaagaccttggtaaaatttagctaacattgttgatgccatttatgatgaatagtaccttctctctctttcacctttatattgcctcacttcaaattcactccctggaatgagcttccattttgcctttctttctcttcctctttcctttgctcctagagaacattgaagatctatcatcttccatatcaaacttctcccatatcagacattttcacatcagtttaataaaagtagctccactaatgagtaacagtgatctaccaattcacaattgtttcttctgtattttttttcctcagggagtatgaatataaatctgtcagtccaaaattcagggtctctctaaatgttctgtaaaatccttatgatatgttatataatctgtcaagctttcttccaaaactcttttatatcttttcattaatttaacaattttttttctaggaaattgctttggagatgaggaaacaaactcttatggtaagttaccctgtatttctactggagattccagatgaagagatatatgctaagttttatagcctgtaccatacaggccttctgcacatgtgctgtgtgtgtgtgtgtgtgtgtgtgtgtgtgtgtgtccatgtgtgtataaacttccaggtgtaccctccagactaacagctcaccatcctctgtttgcatgacttttgcatggagaaatttttggtatgcttctgatatatttcttcaagaaaaataaaagactgtttaagtgcatattatcagttaaatagcttggtcaatttttggagtattcactcatttgaatggcaaagaaattatcccctctgaaaagtagaaaggatatagtgcttttgtcacagacacatttacagtctctcataatgcaatttttctttgtccagctgtattttcaggaaccatttaaaatgaggactttaaaaaatgccttactaaaaatgtcaccaaataatattcatataataacagaaggagagagatgaccaaggcaaacaaatgacttcccttctgaaactttgctgaaactagatatagatttctccttttaatgatgtaatttggataaaaatattttgcaagtatattaaattttataagataaaattattgcagggaaattctctccatgttataatttttattttttttactattctgtactattacacagttaaagcaaatattatgtggcagggttggttaaaaagatatttaatacaaatagctaacagaaagataataaactcttttaggaaagtgaaatatgcttttaagatatgctttcagttaatttataatctagaagggggcttatttgacgattgtaccctataattagtgagatcagtaatcaagacaactgtgatttattttaccaggagacctaagagactgaagacatctggcgtggactactctgatggtaaaattgaaagtacacctaaatttgctttgttacaggattctcttcagaggacaagagaagatgttacattctctgcatgaggacaattctgcagcatcaaaatcgaataatatttgttttctggcagcagaattttgtatcatatttctaaagacagtaagcacttgggtggacgtcaatgaatactaaacactaattgatctgatacagccgtatgcacatacacagatatacatggtggcttgtaatggttgaaaaattacggtttggttttattaaaagatctgtcacttttagg

SEQ ID NO: 2 - DNA, 2369 bp, Homo sapiens
aagtgcgcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggtgagtcacttccgaggggagcgagttgttccagagagtcagaaaggtttctgtgcagcaggagctggcgtgctctatgctcacgaacaccgaagggtatctttggggagggagattgttgtgcctattttatgggtgttgaaactgaggcccatagaagttggatgatttgcccaaaacaacaaactaagaagagggaccttgggctgagggtggttgactcttgacatctctcctccacaaccaggttagcgaccccgagagtacagtggctgtggctttcacaccaaccattccgcactgcagcatggccacccttattggtctgtccatcaaggtcaagcttctgcgctcccttcctcagcgtttcaaggtcagttggagctgagccccgggagtgagaccaggcattgagggtctactgctgaggatggggactgggagagcatgaacatggataggacatcagagtggggcctggaaggatccccattagcagagaggaaactgggaggaagctttccaagtcgatgtgacaagaataaagatctgagctggaaagtggagaaaagtattgaagagtgtggcaggaagggcagtagggagcggcagatgggtttggaccaggggtggggcacaggcaggcctttaaatcaacagtagtgggccagttctttggatagaattggaatagctagggccgggcgcggtggctcacgcctgtaatcccagcactttgggaggctgaggcgggtggatcatctgaggttaggagttggagaccagcctggccaacatggtgaaatctcatctctactaaaaatacaaaaattagtggggcgtggtggtgtgtgcctgtggtcccagctacacgggtggctgaggaaggagaatcaaattgaacctgggagacagaggttgcagtgagccgagattgcgctgctgcactccagcctgggcaacagagcaagactcagtcttggaaaaaaaaaaagaattggaatacctgtggatgggtttggggtgtaacggaagggccagagtccaaaggcatgattaggaggaaggatcagctggagatggtgcctgagggtctgggggctgcagggaaaagtgtgggtcggtgggtgggtgttcaggccctggttatctccctcccagatggacgtgcacattactccggggacccatgcctcagagcatgcaggtaagtgtggactggtggtgagggtgttggcccgggcaccccctaagcagtctgaggcttcccccttgcacaggagtctatgggcaagactggagatgggtaactgtgtgagtgaaattgccagagactcctcagtatgggttatagcctagaccgaagctggcctgagaagactctcctttgcttaccatgtcctcttctcccaaatcccctctcaccaaatatacaggaccagagtgtgtcaggcttcagcagcgcaggaggcagccagggggagggatcctaagaaggcagattaggtgggctcaggtggttgaagtagcctgatcaatatgtggggtcctgggaaggaggtgacaggagggctctgttgctgcgggggacatatcctatatagaggttcagaggtagggctggctagcactctggccagagcctagctttgactctgccttccccacacccttcttcccacctagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagttcccagca

SEQ ID NO: 3 - DNA, 171 bp, Homo sapiens
attaaaccagtactatagcaggttggaaactggtcttaccatctgtcactttctatactggcagtttcacaaatgagatctctttttggcaaaacatcacagcaggagatacagacatgtgaattgtaattaaaatgtgaaaaatgcatttcctagtttttgtcatttata

SEQ ID NO: 4 - DNA, 4165 bp, Homo sapiens
aaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttccttgggagcaccagcttccagcggcggggagagaaggagctcctgtgggagagggggcaggatgtgagtaggtcggtgctggctatgcgagcaatcctccctccaagcctgagcaagtcggtacattttcccccgctgcctcattcctgtaccttggttgccctcctcagcctgggtttgcaggaccccctcggctgcagggcgcctgccacaaagccgaccccggcaggagccactctctctgctagttcgctgcctcggccctgctctccctcagcctctcttcttctctcctggcctcttttctggggcatcctgggtggagtgtttttcttgggatcacgagcttgcactcgcacacaggcccgcagacacacaggcccggcggccgcccttctccgcttactgttcccggctccccgcaggccgggtgctcgcagccgggctggctatgcctcgcctggcagcccagagcgccgctccccgggaacagcacacaaaggcagcctcccctggcctctagcccttaggcttctgtagctcagttctttccccacacccctcccccaagaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgactaaacgccttctaacttaatgctttcggacggggatccccggcaaataacgtaagaggatttttatttgtgcatgtgttcctgcaattgatctctttgatgacattctcattcatagaaagcgtttgatttatgagcgtaggacgaatcgcatccaggagctgcgcagccctggccgctgccgggacgccctgctccgcgctgagcttggggccagaaaccagccatagtccccacactccgccgccgcagctgagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtaagtaagtaggcatcagaagagagctcagaaagggaaaaataaacatggggagacctaacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatcctagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaaga

SEQ ID NO: 5 - DNA, 498 bp, Homo sapiens
atggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacaggtcctggcatcttgtccatggcaaatgctggacccaacacaaatggatcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataa

SEQ ID NO: 6 - DNA, 25426 bp, Homo sapiens
agtgtccatgatagtgaatccattttggttgtgttggatttgaggtggcaaagaaataaggaactggcatgtgactgcgggaaattggagctacaagacaggagttcaggtgaaaagataggactaggtatgtagctattggagtgggggacttcggcgcacagatgatagggttttttgtttgtttgtttgtgagggtttttttgtttgtttgtttgtttgtttgtttggagagagggtcttgctctgtaaccctggctggagtatagtggcatgatcatagctctctgcagccttgacctcccaggctcaagagatcgtctcacctcagcttcttgagtagctgatactacaggtgtatgtcaccactcccagccaattttttaaacatttttttagagactgggggtctcactgtgttgcccaggctggtctcaaattcctgggctcaaatgatcctgctgcctcagcctcccaaagttttgggattataggtgtgagccatggcgcaggcctagatgatagtttaaacaagagggaatttgtatatttgtcactttgggggttgctggtggcctttgaaggaagagtttcacagcaggacagagtacaaaaccatatggtgacgtgaggtctagtaatgctttccacagttaatgtccttccattctgactaactcttaacacctctagggtactttctccttcgacttatgtgctgctcattctggcttgtcctctgtgttctggttattttttgttgtccaacaaattgcctcaaaattttgtggcatgagacaaccctttattacgttcacggattctgtgggccaggaatttggacacaccgcagtggggatggcttgtctctgctccatgttatctggggctgcagctggaagactcgaaagctgggggactgaaatcgtctgcagacactttgcagtggatgctggcagttagctcagggacctcagggtttctacctgtggtctagttagagtttctcttgcatagtggctgggttgctgtgagggaaccaggcatgaactgctttttttttttttgaggcggagtttcactcttgttgcccaggctggagtgcagtggtgcagtcatggttcactgcagccttgactacccaggcttaagtgatcctcctgcctcagtctccctggtagctggggctactgccaacatgcctggctgatttttgtattattattatcattattttgtagagacagggtctcactatgttgcccaggctggtctccaactcctgggctcaagcaatctgtccatctcagcctcctaaagtattgggattacaggtgtgagccactgtgcccagctgcattctttttataacctcatctttttttgatctgcatcacctccctcctaccctattggtcagagtagtcacagccccgctcccattcaaagagagggaacatggcccctacctggagtgtcagtcatgggacaaggagagcaagtggaaaggggcacccaactttggaaaataccatcggccacactctatcggagcctccatttgctttttatgagtggccttcatttatttagctgtcattgggtcaacaataacagcaacttgaggaacctcttgagggcagggatcaggcctgttacgtttgtttactttatctttatatcctgagcattggcccaggaataagtatctgtggaaggacgggatccttctaagtctctcatctatttttcatacacggcatcatttaattctaaactagctgtcattaccatttcacaattgaagaaactgaggcttagaggcgcaaatggtctctctcagatgactcaggtcttctgggttgatgtggcttttattaagaacttgttgtctccaacagcaaatagcattcctaggggctggggctgtttcttcaaggcccctgcctctgcaccctggtagcagcacaggcctagctgtagggctgtggacagcgtgccctcggctgcttactgactggttggcatttgatacatatgatgatttaacatgaagatttagtgtgattttgcatctcttcatgggagcagggtcaggaccaggtcctgttgcggaattcagctttggggctgggtagaagactgggatgaagttgctcctcatctctgtgccctggctatgagcaggcagcacctgggtcaggagtgtgaggtgagtgggtgatgctaaggagggttcaggtggagcagtcagactgtgctgagtaactcccctggaggggaagggggacgtggtggaggcagttcctggaggcccagctcagagcggagaaaggagccaattaccacctcctcccaagtcacatcccagccctgggaatacttcacaggctccggggaaatcccggccaagtggcagagtgggtggtggggtgcttatcactcatgatcaggagtgggtgggggcggatcttagagcttgcatcaggcctcaattttccaactcctgcctgtgatccacccccgcgcccactgcacaccaccaaccaacctttgactttatctctttagttgatttctcagagattgcagatcaggaagggcctttggaaaccacagcttccacttccgctgtgggggcagaaagcacgggacaatctaaccctttcgtgcctggaaagtaacaaggaggactctgcccttaccaggttcccaaggtcctgtaccagccccacagggactgctgaggggagctttttctctctggttcctcatcctctcctctactcaggtgtaggctgtccctgcctagttggtctgacagtagctccctgcgacttctcatatcacctccgactccccagcctcacctccacgggccctgatgcactggcttcggctgtgtcttttgtgagtcatccttgctgctttgttccagccccactgatgggcctcctgccctcccccatgcaggacttagtcaccgctcgtgtcatcaatccctctggaatgcacccctcctccagacacccatgctccccacatcctttattattttgttaaaactagcaatgccccccccaacccccatgattaaaatagtacatgtttgttgtgggaaatctgtaatatgcaaaatatacacaaaagagaataaaaagcaccaataattccataacccaaattagctaacattacattccggtggatttccatctggcattctcctcgccagaactccgtccagcttcaggccttcatgtgtgcttattgcttcttttacctgcagtcatgctctctgtctctcccctccttcaatctgtgagcaaatctactcatccttattattttaagggtcattctttcagagaaaccttccctctacccccaagctagtctctttattacacactcacaatacccagtacttttccttgtagcactcaccacaactagaaataaatcatcatttttgtcctcttgtgtttaatgtctgcctagctacctgacgtaaggtctgtgactggttttcttgtttactctgatggccctagcacccatcacagtgccctgtactcagaaaacatacatcatacccagatgccttcccggaataaccatgtgcctgtcttcccagcacttacaataatcaatttaacaaatataattaatcaattactatgtgcctggcttggtttcaggtacaggataccaagcaaaatgacccagttcttaccctcgaggaggtctcagtcttttgagggagacagatcagtaatggaagctttctaatgtacagctaagtaaacggtgatcaatagtgttaggtaaagtgtggaggagaggtccgtgaacaatcctggggagatgacaccattgttttatcttgttaatgcatttacttcacagaatcacaggataatggaattggacggcaccatgagatcagcaggcccatctcttcctgtacagatgaggaaactaaagtggtgaagggtagtgaagccacttagccaaagccattgggtgacagatctgggaatagaacttggatctttagattcccagcccagggctctttccactgtacctgggggcctttggactccccctcccctctcctcttattctgttaatccccaagtcctttgattttccccatgaaggtctctccaatctctccacttttcctcatccccacatcaccaggctctaagcctccaacatcatctccagcctgagcacctaccctcacctcctacctcatctctctgcttctagtcttgccctgctcagatgccttctccactctgccgccaaaatgagcctcacagatgtacgcatgtctgtccctggcttagaactccagtggcttcccaccaggcttttagaaatatactcaaaattcttatatggtgtattagtcagctcaggctgccataacaaaatatcctagacggggtggcttaaacaacagaagtttatttctcacagttctggaagctgagaagtccaagaccaaagtgctggcaaggtcagctttattcagactttcagagtcctcttttctttctttcttttattttattttattttatttttttattttttttgagacagcatcctgctctgttgcccaggctggagtgcaatggcgtgatctcgggttcaagtgattctcctgcctcagcctcccgagtagctgtgactgcaggtgcccgccaccacacccagctaatttgatacttttaatagagacggggtttcaccatgttggccaggatggtctcgatctcttgaccttgtgatctgcctgcctcggcctcccaaagtgctgggattacaggcgtaagccaccacgcctggcctctttctttctctttttttttttttttttgagacagagagagtcttgctctgtcacccaggctagagtgcaatggcatgatctcggctcactgcaaactctgcctcccaggttcaagtgattctcctgtctcagcttcctgagtagctgggattacaggcgcccaccaccatgcctggctaatttttgatttttagtagagacggggtttcaccatgttggccaggctgttctcaaactcttgatctcaggtgatccaccctcctcagcctcccaaagtgctgggattacaggtgtgagccaccgcacctggcccagagtcctctttacttcgttgtaggtggccgccattttgctctgtactcacatggcctcttcgtgcatgtggggagagagagctctcttgtgcatcctgttccttttataagaacaccagtcccatcagattagggcctcacccttaggacctcatttaacctgaatcacctaaaaaccctatctccaaatatagtcgcattgagagttaggggttcaacatacgaatttggggggacacaattcattccatagtgtagggtccactgggccttttttggttgagcccaccttaccagcctcttctaaacccaactcacctctctgtctgtacgcttttatatcttggaatttttttggttcctccgacttgtctggatctcttgtagctcaggttccccctccccctgctctgatgtttttatattttcatcattttcaagtctcagtttgaacattagcttctaggagaggccttccctgatctgcatcctgtgttaggtcctctggctatacatgcctatggtaccctgaactccaccttgtgtaagagtcaccacctcagtcctgtgtgtttcatatctgtccttctgagctccacaaggcaggaagatctctgtctggttggttgcagtatccccagggctagcacagtgcctggtgcctactaagcagtcaagattaacttttactggtagatgctcaatacatttccattgacctgagctgtcctcagagagtatatgtattttgttgtctaatttgggttgaaatctctcagaagggtcctatctgttccttacttgaaatctcctatcccgtgcccatcctgggctccttcattcaggaaacattcccataaatgattattaactgatctccctacaactttcccaacatgtatcacatttgaaggaacaatcatatttaaaagaatatgttacatagcaggacagtttattatgaatgtcatgtaacaacaatctactgagaattaaaaagaaactaaagtgttcctctcctctcccacctctgggcaaccaggacttcatttctttgaaattgtggatttcctgacccctgaggtgtttggctttttgtgtatgttttagaaggaacagaaagaatcaggctgggtggggctgtaaaggaaacccaccctaagcaggcctcgttttggaagagctggaaagatacctgtggtgccagatggtatgagagtacagggtgtgagggcaggagcctacttcttggttgactcttagacttccatggactcatggaaaagagaaggggtgcaggctgggcacaatagctcatacctgtaatcccagcactctgggaggccgaggtgggcagatcacttgaggtcaggagtttgagactagcctagccaacatggtgaaaccccgtctctactaaaaatacaaaaattagctgggcgtggtggtgggtgcctgtaatctcagctactcgggaggctgaggcaagagaatcgcttgaacctgggaggcggaggttgcagtgagctgaagtcattccactgcactccagcctgggcaacaagagcaagactctgtctcaaaaaaaaaaaaaatcagaatggtggttagtttggagtgaggtgggcaggaaagagggtgctacatattgactgcaagggaaacaagggagactcctgggttgaagctatcttgtctagatggtggttaaatgggtaaatataaatgtaaaagctcatcggtttgtttcctgctgatagccaattagttaattaatttaatttaaaaaaactaattggggccaggtacaccggctcattcctgtaatcccagcactttaggagactgaggcaggaggattgcttgagcccagatgttcaagaccagtctgggcaacatggtgaaaccctgtctctgcaaaaaatacaaaaattatctgggcatagtggtgcacgcctgtaatcctagctgctcaggctgaggcagaaggatcacttgagcccaggaggttgaagctgcagtgaaccattatcatgccactactccagcctgggcaacacagtgaaaccttgcttaaaaaaagaaaagaaaaggaaaaggagaaaaacatcaaactgcatacatttttaaaatgaaaaaaggaaacaaattactgacacatgcaatgacttggatgaatctcaaaggcattacgctgagtgaaaaaagttctcaaaagttacagactgtatgattccatttatgtgacacttttgaaaagataaaacgatagcaacagagactagatcaaaatagcaaaatagcagggagtttgtcgggggcaggaaagaggatgggactacaaaggggtagcccgagggagtgttttaggcagtggagctattctgtttcagtggtggtgattacatgatcgattgtggtgattacatgaatctttacacatgtgaaactcataggactgtccactgaaaaaaatcaattttactttatgttaatttttaaaataaaattatttttaattaagaagagaccttctagcccctcaatagcgcagaggagttcctgaaaggaggcgctaaggaactggctaccctggaaaaggcataccaccttccccgccttgccctgtaccaggcctggggatcttcctgggccctctgtggttctcactctccttccttgtcctcctgctgggccagagtgacccacacatcccctcctttagcatctaagtctcggggtctaggaagccagtgtgctttgctcactcctacgtccccggtccctgagacacaggtacgaggtggttgctcattgacagagtgaaggaatgttctagcaccaggcctgatccgtcttggcacactccacaggcttttctatgtttagcctcctttccagctgcccagaggacacgccatagctgggagacatcactgtcgaggtgtgggtcacaagcttacccctcccatgaggcagggttaccagctttcctatcgtttgaagaatttagcaatctgagtttattattgctgtcattctaattttgaaatacatttttattatacaagaaaatctgttcaattaaaaaaaaaacagttaaaaaaaaagggagatccggtcccacttcccagactcataactgttactagatccttctctatctatctagaaacatttatgtgaaggtaggcatgtatgtccacatatatgcaacagatatgattgccccacagctcctgggctacaagtaatgtcttgtttctttgtggactcactcaaatagactctgggtccagccctgcccaccactgactggaactccagtgtcagacagttttcaggctccctccctcaggtcatacaagatgcccagactgatgcagtactgatgaaacggaagagtctgttcctctggccacatggtcagcacttgccagctgcttgcccaggtcagtggggaccattatgagtcaggctgctggtggggtgtggtggctcacgcctgtaatcccagcactttgggaggccaaggtgggtggatcacctgaggacaggaactcctgacctaagtgatctgctctccttggcctcccaaagtgttgagattacaggcgtgagccactgcgcctggcctattctgacttctgttaccataaattggttttgtctggaaggtttctaacaattgtggtgcaagttttataacccacctggttttgtcttgggaattagaagtctctcaatgttttggagagagattctgatgcccctcaccagaagtcatgctctggggccagtgagcaaagatgagcttcttatcctttttcttcctgggttccagcaagccaagcctcacagcagtgtccaaaaagttggtagaaaaggcctaatttttttttttttttttcaggcagagtctggctctgtcgcccaggctggagtgcagtggcgcgatctcggttcactgcaagctccgcctcccgtgttcccgccattctcctgcctcagcctccctagtagctgggactacaggcgtctgccaccgcgcccggctaattttttttgtattttttagtagagacggggtttcactgtgttagccaggatggtctcgatctcctgatctcgtgatcctcccgccttggcctcccaaagtgctgggattacaggcgtgagacaccgtgctcggcctttttttttttttttttttgagacagagtcttggtctgttgccgaggctggagtgcagtggcaccatctcagctcactgcaacctctgcctcctgggttcaagtgattctccggcctcagtctcccaagtagctgggattacaggcacacaccacctcgccagctaattttttgtagttttagtagagatagggtttagccatgttggccaggctggtctcgaactcctggcctcaagtgatccgcccacctcagcctcctaaagtgctggtattacaggcatgagccactgtgcctggccaggcctagcatcttaaaaacccagtggaggggaaggtcacagtcctaggaatcaaaaggcatgggttcacttcctctctctgatatttgctgcatgttcttgaacaaactatgtaaacttcttgagcctcagctatttcatcagtaaagtgggaacagtaacatccactgtgattatcagacctatttttaaatacttgaggccctctttccttcaaagggtgtaagaaaattgaactttgccactccatttaactcctacccactaatccaggcgtggctacgtgacttactgaggccaattaaaatggtgccttctaggtggaagttttaaaagctagtgtatgcttttccacatttttttttctccttcaactatagtaattggtgatattccacatagtggctgctctgtcaacctgggtcctggagttaggacaatgacagctcagagcagagcctcggccaacccaccatggatatgtggcaggagagtcaatgaagctttgctgcataaaagccattgagatttgggggttgtttgttactgaagcataacctagcctgcttggttgatataccacattacacatttattactaagattatgtgaagtaaaatgtttggaacttcttggtacataataaagctgattttcttcctttcagactctccttttttctttctaagagtcatgaacccagggatacttttttttttgagacagaatcttgctctgttacccaggctggcgtgcagtggcgtgatcatagctcactgcaggcttcccctcctgatcttaagtaatcctctcccacctcagccttccgagtagctgggattgcagacataccctgccatacccagctgatttttttattttttgcagagacagggtcccactatgttgcccaggctggtcttgaactactgggctcaagtgatccccctgccttggcctgccagagtgctggattacaggcatgagccaccgcacctggcccccaggaatgttcttaccagcttctaaccctggctaaagggcaatagaacagagagccactcaaccacaaaagaaaaaggaagaagaaaggatataaagcaacaaaggtacagaaatgtaatacagaggaaaggaaaagaaacaaagtgataaagaaggcgagacaaagtataaaaacagggaagaaagaggtacagagggccaggcagggtggctcacgcctataatcccagcaatttgggaggcccagtcagatggatcacctgaggtcaggagtgcaagaccagcctggccaacatgctgaaaccccgtctctactaaaaatacaaaaattagttggccttagtggtgcaggcctgtaatcccagctacttgggtggctgaggcatgaggatcgcttggaactgggaagcagaggttgcagtgaggtgagagtgcgccactgcactccagcctgggccacagagtgagattctgtctcaaaaaataaaaaataaataaataaataaaaataaaaaaaaacaaaacaaaacaaaacaaaaaaacaggtataagggatgtctgaggcatagacagaggtgattctcagaaaaacaaaagaaaacaaaaggaaaaaccactgaggcaaagggaaactgtatttcttggaattgttggccccaaccccaggcaaacaacattttcccttaagacaaatgaacaaacaaactttggcaaatagagcttctgggtgtgcatttatcagtctttccactcggtttactgggcgcctactctgtgcctgacattgtgcttgggctggctttacaggggcaaccaagacctagtgctggcctctgccttcaaggagcccctagactggtgtgaaacagacacaagaacagttgggattcaatctggcttgtgcaatgatggaagtgccaggaggaattaagggaagagaaggggaagcaggccctgcaaaggggctttctggaaaatttgagcctgagtgtcttgaaggataactaggagttagcaatggcaaggtttctgaggagaaagagggaccacgatgggcagaggggcaataggagccaggtagctgcaggtagtctggggttgctggacccttgatgagaggctgtgggcagcaggagatgaggctggagagggattcagggtcctatcacagagactcaaatgttaagatgttggtctttaagtggatgggctcggggatatttgggctgttatgtggggaagtgacatggtcagatttttagctaaattgctctgcctgccatgtggacagtgtgttggggcagcatttctttgcatgaggtctctggggattgggctgaatacccacccagcccagggcctgcaagtggacaggatggcctctggaagaatcatcctagccgctgcttcatcagtgtctcaggggagtgatggctatctgcggtggtggcgttggggtaaaagaatttaccagccgggcgtagtggctcacgcccataatcccagcactttgggaggccgaggcgggtggatcacctaaggtcaggagtttgagaccagcctggccaacatggtaaaactctgtctctactaaaaatacaaaagttagccgggcgcggtggtgggtgcttgtaatctaatctcagctactcgagaggctgaggcaggagaattgcttgaacctgggaggcggagcttgcagtgagccgagattgcgccacggcactccagcctgggtgacagagtgagactccatctcaaaaaaagaaaaaaaaaatttaccaaggcagttgtaggtagagaaaggcagatttattacagtaattaggaaaacgccagggttgcagggaggtaacttgcatttttttgtcagctgggatgtctggaaagttgaagtgtttgatggtaagcaggaagtttgtgagttctgctatctgagtaggagctggggcttgtaaagcagccaacagttgagcctgccttttggctccgtgtttgtttttttcttagtcttgtcctccttattttgttcttggttataaagactgaggaggctaatttggtaattttctgcataggggtcatgctgtgttatacaagaaaattagatgtttctttttgagagtttggcggtagaatttgtcacaattctttacagcctagaggcaagtttgcaggaacggacggggtttgctccatggtgggactggaaaacatgccgctctggggcaatgtcaatcagggacatgaactgcacttttctgcggggggcatctcactgagatgaacagagggttccacttacatccacagagggacttggatgcactttccaaagggggcatcccaccaattagaaaagacctcctggccgctcaggggcctcatgctggatggccagtccaggcactcacttatgctgggtgatcagcccaggcacgaggaaaaagaagggtaaaggaagatctctacctggtcttggcccaggaggtggggtgggtaagagaagactcaccgttctgaggctgtctgacatcacctgatttagcaaggcccaggacaggatggctggctgactccataggtgaatttagagtgagaaagagagcgtctgagttacctaaaacgtgtgtgagtttgccccgaacaagcttctgctgtcaattgtgtcacatatagggatgagggacttgcaattagagaagatgggcaacagcctttctcccttccaggcagggcagctagccctgttcactctgggccttcaggcaacactggagagtggccctggccagttacctttgattgccagagagatactagaagctggttgctgaaagactgaaaaaagaaaaaaagtcaggtcactcacccaaaccaggcaatgatgatcagatgcttccacatggacagacacctttcagtctcactggagtgtagctctggccagagacctgcaattgtctttgtgcttagatgctgtccttcgagggtcccgagttgggaaagggaaaggagagagagtccctgtatggagagggagagttccctgtatgggccaccaaaatgtttcaggggagcaacggctatctgggctggcggctcaggggtaagagaatttaccaagacagttgtaggtagagaaaggcaaatttattagagaaagtagaaaaacaggagagcaatgggcaggagagcaacgggcaggccagcagaagaggagctgactgcaaggaaacaaaggcttgttggggattttgtaggatggctcttaggctgtagagtgttatgtgcagtactgattatgccagggtagcagggaggtaacttgcatttttttttttttttttttgtcagccagggtgtttgataaattgaggtgtttgatggtaagcagaagtttttgagttatgtacattatctgagcaggagggccatatgtcttgggccatttgcctcatttctttgctttcccctggtcccaccagcctgatttgttttttaattattactcaacagtgagtgctgtcacatgctgggcattgtgctatgtgctctatgtggagtaactcacttactgtccccctatcccccaagaccatcctgtgacatgggcattcttttttttttgagatggagtcttgctctgtcaccaggctggagtgcagaggtgtgatcttggctcactgcaacctccgccttacgggttcaagcgattcttctgcctcagcctcctgagtagctgggactacaggtgcgtgccaccacgcccaattaatttttgtgtttttagtagagacgggttttcaccacgttggccaggatggtctcaatctcttgacctggtgatccacctacctcagcctcccaaagtcctgggattacaggcgtgagccaccacacccgaccagacatgggcattcttatcctcattttgactgagtaactgggcacagagaggctgttatgcatcccaattgcagagctaggcagcggcaagcccactttcacacagcgccagctgcctggctctgggatcagcctgtagtcactctccattctgcccctcaggatctgcttctcccaggaagcctctcacagaggcagaattttgcattggcatcctgcttcaagcttatgaaatcttctatacagatgacctcattccagccttgcaataatagcttctgtgaggtattattattcatagctttaaaaaagccagttgaaggaaatccagtgatttgtcaaaggtcagaagttaggtggccgctctcctgctcagacttacgttttctgacttggagtacagtgctccgctctcacgttatctgtcagctgacgctgcagccagcctcatactcaacacatcacatggttcgaaggctaggccactttccactactattgagctgcctcctctctatgaaaatgcttttctggattgagggagacagtcatagagaaatgtgttgttggcatcgatttcctatggttgggcaatggcttccgccatctggaccaggtgacgtcagctatctggatttctgccagcattccccggcccaggaaacagacttccggctgtctgggctctgagccatcttcggcctcctgggtgagtgggtcttgcaattcgcaaagtgaggaactgaaaagtcagctctcagggaagatttcactgtataaagtcaggtaaaaatggggaagaggcatactgggtcagagagacagggagcccttctatctgagtctggggcctttctcagatgagaggggaggatctagtgatcagacagggaaattgaagatctttgtgactaagactcaagtcaattgggggtagatgaggagtaaggtaagcaaagctaaagaaatctggggaaagatacacataaagatacaaacacagaaggtcaaatactggccaaggatagaatgttgatcccaaaactcatgcacttttctgtggacactgagacttgaacaaatcaataacttgagaatgtaagcagccctctgccatgttatactttgttgagttatataacagttgggggaaaacctaaacaatggtacatgtgttaaggtagacagttaaattgtccctccaccactccctgtctcattcccaaccctgctctccaggccaggctcataaaagttgttactcattttagccattccttcagccaatattcatcttattcattcttacaatcaccctgtgaggtaagagctatcattatgcctttattttgaaaattgtagtaaaatagacatagaatttagcattttaactgtttgtaaacatacagttcagtggcattaggtacatccacattattgtgcaaccatcaccatcagccacattcagaactttttcatcttcccccactgaaactccacccagcaaacaataccttcacattccccactttccttagccctggcaaccaccattctactttctgtagaatgtaaccactttagatgccttttattttattttttatttatttgtttttttgagacggagtctttctctgtcaccaagccagagtgctgtggcacgatcctggctcactgcaacctctgcctcctgggttctagtgattctcctgccccagcttcccgagtagctgggattacaggaacacgccaccacgcccagctaatttttgtatttttagtagagacggggtttcaccatgttggccaggatgtaggtgccttttataagtggaataataggctgggcgcgatggctcacacgtgtaatcccagcactttgggagaccaagtctgatggatcacttgaggtcaggagttcgagaccagcctgtccaacatggcaaaaccccatctctactaaaaatacaaaaattagctgggcatgctgccgtgtgcctgtaatcccagctacttgggagactgaggcacaagaattgcctgaacgcgggaggcagaggttgcagtgagctgagctcacgctactgcactccagcaagattctgtcttaaaaaaagtggaatcggccaggcatggtggctcacgagtgtaatcccagcactttgggaggccgaagtgggcggatcacctgaggtcaggaattcaagaccagcctggccaacattgcgaaaccccgtctctacttaaaatacaaaaattagctgggcgtggtggtgggcgcctgtaatcccagctacttgagaagctgaggcagaagaatcgcttgaacccaggaggcgagtttgtggtgagccgagatcgctccagcctgggtgacagagcaaaactctgtctaaaaaaaaaaaaaaaggtggaatcataaaatatttttcctcttgtgattggcttttttttttttttgagatggacttttgttcttgttgcccaggctggagtgcaatggcacaatcttggctcaccgcaacctttgcctcccaggttcaagctattctcctgcctcagcctcccgagtagctgggattataggcatgcaccaacacactgggctaattttttgtatttttggtagagacagggtttctccatgttggtcaggctggtctcaaactcctgacctcaggtgatccacccgcctcagcctcccaaagtgctaggattacaggcatgaggcaccacgcccgatcatgattggcttttatttcacttagcaggatgtcttcaaggtttatccacattgtagtgcatatcagaattttctttttaaaaaaatattccattatatgtatatatgtattatacaattttttttttttttttgggtggagacagagtctccttctgttgcccaggctggaatgcagtggtgcgatctcagcccactgcaacctcagtctccctggctcaagtcaacctctcaccaccttagtcccctgagtagctgggactacaggtatgcaccaccatgcctggctaatttttgtgtttttggtagagatgaggtctcatcaagttgcccaggctggtctcgaactcctaggttcaagcaatcctcccacctcagcctcccaaagtgcttggattacaggtgtgagctaccaggcctggccacattttgcttattcattcatctattgatggacacttggatggcttccaccttttggctattgtgaatgatgctgctgtgaatgtgggtatacaatttaataacatttatattgagatacaattcacatactatataattcaccttgtaagaggtggaggttgcagtgtggtgagccgagatcatgctcctgcactccagcctggggggtacaaagtgagacgccatctcaaaaaaaaaaaaaatccaccctttaaaaatgtacaatgaaatgtgttttttttttttttttttttgagacagagtctcactctattgcccaggttggagtgcagtggctcagtcttggctcactgctacctctgccgccctggttcaagcgacactcctgctcagaccagagtagctaggattataggctcctgccaccgtgcccggctaatttttgtatttttagtagagatggggtttcaccatcttggccaggctggtcttgaactcctgaccacgtgatccacccacctcggcctcccaaagtgctgggattacaggcgtgagccgccgcacccggcagaaatggtttttagtatattcacagagttgtgcaaccatcaccacaattttagaacattttcatcacactcaaagacgtcccatgctcattagcagtcatttccggttttacccccaatctctccccttcccagccttaagcaaccactaatctactttttgtctctatagatttgcctacactggacatttcatataaacaatcatacaatatgtggcattttatgtctggcttctttcacttagcatagtgttttcagtgttgtagcatgaatcagtactttctttttattgttgaatactatttcattgtatggatataccatattttatttatacattcatcagttgatggacatttatactgtttccaaattttagctattatgaataatgctagtgtgaacattcatgtataagattttgtgtggacatccattttctctttggtatacacttaggagtggaatttcgaggtcattaactttatgttccacttttgagaactgctttccaatgttgctgagccatttgacattctcaccagcagtgtatgaaggttccagtttctccagtctgtctttttgattctagccatcttagtgggtatgaagtggtatttcatggtggtttagatttgcattttcttggtggttaatgatgttgaatatctttttttttttttttttgagatggagtctcgctctgtcgcccaggctggaatgcagtggcacgatctcagctcactgcaacttctgcctcctgggttcaagcgattctcctgcctcagtttcctgagtagctgggactacaggtgtgcaccaccactcctggctatttttttatatttttactagagatagggtttcagcatgttggccaggctggtctcaaactcctgacctcaagtgatccgcccacctcggcctcccaaagtgctgagtcaccgcgcctggcctgaacgtcttctcatgtgcttattggtcatttgtatacctttggagaaatgtttattcagatcctttgcgtattttttaattgagttgtctttttattattgagttgtaagagtttgttataaattctaaatataagtctcttaactgatacataatttacaaatattttatcccattctatgggtcttttttacctgtttctttctttctttcttttcttttttttttttttttttaatagcgacagggtctcgctttgttgcctaggctgatctcgaactcttgggctcaagcaatcctcctggcttggcctcccaaagtgcttgggctacaggcatgggccaccatgcccagcctattttcttaatgtcctttgaagcacaaaagttttaaattttgaagtccaatttatctatttttttttcctgcttgtgcactgtgtcatagctaagaaaccactgcctagtctgtggtcacaaagatttacatctgtcttttcttctaagaatttaatagttttatctcttccatgtaggtctttgatctattttgaataaatttttgtctatggtatgaggtaagggtccaacttcattcttttgcatgtgcatatccagtggtctcagcattagtatgccttgttacggaggaataaattttcagcttcgtaagaaaaggaccatgggcctggcaaggttgcttatgcctgtaatcccagcactttgggaggccaaggtgggagcatcacttgagccctggagttcgagaccagcctgggcattagagtgagaccccgtctctacttaaaaaagaaaaggaaagaaaagaaaaaggactgtgcccggttttgctcaccattatcttcccaggattctcttagccccatgcaagacacatgctacatgctcaataaatatagcctgagtgagtgaacatatgagtgactgagactcagtgtggttaaataacttgcataggtcagtcagttggaaggtggccagatatggctcaaacccagatcttctcatctaattcttttttttttttttgagatggagtcttgtcgtcaggctggagtgcagtggcatgatctcggctcactgcaacctccacctcccaggttgaagcgattctcctgcctcagcctcctgagtagctgggactacaggcgcgcaccaccacgcccagctaacttttgtgtttttagtagagacagggtttcaccatgttggccaggatggtctcgatatcttgacctcatgatccgcctgcctcggcctcccaaagcgttgggattacaggcatgagccactgcacctggccttctcatctaattctaattaagagtttttgtataatacttcaaagtttctgaaaatttcctgagttaccaaaagctctttgtcacaagaaaccatatttcttaggctgggggtggtgctcacgcctgtaatcctaacactttgggaggctgaggtgggtggaatacctgaggtcaggagttcgagaccagcctggccacatggtgaaaccctgtctctactaaaagtacaaaaattagccgggcgtggtggcaagcacctgtaatcccagctactggggaggctgaggcagggaatcgcttgaacccgggggcagaggttgcagtgagccgagatcatgccacttcactccagcctgggcaaaagagtgagactccgtctcaaaaaaataaaataaaataaaataaaataaaataaaaataaaaataaaaataaaaaataaaaagaaacggtatttctccaaagtttcatttgctgtctctgctgtatgatcccaatcatttcattgtttgtgagcagcaaaactcaaatctagggagcctcatgtcccttctgcttctgactcctccctcactcgagccacagagtcaaagattccacttccttctagggtagttttatagttggaaagttcttctaaatctcggaccacaacctcctgctgcaaaattgtgccataaatccccatgagtgttcagtgtaaccattgactataggacctggtttgatgtgggaggcatttggggcttgcggaaagctttatgtgctctgccccgtacaaagggcagccttggggcagccgatgcccttgctctggccctgacatgctgctccctttttgaagtgtggtttctgattctgggtgcagcttgccatatcagaggagaatgaagctaggtggcatgaaccccagaaaattttggtgaactcacctcttggaatgaggacaaaggagagtcttgaagcagaaaagagctgtgctccttgaaggggtccaaagttaaagctcacactggggtggattgggtagacttacctgtcccctctttgacagtgatgcatttgagcttctcctattgggtcctttggaaaagaattctttgaactactagaaaattaggacagggtgggggcaaaagaaaacgtatattgagagcttgctccatgtatttgttaggcatttaatctaggtatctaattttatcttcaaagtaatcctgtgggttggttttatcaatcctattttgcagagttggatgctgaaacttgcagtcacacaaggacttgaacctagagcttttctaaagcccgtactctttccagtaccctgagccaggggagccagcgggcagaaatgacgtgtgaggtaccctctctctcttcacttccatgtgatctgttactcattttgtcaagacatcctgggtcccaggtaagctccagtgattcccctgaaccagtggtgtgctggagccagctcagacctgctagtgagagtgttaaatattcaggaaatttgcaagctggttgttaaactgtcagtggttggaaattggtcatgggaggaagtatctacaccacggaataactacacacggataactgctacaaatcagggatccccatctcccccacaagctggtttgctaacacatcactgtctttcttttttttttttttttttttgagacagagtctcactctgtcgctcaggctggaatgctgtggcgtgatcttggctcagtgcagcctctgcctcccaggtttaagcaattctcctgcccaagtagctgggattacaggcacgtgccaccatgcctggcaattttcgtatttttagtagagacagggtttcgcaatgttggccaggctagtcttgaactcctggcctcaagtgatccaccagactcggcctcccaaagtgctgggattacaggtgtgagtcaccgcgcccggcccagagcactaaccttggggtccagagtgagagctgaagagaacagggcctgcccccagcagtcacagagtttcagctgcagactgagggaagaccgatagtatctatgggaaagtgtgtgcacaaaagagacagaaaagaggctggagaatattgattattcacacatgaacaaagtaagtaccaatgttattaatcccagggattttgctgggaggagttctggcttgttattagggtccttttctttcagatcaagaaaagggagatctaattcatgaagaaactagaaaagtgccctggattggtgggagtgtggtgggggtggtgctgcacaacacagaagaggggaactttgactttgagcctgaggtcttgggatgaaaagcagtttgtggaccggattcctgaccctggggttacagtaggaatccctttgcctgacaggtggtgaccttcctctggcaaggtccccagactcctaaggcagaagcaatcctcccatctcagtctgccaagtagctgggactacaggtgctcaccaacacacctggctaatttttgtgtttttttggtagagatggggttattccaggctgggatctgtgaagagcagaacaactctaagccccagggcaaaaatctgcagagctgagtctcatgccactttggggcactccatctgaggcctggaatcagaggccttccgcagcttgtgtagatgctgccaaaaggctgagctcggtggcccatgcctgtaatcccagcactgtgggaggctgaggcaggcagattacttgaacctaggagtttgagaccagcctgggccacatggtgtacccccatctctacaaaaaatataaaaattagccaggtgtgttggtgagcacctgtagtaccaactacttgggaggctgaggtgggaggattgccccaggggtttgaggctgcagtgagccatgatcatgccactgtactccagcttgggcaacagaatgagaccccatctcaaaaacaaccaaaaagatgctgcaaagaaacagcagcctcctgtaacaaaataagtggtacatcttttgtgatgggagcatctccctggggagcgaagctggacgttgcagccctaccctgtccccagaggtttttctgtccctttatgtctatgaacaagtacagctgaggccatcagcactgcacacacctggaacagtcttgttaaaacaggacctccctaaaggccaagagctaaggaaagagaaagtgaaggactgagcagcaggtaaccagaatcagagtcattgaaggcaactgcaggagttgccccttcctggctccctcccatggcaactccctgagtctgagtagagaaggttagagacgcatggaggttcccacccctcctgtgaaaggctcccttctgagttccaggtccctatctgatgacccacctcacctatgcctgcctaatacctgaatggccatctctttcagagaccactcttattcccaggtgtgtgacctcctcctacagactacagtgggaaagacaccatctccaggtaaccccaacacagtgaggggtggagcggggatgtggtcattcgttccaggtattgttgattctcttgaggttcaatccagggctagagattgtgattaaagagatacccagattgggtatgcgtgtaaagggcaagagctatgagaccaatgtgacatttaggattaattagtcccttccacagggcaggctgccactcactggtacagctcctgggctgagcctggcagagctcattagcaaggcagacactggaatgtgtgtgcaatggagggaggcttaaactcagaggctgctggttcctattaagcagagagaggttagaacttagtggcacagaaactgatatcagctaaatatgggttagtcaccaaccctgcaccatcttccctaacctttgagaaagtcttttcctactgcttgttcacatccattcattcaacaaacaattatgaattttctcttaggtgccaggtgctacacaagatactggctatagcagcgaacaggacagcccgtctcatcctcatggaggtcacaggacaatgagaagaaagacttttttatttttatttttttgagacggagttttgctcttgttgccgaggctggagtgcagtggtgtgatctcgactcactgcaacctccgcctcccaagttcaagcaattatcctgcctcaggcctcttgagtagctgggattacaggcacctgccaccactcctggctaattttttgtatttttagtagagacaggggtttcatcatgttggccaggctggtctcgaactcctgacctcaggtgatccacccacctcggcctcccaaagtgcagggattacaggcatgagccatcgaacccggcccaagaagaaagacattgaacaagtaattacagggtattgggtgttatgaaagaaaagcatggtactgtataatgaggtcatctaatttagtctggggtgacaaggaatgcctactaaagaaggtatcgtttaagacatacctggggaatagcggtagtgaaaatagaagctccagaaatgcagggaccatggctgacatgtttaccatgccagtgtctggcatggaagaggcccaattcctttggttgaaaggatgaagtaatctagctgaataaagggtgtgtgcgtgcacgcaggtgtgtttgtagttaaccttcctttagctcagcttaggaaacagcttttgtaaaactgcgtaactagtagtaggtgagagaggaatacgaatgatatacacaccattaaagacaacttactaacagcatga

SEQ ID NO: 7 - DNA, 17794 bp, Homo sapiens
attccaggaagcgtttgcacatcctggccccagaagattttgcgtagcctcaccaagagaagaagttggaaagaaaaaaaaagaagttggcaaggcatccagaggagaccccgccagcacctgggttctctgccaggggagagaggtaagcacactggactgaaggaggcaaaagctgctcaagggagtggggggtggggggagattcccagatgctgtggaagggatgtggtttgggggtccttggagtagtgaggagaagccctgctcccacatagaaccccacacacacaacagtggggatggagggaggtcagggattccaaaggaaactagctaagaaccttggccttactaaccacaaagactcccattcatatcagctgtgtctgaaggtcagaggcccagactctgaatgttctaggctgggtcagacccctgggatggtcactggaccccataggagaagagataggggagtccctaataaaacttcaattacatttcctgcctgcttggtcagtggatactaaatgcagatgacttagaaaaagaaagaattgtgagatgctgtggagtcaactcaatgtcatcattagcgtcttcctcttcagagtcctgtatcccagcgacggagctcaaggttcagactaaaggcttcctacccctggcaaggaggtctttatagtggaggtgaacgtttacacactacactctgagaattttttttttaaagtagcctctattttgtatgtcttctcatcctgttagagtaagtagctagtcagggatgagcagggcaggagagggcgccccagacacacacccacaggaatgtcaggcaaacatcaggtgagggtcaggcagttgttaacgggctctctaaaataattggtcacagctggcaccagagacaggcagtctcccaatagaaacatctgaaactggtgatcagcagtttcccaataagatcccagtaagtgaccaaagaggcaagaattgaggttgctgcagacccctatggatttgctgccactaacgatccctactactgctgctggggaggaggttttaatagtatctattaattaaagatatcccagtctcttttctatcctccctccccaaatactgctcggtccacctcatgagattgtcctgggccttttgagacccaggcaatgggaagagaaggccatggaagtggactgagaatgctgggtgtctagattaactatgctgccctccggaaggcacctccagtaggatgcacagctgtggctatcagcaaattccccttcctcctcttgcaggtgccctagagaacatggatagggctgcaggtggttaatggttcaaagactactcagtgaagacgctgcctgggggaacagagtgtggccacatctaaggaaagaaggtacaggtgaacaggagaggaggtgaaggagaagcgagcaggtgggggttgcggaggggctgaggaaggtcaggcagagccaggagaccaatccagctccttggaaggtagctcagttgactccttaccatgtggcatttgtaaaaggtggacagtagaggcctggggccagagagaggctggaccagattcccactgtaaaaatctccttgccaaggtccaggtagggtgtccttaagtctgaatcttgatccccatcgctgggatacaggactctgaaagaggaagatgctaaatgactgcatttggggagggaaagacacgctcacttctccccagccccaagttgccctgtgttgctgccacactacgtaactacagtcataaactatatttgaagcatgatggaacctgaaccatggcagtagcttaagttgactacattaacagggaaagctgagtcatgattctatactgaatataaaaattaagtcagatgtgctcactcacatgcacacaaatattctggaaagctgagatccacagccccaagatggggaaagggctccccctggtgggattgccagaggttcccccatggaactgcacgccccagaccaagccaaagccccaagcaaaacaatctgctatgtcatgcaggattggaagactttcgtttgcttcagggccaatttatgactcccggtattctctgtcctgaaatgacacccagttccaggaagaattggattctaggaccaacttgtacaggcgccccaggagacagtctgggcatgcaggtcagccgatgtgtgccggggaagactgtccacatttgctcctcagtcccactgggcctgatcacaggccaccccccatagtaaaggggagccagggcccctgggcaaggttagatgctgcctctcatgcccctgaattagccaagaggcgctccagcaggaagccttgtttggcttatattgcaaaggaggcaccacttactatgcagtcccctgcccggagcaccttgcctgtgctactgagaaatgtcctgctgcagcaggagaggcggatcgagctacagccaagagtgtgccctgcctccatctgttgacccaggtcagaatgatgtggaacactggacagttaactcactgggttcaaaaaacacagcaacacaatgctctgggtgcctcctggctgtgatgtgcactattgttttctggggagatcccatcacatatgaaacttcagatgttcatccagtgatcatgtcaagcttccattgtttgctctcatatgctccctggagctggattccaccctggctcaagacctctgatgaagtgctggcatggagcagaaactcccttaggcagaaaccccctttcccccttgccacccaccccccaccagcaccccatcctagggatgccaccgcaggtctcctctcatagcagcactacttcctcaattctcaacttcaggttactgctacagagtctcgcacctgatccagccttgagaaagtgattagagtgtgaccggaaaaaattgttagtgatccccaaatatgtagtataaagctacagtaaatgcttctaaaaaatagacacaagtgaaacaggctagcccaggggctttcaatacagagcaatgatagatataatattagagaaaattaaaaagcaatgctccacaaagggagaatatccccaaagatattcccagaaactgaatataaatgcaaaagatgaacagggctacagctgtggcctgttgggttctgactcagggtacagttaaaggcagctgggaagtcaagtcctgttgagtactgagtggtgagatagaattaaattgcccactgaggtgggggaccagtgtcatggtcactgtgaaaatattagggactcagattcccctcttgcccacacttccaccctcttcaagaagactgaaatagcttgctactaacttcgcctgggactgtggcctagggaggcccgtggttaccaaacggcaccacacctgggcttaactgagccacccacagccatggggctggatgtgagtcattcccagggttatcccagggcaggagccccgactgccatataagacctagtcctgaacactggcccctgggaagggcaactgcacagccactaggcagggaggagtgaggaacaagagaagggagacagagaaagcctggaaatgaacctggaagctgaaattccaaaacacataaaaactaacactgagaaaggcagccagcaacatcaacacttgatgcatgacaggtgaagtgaaaagaatataatcattggaaagagtcttcagtatcctcaaggaggcagttaaacatataatgttcacttaaaaatcaagccactatgagattacaaccaggcagaaacgtgctgtcatataacaatggaacagaaaaatattatgcaataaatggttcaggagaaataattattaatatttgggaaaatacatatagtagatgtaaatcctcacttcatctaacatatcctgagcaaatctaaatattttttaatctctgaaaagggtaggatgttctaaattagctgaaagaagccaggtgtgttggtggcgtaattcccagctacttgagaggctgaggcaggaagatcgcttatgcccagaaattcgagacccgcctgagaaacatagcaagactcccagtctcttaaagaaaaataaaactagattttaagataaatatcatacaagaaatatgaaagtaataagtaaaacatgggaaaaaagtaaaaaaacaaattaactgaaacaataggccaacaaaagaaaggaatatatgcatagatttaactacaaaaagtttttaaatttttttttttttcttttgagacaaagtctcgctctgtcacccaggctggagtgcaatggcacaatcttggctcactgcaaactccacctcccacattcaagcgattctcctgcctcagcctctcgagttcctgagtacctggaactacaggcacaggccatcatgtccagctgattttttgtatttttagtagagacagggtttcactatgttggccaggctggtcttgaactcctgacctcaagtgatccaccctcctcggcctcccaatgtgctgggattacaggtgtgagccactgcgcctggctaatttttatatttaatagaaaaaaatggaatgcaaataaataaggaaaatgttggcaacagtctctgaatccagcctttctgggtatgactttgggcaagttacttgacctctccaggcttctatttcctccgtcatacgagactaattattgtaccgtgaggcaggattaactgaattactccatttaaagctcttagaacagtaaccagcacctagaaaataccccacagctatttgtattttatattgtactgtgtgagaaattcagacacagacaatttataacagaaacaccataactaattaacaattatcaacgaacaattcaacttcattaatattgaaaaaaatctaattttttttttgcctttctagttgatagactgttaaaataacaatagtgtattcctgccctaaccctggggtcctgttcctaaaagcctccttggatgaaaacattgtgattaagaaactcaggactttatgaaaagttagggatagggaatactgaaatctttagaaaacccatgttttttaaaacttttgcgttttttatgttttaaaactattcccagccaggcacggtggctcacgcctctaatcccagcactctgggaggccaaggcaggcagatcacttgaggtcaggagttcgagaccagcctggccaacatggcaaaaccccgtctctactataaaatacaaaaattagcaaggcatggtggcgggcgcctgtaatcggaggctgaggcaggagaatcgcttgaacctgggaggcagaggttgcagtgagccgagatggcgccattgcactccagcctgggtgacaaagcgagactccgtctcaaaaaaaaaaaagctattccctatttttactaaaatacactcataaagagagtatcaattttataaaacttagattggtaactgcttactgaacaattacttccattaatttttccttactggagcatagccttctaaaacctctcccctgcggtttcagtgagatgtttgcaaatcagttaagtgggtctataaggaagaactgtggtatttgtttgcatatggttcctcatccaaacactgcgagccttttcagttatcagtggctgtatgtaatggacaattataaaacagagaaagagaaagtgatccaagcggaacgtgctatggaaggttgcaccaggaagagatgcttgtgcactgtctggaatgagccagtggtcccagcccagggattctggttcactggatctagggatgggccaggcacgtgccgcttggaaggctctgcaggtagttctaatgtgcaccctgtcatgaacctgcggaagaggattggatcagggaagggacacttgatttctcagctttaacataaatgagggtttccattttctgggttttaatcttctcctttcactgtaaaatggaagagttggactaaagtggaatcttcgttatatgacgaggcagcacaatatgcgagaaagcacacaggacttagggtcaggccactggagctggtgttctctccagagtcattcttcctctccttcacacttacatccacccttcctaccctaaaatccatctcccatctgtccccactcagtcccttaaccactgccttttttttttttttttttcgagatggagtctcgcactgtcacccagcctggagtgcaatggtgccatcttggctcactgcaacctccgcttcccgggttcaagtgattctcctgcctcagcctcccaagtagttgggattacaggcatccaccaccacgcccggctaatttgtcttttttttttttttaaatcaagcaatcccctgaaactgaataggttcagagagactcctgccactaattcagatgttcatcacctctcactggagcaatttccatagcttcccaactacttttcccgacaccagtttttgtgtttttttttcttttttgagacaggatcttgctctgctgcccaggctggtatgcagtggcgtgattatgggtcactgcagcttccgtctcctgggcttgagtgatcctcccacctcaacctcctgagtagctgggactacaggcatgcaccaccatgtctggctaattgtttaaaacttttgcagagatgaggtctcactatgttgcctaggctggtctcaaactcctggctcaagcaattctcgcatgttggcctcccaaagtgctgggataacagatgtgagccaccacacccaatccctgataccagtttagatcctctctaatccccctttgcaccgccttctggtatgcatcttccactgctgctgaaacctctggctgatcacaggagggtacattttccccacctcatatgccagtcattttattagatcatcaaaatcctggcagtcaccagtgagcgatttacatttttgcaacgtggttcccattattctactgtctctttctttctttagtaaaccctcaatgtttcttgtataagaaatgggctgggatggctgggcggggtggctcacaccactgcactccagcctgggcaagagagcaagactccatctccaaaaaaaaagaaggagaaggaggagaagaagaagaaggggaagaggaagaagaagaagaaggagaaggagaagtgaaagaagaagaagaagaaatgggctgggatgttatcaagaagctttgtcattttggtttattcttttttttttttgagatggagtcttactctgtcactcaggctggagtgcagtggtgccatctcggctcgctgcaacctctgcctcccgagttcaagcgattctcctgcctcagcctcccaagtagctgggattacaggcacccgccaccatgcccagctaatttttgtatttttagtagagacggggtttcaccatgttgaccaggctggtcttgaactcctgacctcatgaaccgcctgccttggcctctcaaagtgctgtgattacaggcgtgaaccactgcacccggcccattttggtttattctttgcagtcaataaacttttaaaggacttctgccttcaccaggagctgcatcccacttcacacatctaggcactgagtgttcccttgggccacaatcaaagagcctctcatggcattcccatcttgcccctgtgggactaaaaaccaagattagaaagctctttgaaagttggaactctgccttatttactctttcttcccagcccctatatggtgcctggaatgcttgttgaataaacaaatctatgcacctagaacaaatattagaaatagacctttaaaatctcccagagtcaaaaatatgtagaagcacaaaacaagcaatgaatgtttttactttctcagttcccttcttgtcataacccaaaccccacaagttccaaatcatattcaaaagtaaccgaaagggacaagctaatccttagggaccaatgccactcatcctcagattccacaggacagtcagcacttctcctgacaaaatatgatggtattttagctcaacaatgctaatattagctacaatccctcatcaccctcttcatccactccgagattcaagggctcaacagtaaggagtttacctcaaaggaaggtgtgtgctagaagcaggtagagacacgctcatttctaactcttagaacagacaattctaaatgccagttgacgatttcagtgtggttttctggccatcaggtacagacaaattcctttttgaaccttaaaattccaaagatgggtctcccctgcctgtgtataaaaagccagctaggagtaagaattagaaatgagctttctcaggggcattttcaccattaattatctagagtttttttttttgttttttcagagtagtagccattctctttgtttatcttaatgagcccagttatgccatctggtggccaaaataaattgaaaacatgcaactatgctgtcagaaagtgtgaacgtgtcctttttagagttattccctttcaccccttagttttctccccattttccgtgagcatctatcactcactacataaggagtaccagggcattgatcttgatggtgcctgtttccctgcatggaaaggtaagaaagtttggtcttggtacaagtgaaactggttaagatcaaaagaaaaagaaggacaagttagggacaggacccttgcccatgtccaaaggaacagaataatgtttccagaagaaagagcaagagcagaagccagtgcccccagcttatcagtaagcagcatggaatttgactaggaaacagcagaacggccactgctaagtgggaatcaccataacacctgaaaaaaataataataacagcaagagtagctgctccaaatgtgttcaaacctcctggtctgaatggattacattcctaagtaccaaaataaaaattaactgagagtatctccaagtcactatcaacgatctctgagaaatcacaaagaggcagaaaggtattagaagttggagattgtgtggctctgattcccaaagatggaaaaaaagatgaatgttgaaaagcacagatcaggccaggtgtgggggctcacgcctgtaatcctagcactttgggaggctgaggcaggtggattacttgagttcaggagtttgagatgagcctgggcaaaaccccatctctacaaaaaatacaaaaattagctgggcacggtggctcacgcctgtaatcccaacactttgggaggccgcggcaggcatatcacctgaggtcagcagttcgagaccagcctgaccaacatggagaaaccctgtctctactaaaaatacaaaattagccaggtgtggtggcgcatgcctgtaatcccagctactcgggaggctgaggcaggagaattgcttgaacctggatggtggagtctgcagtgagccgagatcgtgccatcacactccagcctgggcaacaagagcaaaaactccatctcaagaaaaaaaaaaaaattagccaggtgtggtggtgcacacctgtagtcccagctacttgggggactgaggcaggaggatcacttgagcccaggaagtcaaggcttgcagtgagccaagatcaggccactgtactccagcctgggtgacaaagcgagactctgtctcaaaaataaaaaagaaaagaaaactacagataagtggccttggcaatgactgtaggcaaaaaccctcaaatgagatacagaaagatgttttgtaaagtgtttcgtgagccccgagaagagctgagtatagtcacccctaagctcaagtgatcctttcaccttagcctcccaatagctaggactataggcgtgtcaccattccctactaattttttaacacctccttcccgtccctcgactcctgctctcaaactcttcagaagacttgttcccatgattctgttggagaccatgttctctggaaacagatactgagataaagttgggatgcaagatgttaattaggtattaacacctgtgaataagggcaaggaagcaggagtgggcagagggagaagttaaactgagctgcaggcccaaccacacctctcataactctgcagagagcttggggcagtattgtctatcaaagcaaagcaagttgaactgaaagagccagacatttatatccagccctgcttagtcaccacatggagctgccaggagaaagggtgtgaccaggaagagggaccaggcagctctttgcagccaggggaccctgaaggagctgatggctggaggctgtctgctgactgctctcccatagctgggcaacaagtccttccttgggggagatctgagcagcacatctccatgtccactacgctctccttactaccattcccctctggcaccactgaaatccaccttccatcttcgcttttactccactcactccatccctttgctccacgccaaatccagtgggcccttcttggttcttaccttacagctgacctctctctcatttgttgaagttatcgatttctacagtaacttctcctctctctccttgacctctctacccacactttgccggcctgttcaggggtcctgtcctccatgcactacccaagcactgggactccattctgaatccatcctcctcttcctccgtactctcccaggcgatcccacccactatcagggttttaattcctgtttatatggcagtgactttgaaatgtactctccagctatcctctctgctaggcttccgattcccatatctaattggctgctggctatctccatgctaagggctgtcagaactgtgacattccacctctcttctcccactgtgttcccaccctaattcttccagtgcaagaaaccagggaccctttgaacctgctctgtcaagtttcttttctcggcagccacccccgctgggtccagtttgggcatgggtatggaagcactccgaacagtatcaaggactctgcatatggagatttgcatcactgacatataaatagctgatgctggtgctgaaaccaaagaatattcatcactgatcacacccactacttgcccaaccagatgtgaacctctgactcagtgggtccacaggaaagagttactcagcacttcctaggtataggtgatgagagatggtattcatttattttacagcttgaagaatctgtaaagaaaatctgaagaaaagagttatctgggctgggcacggtggctcacgcctgtaatcccagtactttgggaggccgaggcgggcggatcacgaggtcaggagattgagaccagcctggccaacagggtgaaaccccgtctctattaaaacacaaaaatttagccgggcgtggtggcgcatgtctgtagtcccagctactcgggaggctgaggcaggagaatcgcttgaacccgggagacggaggttgcagtgagccaagattgcgccactgcactccggcctagcgacagagcgagactccatctcaaaacaacaacaacaaaaaaagagttctctgagcaggtagcttttagccacaccttttatttccaggcctatacctgtgtggcaaaggcttaaataggaggtatttctgaaggaaaattaactccagtttatttaaatataccatgcttcgtgtatatatgtcctctccttccaaaccggaatttccagttaaattcaaggaataattatcaagtaaatacaacatgacaagagcaaggctaagtacaggacagttcctgccttaaggaatctaaggtgaaaggataagtctaatggaagcgcattccagtttgctgatgagcacaaaagccatagcagctaagtgccatgggttccagagaaggaaagtgtctccgtgcaggctggcttcataaaggcttctgagataggcctaaaggatagatcagatttcaggaagtaagcacaagacaggaataagcaagaaataatgatgacacacaaggaatggagaggaaagaatgccatcagaagaatatcttcagagaattgcacaataaagagtaatggtaaggaaattttcttatagctaaggccaaatattgagactacagaaataccctgggaggctagagagaggcaacgtcatgggggtaagattggttttttgtttgattggttttttttggggggggcggttaggttttttctttggagaaggagtctccctctgtcacccaggctggagggtagtggcgcaatctcagctcactgcaacctccgcctcccaggttcaagcgattctcctgcctcagcctcccgagtagcttggattacaggcaaccaccacctcggccgaatgatttttgtatttttagtagagacagggtttcaccatgttggccagtctggtcttgaactcctgacctcaggtgatccattcaccttggcctcccaaagtgctgggattataggtatgagccacatacccagccagattgttaaaataatattattacaaggaggtgggtagaaaaggccaaaatcactgccccattaacttttcctaggccccagttcagacccaaactctttttagacttcccttttctaccatcatgggcagcacgggtgttgtggctccgagacccctcttctatccagctccctgaaaagaacaatgcccactaaaggcttgctgggagttgatccatcacttctggtttggtagaatgtttccctaaggatctcttgagcccaggaattcaagaccagcctgagaaacatggaaaaaacgcatctccacaagaaatgcaaaaatgaatggggtgtggtggtgtgcgcctgtagtccctaagggctgtcagaacttaggaggctaagacaggaggattgcttgagcccaggaagtcgaggctgcagtgagccatgatcacaccactgtactccagcctgggcaacagagcaagaccctgtctcaaagaaaaagtttccctaatgttgcccacatgggtaactccctcccacctatcccagttgtaattaagtgagaacactctagtccttgttcttaaatgaaggaagtgaaaatttgtgaggacaagaatgttctgggcctggtgacctcccgaagtgagcttggcagcaaatcttcccatttgccttgggaaagccctaaaaaaaccagagtatgggatactgatagtggttataattgctaacgaggttagggttttaacacatgacgcatgctaagtagtcaaaattccccattttacagaaagagaaactgaagttcaaagatgctatgtgcaatccccctacatggagacacagtctgagtctagtttctcaaggccttggcagggcctgagggagtgggtaacatgggtatggcttgtatacatttatgaattttgtatctgggaagcaatatggagaaatagcctgtaaggaaggaaaagattagacactatttactgcagctccaaacaaaactacacagaggccaggagcagtggctgatgcctgtaatcccagcattttgggaggccaaggtgggtgaatcacctgaagtcaggagtttgagaccagcctggcgaacatggtgaaaccctgtctccactaaaagtacaaaaattagccgggtgtggtggcacacgcctgtaatcctacctactcaggaggctgaggcaggagaatcacttgaacctgggaggcagaggttgcagtgagcttgagaggtgacagcctgctagcagtcctcacagctctcactcgctctgggcgcctcctctgcctgggctcccactttggcggcatttgaggagcccttcagcccaccgctgcactatgggagcccctttctgggctggccaaggccagagccggctccctcagcttgcagggaggtgtggagggagaggcgcgagcggaaccggggctgcgtgcagtgcttgcgggccagctggagttccgggtgggcgtgggcttggcgggccccgcactcggagcagccggccggccctgccagccccaggcagtgaggggcttagcacccgggccagcggctgcggagggtgtactaggtcccccagcagtgccggcccaccggcggtgcgctcgatttctcgccaggccttagctgccttcgcacggggcagggctcgggacctgcagcccgccatgcctgagcctcccaccccctccgtgggctcctgtgcggcccaagcctccccgacgagcgccgccccctgctccagggcccccagtcccatcgaccgcccaagggctaaggagtgtgagcgcatggcccaggactggcaggcagctccacctgcagccccggtgctggatccactgggtgaagccagctgggctcctgagtctggtggggacgtggagagtctttatgtctagctcagggattgtaaatacaccaatcggcactctgtatctagctcaaggtttgtaaacacaccaatcagcaccctgtgtctagctcagggtttgtgagtgccccaattgacactctacctagctgctctagtgggcccttggagaacctttatgtctagctcagggattgtaaatacaccaatcggcactctgtatctaactcaaggtttgtaaacacgccaatcagcaccctgtgtctagctcagggtttgtgagtgcaccaatcgacactctgtatctagctgctctggtggggccttggagaacctttacatttagctcagggattgtaaatacaccaatcggcactctgtatctaactcaaggtttgtaaacacgccaatcagcaccctgtgtctagctcagggtttgtgagtgcaccaatcgacactctgtatctagctgctctggtggggccttggagaacccgtgtgtccatactctgtatctaactaatctgatggggacgtggagaacctttgtatgtagctcagggattgtaaacgcaccaatcagcaccctgtcaaaacaggccactcggctctaccaatcagcaggatgtgggtgtggccagataagagaataaaagcaggctgccccagccaacagtggcaacttgctccggtccccttccacagtgtgtaagctttgttcttttgctctttgcaataaatcttgctactgctcagtctttgagtctacattgcttttgtgagctgtaacactcactgcaaaggtctgcagcttcattcctgaagccagtaagaccacaaacccaccagaaggaagaaactccgaacacatctgaacatcagaaagaacaaactccagacatgccaccttaagagctataacactcaccgtgagggtccgtggcttcattcttgaagtcagtgagaccaagaacccaccaattccggacacaagctaagatcacaccacactgcatcccagcctggcaacagagcgagactgtctcaaaaaaaaaaaaaggccgggtgccgtggctcacctttgtaattccagcactttgagaggctgaggagggtggatcacctgaggtcaggagttcaagaccagcctagccaacattgtgaaaccccgtctccactaaaaatacaaaaaaattagccagatgtggtgggcgcctgtaatctcagctactcaggaggctgaggcaggagaatcgcttgaacctggagcagggctggatggggggtagaggttgtagtgagctgaggtcaggccaccacacacaagcctgggcaataagagtgaaatgccatctcaataaatattgtgtttggttcttgagtaacaaaaactcaatacaatggcctaacttcataggtgtttatttttcccagttatgaagaagacttgagcaggcagtccagagctgatacagctgctccaatcaccagagatgcaatctcctgctagatgtcttcacatctacctttctatgtcacatgtgcaagatggttgctctgccttcagacatcacatttacattccaggcagaaaggagaaggaaagagcaaaagatgtgttccgaacaaatccatcttaaaaacaaacaaggggaggggtagcaggagaaaatttaaaaagaagaagaagaaaaacaaaaacaggaaagccgttgtttccctaaaagccccatcaagccgacttctaccggtgactcattacccagtcatgtggccacccctggattcaaggcagtctgaggaggtgagtgtttcaaagaggcacatggatgccacagacaaaatcaagtttccatggttgaaggagaagaggacgatagagtttggggaggcagcaggctacgtctgccacagaagatataaagatatggagccacacgagaagatgggggaggctgccaaaaaagtccactgggtacaggtgaggagcaggtgacattggagttgctccatctgaggagcccgcacctgcaatggcttgtgctcctgctcctgtgggtataggcacaaggctgatgccgagagagtgagttgtttctgttggggttcagaacacaataccccaaagtatggcgatgagtacttaactaaaggacattggaaggcctcagaagcagcctcagatccaaggtccctctgacctgctcctgccctcctgtctctctcgtccctcgttctcccctgaagtgagtcatagaaaccagaatcctcttccccacggtaggtcctagaaactagaaccctttttccccgaagcaaaagccataaaaactggaattattactctaaactctccttgactttttgtccagaagatggccataaagaaattctcagctaggtgtggtggctcgtatctgtaatcccagcactttgagaggccaaggtgggaggatcacttgaggccaggagtttgagatcggcctgggcaacatagtaagacccccatctctacaaaacttttttttttaaacttacctaagcgtggtggtacacctgtagtctcagctacttaggaggctgaggtgggagggaccctgctctggctgtgactgctttatcacagggagtgcctatctgtgggctgctttctacacattaaagcattttcagaaagggccaacatcagccttggaaaaaaggaggaagagccacggagagtctccctttatcttccccttatgtgatgtgagagtgcacatgactgtgtgcacatacacacacacacacacaccacacacacacaccccacaggcacacagggtcaagaacatgctgggcagagcttaagccactgaatgtttcagtaggaatcatgatatctaaaaataggacagctgataagggggttcttactactcacagttcctggaattatatgcaattgcatcttggaaactcaacaaataaacagttagtatggaattaaggaattaagtttggtgaagttcaaagaagctgatgttactcacaagagtaaatagagaggaaaccgggcgtggtggcttcacgcctgtaattctagcactttgggaggccaagacgagcagatcacttgaggtagagagtttgagaccagcctggccaacatgatgaaaccctgttctctactaaaaatacaaaaattagctgggtgtggtggcaggcacctgcaatcccagctacatgggaggctgaggcaggagaatcgcttgaacccaggagacaggggttgcagtgagccaagatcacaccactgcactccagcctgggcgacagagcaagactccctctcaggaaag

SEQ ID NO: 8 - DNA, 2509 bp, Homo sapiens
cctgttcggcgtcttgcagcagtgcctgcgatcccgcgtgagtccgtcgctccctccgcgaaaacctggactctttcccagaagccttgggctccagcaccatgcctgctgcagccgccaaagagcgggaagccacaggctctgcgggtcttggttacagcgtctctggtcgtgccgggcctccttctgcatctgttccacggcccggccatctccctcgtgcagcccagaacaattgggaggaagcgttggcgggcggagggggatgcctgttgggcttttccactagttactgagtgttttttgcgaagagtacgttgctatcagtggcgtccgggtcgtctctccctctcttccttttggtccccataaatgagctgttctcggctctgggaaagaaaagccctccagcgattatgcggatctaattaagtcaatcaggaaactgccggagagcggcactggcttgaagcggagtttgtcctgaggcacagcggaacgattgcacgcggcccttttcagcggttcgagctcggccagcgccgggctgcaaacggaagcctgagctgggcttggggaactacgcccgcagatttctctaattttattcacaaaactggacaccctcagggaaagcggcaaagccggcgcgagcctccttcccactctggacctagctgcagctccaaagcgagatagctgtctagcctcagccggtacagctcccggcccctttctccacccggatcttcggctgctcagaagcgatcagctcccttagcccaggtgggaggcgggagactccagatcctgtgacccgcggaggcagacctcagacatgttccccatgcacagaaatgactggggctccagtgtgtgcaccttcaactctgaagcccacctgcccacttcaggcgctggcgcggagataaccaccacgcgtctgccgggcaaagttcgagagtgaatttacatcttctctttccgctactcctggccactgtcccctcccagccccatctcccccgcccccaaccctggactatgtggtaggggactcgcttaagcacccaagtactgcgcggttgttgagaccaaggcgagctgcggagcctgtgggctgttgttcgtgggaagagggttgcgacctcaggagagaccgaaaacagcgccacttgaaacccgccggtcctgaagatcacagagttcccggagtggtagggaaggctccacgctcttgagagcagaggcggccaggggcagtgggggacgcttccaggtatgtgggaaggagaacttcatgtctaagtgcgctcttgtgggtttctcggccagctgggccgagcctctctttctctgtcctcatgtgtctgtcctctggacaacagtggctctgtatggcggattgcgaccctgagtgacgggcgcctgtcttgcatcctgtgtcctgtgtcctcccctccagacctcatgcttggtgtccacagagtggacccaggactgcctggaaggcttatcatccaggcccgcgacttccccccagagtctgaagccttgcgacctggtcggggacgacaaacctgctcggggtcaacagcgagaccctagtggggaatgaggatgggtgagggtgcgcctgggttgagggtctgtgactgtagcatggaaaaggagttcatgcagggatcgcactgagggacagccaagaatactccagcggcagcctccctcctaccaattacacgccgcctgctggcacagtggcacctcgggaacaggacgcccttccgggccctgaattggggcagcgcaggagggagggtgcagagccatagcgacctgtgtgtaccatagacatgcacatgcgctcaccttcacgtgtaacccttctgagtcccagacagggtaactggcgaggccgtaagtaccctcgtgggggcggaaatattgccgcgtccctgagtcctctgggcagatgcagagccgcgtaagcctcatagaagcaaagccaggggaacagtgggagctctggcctcgcggtgcggacgctagtaatggattcctggggaacagcgacctctggaggagcctctcatccacacagagtcaggaactaaaggactggttctgagacaaagcaccctttcctcaccctactcccattccacccgcttggaaaagttatccagagacttttaacctccggactccactcttcgcttatgtttgcttttttttccaacctgtacccacgcttcaaaatccctgctccagtcctgcctcttccagaaagaagccttctggccagcccagttcctcttcccctcttcctgttctgagctcattctcaggccacactgcacagccaacctgcttcctgcctgctcttctccaaaaagactgtgaatccactccacccacgccttgtgttgcatgctgggcatgccgttccctgccccaacccaccccaccccccagtgaataaagactgaagttattcattccaaaa

SEQ ID NO: 9 - DNA, 395 bp, Homo sapiens
aaagaagccagaagcctggcagtagaggaattcccagcaggctggtgtgcctagaaaggtagtttctttctttcccttccacaggcacaaaggaggccaacaaacacgcagtttcagactattctgacccttaagaaaaaagtttaagagttcaccaaactattgtgaatgagtttgattctaatcatttgctggcagggaatatggaataaaatagctcatttgcagttgtttatttcctgttgtggcttctattttcatcttttagtcgctttggtgatagtaatcaaaccctaatcatggtgccgccacaagtcacagagaccaaaataacttgcagcagagttatgacaaacaaggatggaatcagctaaagacctggctacttaatcacc

SEQ ID NO: 10 - DNA, 991 bp, Homo sapiens
ctgttgagtgcctctgggacctgtatttttcttgctggggtgggatttattccgcttctcccgtactcctgcatctccaaggccagtggaggacaccaggggacagctggctgagatcaagggtgagtgcgattggtggggtgtggagtggggtgggcgggagatggaatgggtgtgcccaccctctcctagcgtcatgagggatttactgctcattgagtaggtgttccttagtgtctctggcttgacagcagaagtctacttggataggcagttctgggcacgcacagccaactgtcggggcctctcccctagtctgagtgttcatgctcacagagctggtgtcccctggaatccagggactcggaagaggggaaaactaagctggaagtggagagtgaggcagaggcctgggtagggaacccttggggagctccccccagcctgagggctgctacccagtagaccaatgtgccaggaggaggaaggatgtgggggcaaatggggatctcccattccacccagagcctgtgactaccctctctttgcactgggaggtattgcatgcagaaagcataagcaaggcaagtgaggctcctctgggaaagccagaacctagacattgatcaggctcctggggctttttcaaatgagctcatccctgctttcctaggcctcttttggcattgaatggtatttccctttggttctttcaaaagcaagatgtgtttgtgtaattttaaacaagtgatcaatttcagattaacgtcaaggaatttcttcatcgtctccatcatcaaattctacttaacatgctctgcccattccaagaaaaaaagaggaatgaatgtgaactctttttgtacatacagccatttactcaaaaaatgcagccggcagagattccacagctgggaagctgactggtaagcaccctgtgtaagtgaacgcgctcagtgggatggaaggaagagtactgaggggacgcggg

SEQ ID NO: 11 - DNA, 20107 bp, Homo sapiens
ggcaggccccgccccccgcccacgaggaagtggctgctgctccggcgcggagcccagagccggttcggcgcgtcgactgcccagagtccgcggccggggcgcgggaggtgagggccgtgggggcgcccggaggtgggggtcaggggagccacctggaggtgggggggcgcgtagatgtggggcgccgcctgggagtgagcgggactggagggatgagagggggtgcaaggaggggaccggggggcgcctggaagtgaggacgcatagatgtggggcgccgcccaataggggcacggggatgagtgggggcacatggagaggagggggcgcggggacgaggggctcacggaaaggagagggagccctgggattggagggggcgcgggggtggccgcagggccagactgtggaaacgcgggctcccagcgcaccgggcgccctcggggcgtccccagcccccggccccaagcttccgcctcgtgccttccgcccctgctccccggcccccatccccagccttgccccgcggtcggtcggtgtagccccgttacttcgggccggcggggccccacacccagtcacttcccctccatccccggagccttccgggttgcagccgccgggaaatgagctggcgtctcctgccgccccgcccctgccctcctggccgctcccgctgctcccacccgcctcccccgggccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggctcacacatagaatcctagcattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccgacatggtgaaaccctgtctctactaaaaatacaaaaattacccaggcatggtggcacgcacctgtaatcccagctactcaggaggctgaggcaggagaattgcttgaacccgggaggcagaggttgcagtgagccgagatcacgccattgcactccagcctgggcaacagagcaagactccgtctcaaaaaaaaaaaaaaaagccacgtaacatgcctgtaatcccagctacttaggaggatgaggcaagagaattgcttgaacctgccttggcagtgagccaagactgtaccactgcactgcagccttggcaacagagccagactccgtctctaaataaataaataaaatcttagggacctaggtaggagtgccagcttctcccttcactggccagtgactggtaagccacccaactcctgccagcctcaactttccttatctggaaaatgggaaccttaaagactgggaggctgaaatgcaatactgcaagacacctggcagcgtgtcaggcgctgacagtataaacgtgcgtttgttgctcaccttgatcatagtgttcccccaggtgaacctaacttcctggcctccaagatttggggtcagagtcccaagctgcgtcatttagtagaagccgagtgactttgaacaaatcgttgcttttgtctgagcctgggtttcctcctgtacaaactgaaggtaaaaagcaaacaggctgggcgcggtggctcacgcctgtaattccagcactttgggaggccgaggcaggcagattacctgaggtcgggagttcgagaccagcctgaccaacgtggtgaaaccccgtcactactaaaaatacaaaattagccaggtgtggtggtgggcacctgtaatcccagctactcaggaggctgaggcaggagaatcgctagaacctgggaggcggaggttgcggtgagccaagatcatgccgttgcactccagcctggggttacaaagcgagactctgtctccaaaaaaaaaaaaaaaagcaaacaaaaaatgtctcaggcttgcttcagggggagaatggtgaaaggtctgggtaaaatcgccctgatagatgccggtaaagtttgtttcttacatatgtctgtacataatccattgataggtctttttctttttttctggagtccgggtctcattgtgttgcccaggctatagtgccatggcttgatcataactcactttagccccaaactcctgggctcaagggatcctcctgagtagctgggattacaggtatgttcctccatgcccagctaatttttaaatgtttagtagaggtagggttttgctgtgttgtccaggctggcctcaaactcctggccttaagcgatcctcctgccttggcctcccaaagtgctggggttacaggcatgagcctccacgcctgccttatacgtgctttctttttttttttttttttttgagacagtgtcttgttctgttgcccaggctggagtgtggtgacactaccttgactcactgcagcatctgcctcccgggttccagtgattctcctgcctcagcctctcaggtagctgggattacaggtacatgccaatatgcccggctaatttttatatttttagtagagacggggtttcaccatgttggccaggctggtctcgaactgctgacctcaggtgatccgcccacctcggcttcccaaagtgctaggattacaggcgtgagccaccgcgcccagcttcttcttcttcttcttcttcttttttttttttatttggaggtggcggagtttcactctgtcgcccaggctgcagtgcagtggcacaatctcagctaactgcaacctcttcctctcgagttcaagtgattctcttgcctcgaccccccgagcagctgggattacaagtgcccaccaccaagcccagataaattttgtatttttagtagagagggttttaccatgttgggcaggctggtctcaaactcctgacctcaggtgatccacctgcctccgcctcccaaagtctgggattacaggtgtgagccaccgcacccgtcggttgataggtcttttctaatattaataattacgtagcatctcaacatgttaatgtcataatttactctttccatattgtcacctgggtttttccacactgtcaccattataaagacagctattataaacatgtttgctttattttttagatgaggtttcactctgtcacccaggctggagtacagtgacgagatctcggctcactgcaacctccaccttcccagctcaaggaatcctccagcctcagcccctcagatagccaggactacaggcgtacagcatcacatcccgctaattttttttttttttttggtagtttttatagacacagggttttgccatgttgcccaggctggtctccgaactcctggactcaagtgatccacctggcttggcctcccaaaatggtgggattacaggcgtgagccatggcaccccacctgtttgcttttaaaaaagaaaaatggggccaggcgtggtggctcacacctgtaatcccagcactttgggaggccgaggcgggtggatcacaaggtcaggagttcgagaccagcctgtccaacatggtgaaaccccatctctactaaaaacaaaaacaaaaattagctgggcgtggtggtgggcacctgtagttccacctactggggaggctgagacaggagaattgcttgaacctgggaggcggaggttgcagtgagccgagaatgcaccactacactccagcctgggcgacagaatgagactacatctcaaaaataaaaaagaaaaagaaagaaaaatgtgttgctgttttcttaggaccaaatgggtgtatgtgaccaaagaatgttaattttctttttcttttttttttttttttttttgagatggagtcttgctctgtcctccaggctggagtgcagtggcgcaatctcggctcactgcaagctccgccttccgggttcacgccattctcttgcctcagcctcccgagtagctgggactacaggcgcccgccaccacgcccggcttaattttttgtatttttagtagagacggggtttcaccgttttagccaggatggtctcgatctcctgacctcgtgatccacccacctcggcctcccaaagtgctgggagtataggcgtgagccaccacacctggccagaatgctaattttcaagttcctgttagtgttattctgttctattaatatttggtcccacccacttgttgaattgagtgcccttcagaagaattaaaccaattagcaacaaatgacaatttctccacagctctgctagcattgaattttgtgtgtttttgttttgtttggatgactaaccggtgctttaatggtaccttacgattgttttcatgtgtgtttcttgacttcactctgcgtggttggtaagacttcaagagcagagctggagagggaaggataggggtaggaagggctctgacccagcataggaagttgagtaaccgcttagcacggtgcaaattagcctgctggctgctctatccaagaactgcctgagctgggtggggacttcccagagcgcctgtaatgctgagatctttcctccaggcaactcctccttggtttagcctctgatacagccaaacctctggattcagggaaacctaaggaagccaggcaagaagggtcccgcagcctgtgcctagtctagccccagcctcatctggattaagatgggagggaaatattggctgagggcacccagccagtatgaagacagctagaatgtaaacccagcacagtaagggagagagtatcaaggcccaggactttagagtgcctcaccaccaccaccccgccgctgggcagcctgaggctttctttgcctggcaccaccatgcctggctaattttttttttttttttccaagtggagacggggttttgccatgttggccaggatggtctcaaactcctgacctcaagtgatccacccacctcggcctccgaaagtgctgggattacaggcgtgagccactgtgcccggctatcccctcctctctctggtttcttaacatcaaacaggcccacagtgctggctcacagggccacagtgatagtgggttggtgtcctggatccctcccccaggagccatcactgagaccttatgctgtcaacactggtgggtgaagcagccctcgtatttttctcctgagacatccagagcagggtaattggcaggcgggggtgagcacacgctggctcacgcaggcttggtaggtgagaggttttcctgaggatgatgaagttggagtgtccccggctagaatccctgaggcaggagactggagccctgtggcagcattggctgagagaagccactccctttttgctctcccacttcctcactggtaagatgtgggggttggggagttatcgcagaggcgctttgggtttcagctgctttgcagaagttatggaaaaagggaaatgagtcttcctgtctctcgcccccttaacacttctttgccccatttaaggggtttgttcaacagactaggaagtatttctgctaattcatgctgaagtgtgattggctgataggtgtggtctcaacctccctcctctgccagtcactagtgtaccactgtggccatcttttccagcccctcctctgccccttgagtatgtctaggtcctagaaacagtggtcagggctcttcaagtcctctcggttgcccttgcccactggcacacgtgggggttgctgtcttcagcagagccagccactccgtcttgacagccagggcagagatgtggctgggcacacagcaagaatgtgaccactgatgctgggatgtcagagtctgtgcatcaacccagggttctgagtctgggctctcccaccctcatccccggaggttccttcagtctgggcctcctggggctgaaagggagggaaaaattggcctcagctggagtcctggggccaaccagagcctgggtggagtgtgaaagtgggcttctggccttcaccctgcccctgccctgctggtgaccttggaccatgggggttgtcggggtgtagatgagcaccgtgaatcagtcacaggccttgagcttctctctgcacagtgctggcatcagatgtgggtggtgatgtcccagcctgggaacacaggaaacgctcagggaaacccccatcagacctgctgacatggctgagggcgctgagatggtgcttccggggccctcaccttacacaaagaggccttataaggagagagaggctgcagaggcagccccagtgggtgccgggtgcttgttctgggtaaggctgcccacacgtgcaaagtgtgcttgtggacacagtgcgcttgcgtgtgtgcaaggctgaacatacatgtgtgcaggcctgcagtgtgcctgtgtgtgaggctcaacacgtgcatgtggggagtatggtcatgtgtgcaaggctaaacatgtgcttaaagtgtggggaggtgcagtgtgcatgtgtgtgtgcaaggcttaacatgcaaagtgtgcttgtgtgtgtgaggctgaacacgcatgtgtttgtgtgcgtggcctgaccctgcgctgcgtgtgtctacttgctcagcaaatgctgactggggacccaccggggtcctgttctaagcatggaggaaacatgaggtccctgccccgtgcatgtacacatgtgcatgtgtgtgtgtcctgtgctgctccaggaatcttccaggacatcctgatacaagtgaaagcaagcggtttggatctggagtgagcaggaggtggacagggccttccaggcagtgagcgcagggggctttgtgttgtgacctcgggcaggctggtcactgagccctgtggggccaaactgcagccccaggcaaaggtcgttctgcctttcccttgtgcctgggcccagatgcagtgcaggatgggccggcccctgggcagggcagtgacggggcagccaccggcctcctggggcattcagggttcccagtcctggttggctcccagcccaggccctgagacccaacacaaaactgccagtctggtgagggaggcagccacattatctaatggctgtcactggtgactctgggcaggtggcctcagcccccacatctgtcatctggagctgacctggagcctggcatccctccccaagtgcagccaggcctccctgaaagtccagggctggtgggagtgttgaagtcaagaatgtatacagagcacctggccaggcgcggtggctcatgcctgtaattccagcactttaggaggccgaggcgggcggatcacttgaggtcaggagttcaagaccagcctggccaacatggtgaaaccctgtctctactaaaaatataaaaattaggcatggtggtgcgcacctgtaatcccagctactcaggaggcggaggttggagtgagccaagactgcgacattgcactccaggctgggcaacagagtgagacttcatctcgaaaaaaaaaaaaaaaaaggatacttttttttctagagctggcaaggagggagtatccagaaagtgctggatggtactagttaatacattttattttagagacagggtctggctctgtcacacagtggtacaatcatagctcactgcagcctcaaactcctaggctaagcaatcctcctgcctcagcttcctgaatacctaagaatacagatgtgcaccaccacacctgcaaatttttttatttaaattttttgtagagatagggtctcactgtatcgcccatgcttgtcttgaacttctggcctgaagcaatcctcctgcctaggcctcccaaagtactggggttacaggcatgagccactgcgcctggccctatttaataaaattatttatttatttattatttttaagttattttttcacacacattcattcctaaccttttttttttttttttttttgagacagagtcttgctctgttgcccaggctggagtgcagtggtgtgattttggctcactgcgacctctgcctctcaggttcaacagattctcctgcttcagcctcccaagtagctgggactacaggtgtgcgccaccacgcccagctaatttttgtatttttagtagagacagtctttcaccatgttggccaggctggtcttgaactcctgacctcaggtgatccgcccgcctcggcctcccaaagtgctgggattacaggcatgagccaccgtgcctggcctcattcctaacctatgtaatgataatatttttgagggctgggtagggtggcgtgagcctgtagtcccagctacttgggaagcagaggcaggaggatcacttgagcctgggaagtcgaggctgcagtgagctgtgatcacaccactgcactccagcctgggcaacagagcgagaccctttctcaaatatacacacacacacacgtttctgagaacgtactctgttggtcactaatggcaatgaaaaatttgttcagcggatatttcttgagcacctactatgtgctaagcatttaagcagtggaaatagaaacgagaacaagatagaacaaaaatgtgtctctgccaagctggttctattccagcaggggaggaaggcagcgggccagatcagtgagtgcatgtctgatggtgactgctgagaaaatttaatcggaaatagggaattacgaagtgccggaccgtggaaggtgctgcagtttccagggaaggcctccccaaaagttgacatttgagtacagacttgagtggcagcaccagagcgagagccgtgtgtgccggtatctgggggaagagtgtcacaggcctagggaacagccagcacggaagcccgaggcaggtgcatgcctgtgtgccccaggattggcctctggttggctggggaggcctgctcctcaaagggctggtatatcacatccatcacaggctaagagtaaccgcctcgtggttcctcctcatagaggccaggtgcggtgtgtcatctgcttccagctctcagcatctctgctgggaggcaggattcctgttcccattttacagatgagaaaactgaggttaaaagaaggcaggtgatgtgtcccggggcatgtggctgggcaagcagtgccactgggctcctccacttccaggtccctgtgatgctgggaaactgagtcacggaggcggggagagatgtgtttgaggaattgggctgagaccgtgatctcacccccgtcaggcctggtgggctcctttgacactcagcggcaggtggaggaggctagggacaggctggcaggggctgagctgggctgacgggaggatgagtcgctgccctctgccagggttccccttcagtgctggggctagtctagagggctgcagtcaaacatctccctcgttctggccgagtgtagtggctcacacctgtaatcccaaatacttggcaggtgaggagggaagatctcttgagcctaggagcttgagaccagcctggacagcattgtgagacccccctctctacaaacaaatcaaaaattagttgggcacagtggcacatgcttgtaatcccaggagttcatggctgcagtgagccatgatcacaccactgcactccatcctgggccacagagagagaccctgtctcaagaaacaaaaatctccctccttcagttccccaaggctgggtcaccctggggcctccccaagagccatcacccaggcctcgcctagccctgtgcctcctcccagccctgggtgcagccagtggatgtctggatggagaatgggatgtatctgttaaatatctgcctttgcctcagccatgagcccctgcagaccggccacctcccttctccccgtctgagcagtgtgggggaagaccagggctctgggcacggcagggccaactgccatgtgctggacacctttctaggtggtttatgagattacttcatttcttttttttttttttttttctgagatgagtcttgctctgtcacccagcctcctgagtagtggggattacaggcaggtgccaccacacctggctaatttttttttttttttttttttttttttttgagacggagtctcactctgtcgcccaggctggagtgcagtggtgcgatctcggcttactgcaagccccgcctcccaagttcacgccattctcctgcctcaggctgggactacaggtgcccgccaccacacccgactaattttttgtagttttagtaaagacggagtttcaccatgttggccaggctggtcttgaactcctggccgcaagtgatccgcctgcctcgatctcccaaagtgttgggattacaggcatgagccaccgggcctggcctggatgacttcatcttcatcccatccttaatggggcaggggaagttgggtgggggggggggggtcgtccatcctatgaggaaaccgaggcacagatgacaagtgaggggcctgtccagcttggagtcctagcaccccaccccgccccagggagcatctcccctgtagtaccgtctcctccaccctgtccctggagcctcagagacatcctgtgaaagctgcccttttataaggagggaaactgaggccccaggaggggaagcaacatgtcaggccagttgggagccagggctggcccctgctgctcctctctgcaaactgctgcccctctaaactgaggggcctccctggtgtgaggcctgtgaggatcatctggggcctggtatgggtgaagtcaggggcaaggttggggctgacgtggattctctcttcctctctcgggcacaggagccaagccgccatggcctaccacagcttcctggtggagcccatcagctgccacgcctggaacaaggaccgcacccgtgagtgcttgctgggggccggtgggtggctgcttccacctcctgggatggggaccagccagagcacacatggggactctggagcagccaggcccccggaccatgggctccatgtggctgtcccctggcctcacccctgggtcttccagctgaccaggggcctcctgggttaaagtttaaggagggaatgggccagttgcggtagctcatgcctgtaatcccggcactttgggaggctgaggtgggtggatcacttgaggtcaggagttccagaccagcttgggcaacatggtgaaaccctgtctctactaaaaatacaaaaattacctgggcgtggtggtgggtgtctgtaatcccagctactcggggggctgaggcacgagaattgcttgaacccaggaggcggaggttgcagtgagtcgagattgcaccactgcactccagcctgggcaacaaagcgagactctgtctcaaaaaaaaaaaaagagagaaagaaagaaagaaaaagtgaccaagaaaaagcctttcggaggagatgacattttgacatttacccagagacccagagggggagaggaagggaactgtgccccagctggggaggggctggcaggtgcaggggccctgaggtgtcagcaggagcagcgaagggttcctggttggccagagcaatagggtggggagaggtcccagggttcattgctgcgagtaaaggacagccagttccaggagaagacagggtggcctagcagggcctgaaggacttcagggggcccctgcaaggcagaagaggagagactgagtcatgaaaggtgaggtgttgttgcctaggtgcactgtgtagtgtgtcctggcagagggcagtcatggagagggcccctcaatctccctccatctccccttcagagattgccatctgccccaacaaccatgaggtgcatatctatgaaaagagcggtgccaaatggaccaaggtgcacgagctcaaggagcacaacgggcaggtgacaggtatgtcagggtggctgggaccaccgtcctgaaaggaggtggtgggttgggggggtggtgcaaggcagggcatggccactcattgtggagcatctgcccactcaccgtgaaacccggattcaaactggcttcaattttaaggggactgtgttggctcatgttaccaaaaactcacagggttgagggcttcaggagaggcttgatccagcagctccacatgaccaagaacccatcttttctgcctcttggctttgccctccagcatgtttgctgatagcatggagggctctgacactccctcataagctctaggagtgccccctggtgtcactctaaataagcactggatctcagtaaaaagtgcttgctgggccgggtgcagtggctcatgcctgtaatcccagcacttcaggaggccaaggcgagtggatcgcttgaggtcaggagttcgagaccatcctggccaacatgactaaatgttgaaaaatacagaaattagccgggtgtggtggcacgcacctgtagtcccagatactctggaggctgaggcagaagaatcgcttgaacccaggaggcggaggttgaagtgagctgagattgcaccactgcactccagcctggatggcagagcgagactgtgtcgcaataaaaacaaagaaagaaagaggccgggtgcggtggcttgcgcctgtactcccagcactttgggaggcggaggcgggcggatcacctgaggtcaggagttcaagaccagcctggtcaacatggtgaaacctcatctctactaaaatacaaaaattagccaggcatgatggcgggtgcctgtaatcccagctacttgggaggctgatatgtgagaattgcttgaacccggaagatggtggttccagtgagctgagatcgtgccagtgcactccagcttgggcggctgagcgagactctgtctcaaaaaaaaaaaaaaaaaaaaaagattggtggtacacacctgtagtcccggctactcaggaggctgaggcacgaggattgcttgaacctgggaggcagaggctgcagtgagctgagatcatgccactgcactccagcctgggtgacagagcgagactctgtttcaaaaaaaaaaaaaagtgcctgctgggcagatacagcttccacctggatggtggcctttcagcctctcccatgtggccaccatacagccacctctgcctgagtgtcatcagcctcctgtgttccctccatccccccacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtacctaggcagggccagagtgggctgttagggaccgggggcaggactagagtgtccccgggaagcaccaaatgggatgtcaggacccctgttcccatcaccctgggggagtccatcctctcctctctgggcctcattcatgaggcaagggcctctctgcagcgtccggatgttctcactgccagtgacacccaccacaccagaaacacatctgggggcacctcactaagccctgcacacacattagtcctgacttccctgcagctccgtggactgggcatcggtcactgtccccactttacagattagcaaaggccctgtagcagtcactttctcaaggcaccactcacgagctcgcagccacatcttgttccttttttttttttcagatggagtctcactctgtcacccaggctggagtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggttggtctagaacttctgacctcatgatccacccgcctcggcctcccaaagtgttgggattacaggcgtgagccaccgtgcccagccaattttttttttttttttttttttgagacacagtcttgctctgtcgtccaggctggagtgcagtggcacaatctcagctcaccgcaacctctgcctcccaggttcaagcaattctcctgcctcagcctactgagtagctgggactacaggcacgcaccaccacgccaggctaattttgtattttttagtagagatggggtttctccatgttggtcaggctggtcttgaactcctgacctcaggtggtcctcctgcctccgcctcccaaagtgctgggattacaggcgtgaaccactgcgcccggccatatatatatttttgagacaaggtcttgctctgtcgctcaggctggagtgcagtgttgtgatcatagctcactgcagcctcagcctcctgagctcaagtaatcctaccacttcagcctcctgagtagctcggactacaggcccaaatcatttatttatttattttgtagagatagggtcttgtcacgttgtccaggctggtcttgaactcctggcctcaagcaatcttcccacctcagcctcccaaagtgctgagactacaggtgtgagccatgattgccagtccacgtcttagtttttaatctcccctgcatggctgagggcagaggccagccaggagcatctgagagacccaaatttgcatcccaccatggccagttagtagttgtgtgacctctggtgatggcatcactttgctgagcctgctctgagggtgactgtgtggcctaaaggatagagggcacagagttcccactccagaagcgacacagcacatccctgccgccccagggccctgacggccttgtgggctggcaatgcccagtcgcctctctcctgggtctttggtgggctgcagggagcagtgggagcctggagtccctggtgctgaggtccatgagtcccacctgcctgtccctctctccctgtctgcctgaccaccgttcccaggtgggtttgcaagcacatcaagaagcccatccgctccaccgtcctcagcctggactggcaccccaacaatgtgctgctggctgccggctcctgtgacttcaagtgtcggtgagacagggcgccatgggggagggcggggctgacgtcaactgactgctgacatcatagcggggagccgcacctgaaagctctacaccccagcttctagacacattccagacctgctaccagtggatgacctgggcgtcggttgaaggttctagttcctggggaacccttcatgtctcagctggatgggcctctgcccacctcttttattttttttgagctaggggcttgctctgttgcccgggctggaatgcagtagtgcaatcatagctcactgcagcctccaaatcctggactcaagcgatcctcttgcttctcagcctcccaagcaagactaccacgcccagctagacaggattttttttttttttttggagacggactctcgctctttcgcccaggctggagtgcagtggcgtgatattgactcactgcaacctccgcctgctgagttcaagcgatcaagcgattctcctgccttagcctcctgagtagctggaactacaggcgcatgccaccatgcccggctaatttttgtatttttaaatgtagagacgggttttcaccatgttggccagactggtctcgaacccctgacttcaagtgatgcatctgcctcagcctcccaaagtgctgggattacaagcttcagccaccatgcccaggcacctgttaaccctttaaaaaaaatttttttttttttttgagacagtctcactctgttgcccaaactggagcacagtagcgcaatcacagctcactgcagccttgacctcctgggttcaagcaatcctcccgcctcagcctcctgagtagctgagagtacaggtgcgcaccaccatgcctggctactttacctctactttgcctatcccggtaggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggcgtgagtcgaggccatccccaggggaggaggtgagtgcagaggagtgggacaccgtgactcacagctctctcccctcagcgtcgcgactctggcctctgaaacactaccactgctggcgctgaccttcatcacagacaacagcctggtggcagcggtgaggaatagggaggggagggagggtgtgtggtcacagcaggcctccgagagagcccagcaactctcatctcctccctcctttctcctgcctccctcctttttttcttccttgcattctctcatgtaccagaattgggcagaacaggttgggttatgctgcagtaaccaaaagtccctggctgcagttgcttaacagagtaaagatttggccaggtgcggtggctcacacttaaaatcccagcactttgcgaggttgaggtggaagtatcactggaggccacgagtttgagaccagcccgggcaacacagtgtgagacccttgtctctacaaaaagttaagaaattagctgggtgtggtggtgcacctgtaatctcataatcccagttacttgggaggctgaggcaggaggataacttaagcatgggaggtcgaggcttctgaactgagctatggtcgtacctctgcacttcagcctcggcgacacaaaacctgtctcaaaaaaaaaaaaaaaagagccaggcccggtggctcacacctgtaatcccagcaatttgggaggccaaggagggcagatcacctgaggtcaggggttcaagaccaacctggccaacatggcaaaaccccatctctactaaaaatacaaaaattagccgggtgtggtggtgggcgcccatggtcccagctgctcgggaggctgaggcaggagaattgcttgaacccagaggcagaagttgcagtgagccaagggtgagccaccgagactccatctcaaaaacagaaaaaaaaagatatttacttcttgctcacattttatgtccagtgtgggtgttgtgaggtgctctgatggaagctgtccccagcatgctgtcccagatgccacgagggagccggaacctgcggaatcatgccctgggtcttaacatttctgcccacattttattggcaggtgcaatggcaaggccacgcctaatgcaaagggcgagagttcggggtgtgcggttcctccaggtgtccaggaagggcactgctctccctcccctccgcccacatctgtcaagtcccttttcacccctctgcaaacataatgggggtgccagggccaggtcaggcttgctttttgcctagaaaagcaaacagctgcaggggtctcccctagagcaggtgtaactggctgggcaggacagaaggcgcctgagctcccagggagtcccaacgctggccttgctgggggaggtggcagcccccagcatcacccccggttttgatacacctgcaattcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcaggtgagagcgggagccgggccggcgggtgggcggggcctcggctcgcccagaaacagcgtcgggtgaggaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataacatcgttagttgtgggcggggcccatcttgatctcaccatagcagcccaggtgctagtggagcctgggagggacacggtgcgaccgacataagacggggtcgacctctttaggttgcataaaaatagcatcagatggggctgagcagctagcctcgctctgcatttccgggacttaggtggggactgtcgtagggctggcccctacggttctctggggtggccaggcagtgaccagcgggcttcctgggcggggtcacagctggggcgggtctattgctagcacttagcgaggtgggggcggagctgagggtctctccgcagccttctatggatctagggtgggatggggaagaggctcttcaaagcccaaaagctgccagccacacgtgtccaccccgcggcgaatcagagggagcgggagctgtatggcaagactggccaagcccttcggtctgtaaaacctcctgtgtccgccagatccgatggcttcctcagatgaaacacctttgtccagctatcagcttagtccctggctgcccccacccccatctccttttttgtcctgtccagctgcactgctggcactgtgtacactccgcagacacacgtgtctttcctgcctcccaggacttgagtgtcctgtcccatttgcctgcacctcgcatgccactgtccccaaggcagaactgacttctaagcccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccaggtcaaccctttccccccatccccactccctggagatgacccccatccttcactcctgcagagatggcactgcatggggatgaggggtgggggcggccccttgacatctgggccttggtgctcactggggcacccgtcttcagggccgggattccaacccagctgacagactccaaaactgcaggttctctgccctctgctgtgctggggctgagatgggtgatcaggtccctgggagtggggtgcctgcaggacagctgagaaccagcctgtccgttctgcctccctgcagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaa

SEQ ID NO: 12 - DNA, 14007 bp, Homo sapiens
ggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggtgaggggcgggcgccggtggcccgcaggcctggaggggcggcccaggtccggcttccgctgtcccctcagcccgtgcgcgtctctgagagcagcgcagagggaggctgtccgcaccggctgagagccaggcctgggcctcgacgcccaattgtcccgatggggaaactgaggactgtggtgtcccagagtcactccgtcagtggtctgaggagtttcggaagctctgggtcctcgccggcctagaaagccggatctaggatgcgcttctccgggtctaggggttctggaatttatcccactctttggctggctaggaactgagtcaccgcgtcccgcgcttgtgccgggcccgcctgcctctcgcgtaaaacgtgggctttttctggcttcggttcagccaggcctgcctaggaggacttaaggagatgcccatgagccttccagacctggtttcgactcccccgttcggtagcggctcggtgtgttcctttgagccagtcgctccacctcctgtgtctccgttttctcatttgccaatgggaataacgattgtacctacctcttagtactgttgggaggcttcaactaggtaatccacgtggagtgcgcagtacagtgccaggcagtcgttaaaagtgcccagtgaagcagtaactattcttatttttaaggctttgccagctcttgatcttgtaagtaggttcatgactgcccagtccattgtagcccgtcctctatcttctagcccgttctctatcctgtttccccctttagaatcgatagtccccagtttgaatcccagctatgtcacgtctaattctgtggccctgaacaagttaacctcttcctcatctgaaacactgggctaatccttagcttgttgaattggggccggggtggtaaaattatagcgctcataaagtgcctggccacctcctggcacagaacaaatatatttgtgttggtagctcatgtgttatattggttaatgcactcaacccacagaaacatctgcctgtagcgttttcaaacctaaatcgcttcctgactccagagataattgggcattacagagctaaatgtgtttaaacctagctctctactgatttattctgtggctggaaaagtctctctgctattgttccccagtcccttcatctgtaaaaggaggttgctgaatgagccatcctccctccgaagttttacttaatggatactttgggtaaaggttggaggttacaacgataaaaccttaaatatgaattcatagctaaatggtctttgggcttgtgaaaagctttttggggtagacaaggtttacattttcttgggttaatctgaaaaccacaaaaaaccgtgaaggtgttaaaagtatcaaactccctaagagcaaaggaccaacgcttgtttccattatgttaagtgcaaatcgttttttaaagtcttgaagagtctactataaaattactgtggaccaagctaaggtcagggtcccatagccaagtgcatgagaggagagcctatagtaatcaattttgagttgttactgttgcctggtgtattaagagagcaagaaagggtgttggtttttttcttggcacacttgctctctcacaataggactttaataagcatagacttagacacccctgggaacctaggtagtcattaaaaatgggtggtgtgatctttagcagcccaattatggctttgcagctgctgtaaggaatcagaggaggccagtatctctgctaccgcctctggagtgcagagcaactctggctgattacagagtctctgctcacagagacagactatggaaatcaggtgggcctcagcttcctgtgtggaagttgaggccacagccacccttgcatacttggggaccagcagagggggatgccaccttgctttaaaactggctgatggcttaagcaagggtcagcctggtgttctggctgaagagggtcagactataaaactgacactttaactgctagtcacatttttaacttttagactgtgtagtcaggtttgttttcatctgtactttgccagtcatttcttagtctaagcacaaagtttttgcctgtaggtttgggtttcttttttttcccttaagtattctctttttgccatactactaaggtgaacacaaggtattttattgtgtttccaacatctgcagtaaattgcttatgtgctcagtggtgcttttgttgttgtttttccaccaaatactagattagagggaaaagtaacgaacagcgatttttttatttttttgagacggagtctcgctctgtggcccaggctggagtgcagtggctcaatctcggctactgcaacctctgcctcctgggttcaagcgattctcctttctcagcctcccaagtagctgggattacaaacatgtgacaccatgcccagctaatttttgtatttttagtagtgagggggtttcaccatgttgaccaggctggtcttgaactggcctcaagtgatctgcccgccttggcctcccaaagtgctgggattacaggcatcagccactgtgcctggatattagcgaacatttttgtagtgcttattcagtagcaggcactgttccagcagctttctgtatattgattaattcatctatctttgtgacaaccctgtaaggtagggacacagatgaggaaactgagactgagaggttaaatacctgcccaaagtcatcaagccagtaagcgtagaacctgggagttggactctaaacttcgtggtgtttcgcagtctgctttggtctaagtctcctggtctatgaaatgggaccagctatcacccctgtaccataggtttgttccgaggatcaactgtgcccctggctggctgggcgcggtggctcacacctgtaatcccagcactttgggaggctgaggtgggcagatcacgaggtcaagagatcaagaccattctagccaaccaacatggttaaaccccatctctactaaaaataaataaataagctgggcatagtggtgcacgcctgtagtcccagctactcgggaggctgaggcaggagaatcacttcaaccagggtggtggaggttgcggtgagccgagattgcgccactgcactccagcttgggtgacagagcgagactccgtctcaaaaaaaaaaaaaaaaaagtgcccctggctgtgacagaacatcgtgtaaaaagcccttatagtgacggcagggatgtaagtggtacatgtttctgtggttgcatctgagtccactatgcttggattgtaagggaccaggggatgtagcaagtcattgcagtgcaccgtccgccatgttctcccctccggtcttctgtgtaggagccagcatttagtacacagtttggtgatgcatcagatggtcacgagttgcttcctgcgtgcctttgaacacatgagggtggcggaggtgtcggtttgggtggtgctgggtgaggggtaggtgaggcctccgatgagagtactccaagcaggacacagccctctgggggtcagagcagtcaaggcagctgcttccgctcacctaaactgcgggtctctgcaggaagaaagggaggccacaaaggccgggcgaggcagtatacaagccctgaggagatcgacgcgcagctgcaggctgagaagcagaaggccagggtgagtacgtgcctgtccaggccacgccagtggcccagggtggcgctttgccaatttggttcatagagaggccaggcaaggactacccattcgcagggacaagccagcacgtgggggtcgggcgggcagtgagccccaggtgtgagtctcagaacaaccaatgacagtcagggcgtgggcatcctctgcctggatgggttagaaagaactgtggctgctctgcagcagctgctttagtggggccctgttcttggtcttgtgcacctactttcaggaggatctccctcctgcaggacctgtccattcacagctcgagctcccagcacccctgcttgtctgctgcagccacacaggatgatttgccacactgcacatgacatatgccctgccttcccacacccccagcatcagcatgctctccatccctggagacgttgtttagcctctcctcctctgtgactcatgcctcacctccagccagagctgatttagtagttccctctcctctgctcccatagtacattgtccaggccaccgttaggaaatagaatacattcccatcgtcagcatctgcatcttaccatatcattagattgatgcctggatcaagggcctaagggagcagtcagggccagatgggtacacagctgtgacgtaccccaggagtctcaagaagggaaaggccacatccagctgtggggtctgggaggggtccttgggggagccagcagctgagcaggacatggagaatgtgtgggcaggtgccaagaggtgaagggacatgaggttcctataagggacatttttggtgggaaggcaagaaaggtggagggaagcagccttccgaggtgttgttctggggagctggtgcaggaggtcacctgtgtgggtgggtcggggggatgacttgccatggagtgggagtggagtgcggagaggactcgcctgggaatgccagcatgatttggcagctgcatgtggcaggtgggagctgagtaggatggtggttttcagcctggtggctgagtccttctgaccccaggaaacaagcttctcaccctggctgctgaggtggctgcgttaggaaggggagcagggccttctgtggctgtgtgaggggcttcctggactatgggaatggcctctaagctgtggtgctaagtgcataggctgcctgtgtctggcccaggtcccattccctgggggccagggtcacagtaggacccttgtcatccttggttccagccttccagaggcttgatttctcaagatccacagtctggggggtgatagggtcacagtcttggggatttgttttgcatttttgattctgcaggttgtccatttctgaaacaggaagaagaggagcaaaaagaaggtggagatggggctgcaggtgaccccaaaaaggagaagaaatctctagactcagatgagagtgaggatgaagaagatgactaccaggtactgagttcttttgagggcctagagcctggactcattcattcaacaaacaaacgttgagtgaccgtttagtactagtcccaaaggtagatgcagacaacgtccttgctcttgagggtttacactacgggagatacaacaaagaagtaaacagacagtgtcatttcaagtaatgagaagtgttactaacaaaacagactgtgattgaggggacttggaaaagtgttgtggtggtgaagcaacttataaactgagatctgaaaaaacaagatgcagccagctatgtgaaaattggcgtgcagagcaattgagaaactggattagcaagtgcaaaggtcctgtggtgggaataagcttggcatgttcaaggaccagaagggggccagtgtagctgtgagttagtgggtaaggagcggagtggtccagatgcaggaggagaattggcaagggcacctcctgtgtagctgttgaaggggttggcatttcttttcttttcttttcttttttttttttttttttgagatgaagtgtcgctttgtcactgaggctggagtgcagtggcacgatctcagctcactgcaacttccgcctcccaggttcaagcgcttctgccccagcctcctgagtagctgggactacaggcgcctgccaccacgccgggctaattttttgtatttttagtagagacagggtttcactgtgttagccagaatggtctccatctcctgacctcgtgatccacccgcatcagcctcccaaagtactgggattataagcgtgagccactagcccagccccctttttttttttttttttttttttttgagacagggtctcgttctgtcacccaggctggagtggagtgaagctgcagtgaagcaccgcagcctcagccttccaagtagctgggaccaaaggcacacgccaccacatctacctaatttttaaattttttgtagagatagggatctcactatattgcccaggtggtctccaactcctgggctcaagtaatcctcccacttcaccctcctgaggtgttgagattgcagcagcatgagccaccatgcctggcatggggtttctttatggtaggtagtggcagctgggggaggccttgaagggattgagagacatgaccagatatgcttttttttttttttttttttgggagatggagtctctctgtcgcccaggctggagtgcagtggtgcgatctcggctcactgcaagctccgcctcccgggttcaggccattcttctgcctcagccttccgaatagctgggactaccgtagaggtagcgtttcaccatgtcagccaggatggtctcaatctcctgacctcgtgatctgcctgccttggcctctcaaagggctgggattacaggcgtgagccactgcgcccagcctccagatatgcttttaaaagattattttactttgggaagccaaggtgggtggatcacaaggtcaggagatcgagaccatcctggctaacacagtgaaaccccgtctctactaaaaatacaaaaattagccaggtgtggtggcaggcgcctgtagtcccagctacttgggaggctgaggcaggagaatggcgtgaacccgggaggcggagtgcagtgagccaagactatgccactgcactccagcctgggcgacagagtgagactccgtctcaaaaaaaaaaaaaaaagattattttagcttcttcatggagagtgaatgataggatgttgagagtaagagcagtgttcagatcagaaatcctgggccgggtgtggtggctcacacctgtaatcccagcactttgggaggccaaggcgggcggatcacctgaggtcgagatttcgagaccagcctgaccaacatggagaaaacctgtctctactaaaaatacaaaattagtcgggggtggtggttcatgcctgtaatcccaaatactcaggctgaggcaggagaattgcttgaacccaggagaccgaggttgtggtgagccgagattgtgccattgccctccagcctgggcaagaagagggaaactctgtctcaaaagaaaaaaaatcgtggcttgccctaggatggtgacaatggcagtggagaagagtggacaaatttaagctgtatttgggggttgctgaaggaacgacgaatcaaggatatgcttaggattgcagggagggtccggttgggtaaaggatgaatctcgagttctgtcttggacatgttaagtttacagtgccaggcatctgagtggaggtgtaagtgtgcagctggactggaagtgtgtggagggagctctgtggagtggaagctgtctccctgcccccttaaggagaattgatggaattgacagggcctgaaactttgaccaaacctgctgcattgagaacacacccccttcttctggaacttctgcaggggaggtggaaggtgcagattccaggtttttgggccagcgtcccaaacctgtagagtgtgtgatccagtagcttattcttgggttacaagtccagtccatcagctaaggtgggtgggaattggaattagtcatgacagcacacacttggcccaccctgccctggggattccagcccagcgctttttgcaagaagaatcaggcatgggattccatggaaaactgcttttggaagccgagcttgaagtaggggagtagtgctgtgtgagtgcttgcaagtcggggtagggcgcacctctcatctaccacctacttcctggttgacttgggcaagttattcgaccccgagcagccgttctgtgggctcttcccaggctgatgaagatgctccagagagctatacccactgtgagacttgggctgagcactacgtgggctggggtggagcaggagtttgtcctcatccagatgggctgttgagagatggcaggagtggccctcaggggctccacaggacctgaactccaacaaccagcttcttgccctgttctagcaaaagcgcaaaggcgttgaagggctcatcgacatcgagaaccccaaccgggtggcacagacaaccaaaaaggtcacacaactggatctggacgggccaaaggagctttcgaggagagaacggtaacatcactggctgggccttgtgtcacggggaatacaggccagcagttggcctgtgggatgctaaggtccccagctggctgggagctgtggctgtttatttctgtctcattccccaatggccctccagtagcctttaaaaagccacacagaatttgttttcaccaattgatacatgatatcaggggaaataggacaacaggctcagacctgagcataacacttgaggtaatggtgcaggatacagagggttgccctccattcccctcttccagagcaccacaccctggggagacttcccttaccccactgatctgaccattcctgacctgcatccatctgtaatgtcgtggccatggggactggaagggggctgcgagcctgtgccggccagaaggcagtccagcccagcgcagctcagccagctgtcccaggcctctgcaagtcctgtgtgaaaatgaagctgtaaatatcttcctcaagagtcgtatgaggatcaagatcatgtactgaagtgcctggcacaggatcagtccttgactggtgccctgacttttggcagccaccaggtgacctcaagggccttacaagaggttgaagcctgctagtttctctcctgactgggaatttaggataatggctgaggggtgtgtctgtgaaagcctcgtggggaaggccatgagcttgggtgtgattgcagctgctaaggacccttctgtcccccttcagtagcttcctcttggcattgacttcaaaaacccagcaacctgggtgttctgccactgtggtattctgccattggcagctgtgcagccttcgataaggctgtgcctttctgggcatcagtgtcctctccagtaaaagggatcctgttgctccctccttctgtcctttggggttgcagagacaccctgcctggcattttgctttcactgaagggccctgcagagtctttgggctgccttagtcatcattcctgaggctcagcttagaggcttctgagtgtggcacatccctcctgagctaggatctgcggttcgccaggtattatctcctcagctctgtagtgaggcatctgctcttcccactcgggagtccctctccctcccctctagctagctcccatgcctggtttctcattactccccagttctgtgtaccttgaaggcctctgggaggccgagtctctctcccagcctcctgccaggcagggccctcccctcctccagcacttggctcttccaggaacccagtgcaaataggccctccgatctcatcctgaagggcatccactccagttcagaatctcaagcttgggaagatcctcaaaaggaagctaatgaccctcaccactgactctacttagggggttcattcctgacactttgtcccatgggagcccagcaattattcccatctccctactgatgggggctgtccccttggggggcagcaccgtgcacatctgagctgctctaagaatgggccatgtggtgttgacctgagactgggtgtgtctgtttcccactgtggtcctcatcctatgccctgtggctgcttcctccacttcttcattcctttttttgtttgtattttttagagataggatttcactctgtcacccaggctggagtgcagtggtgcaattgtagctcactgcagccttgaacttctgggctcaagcaatccgcctgcctcagcctcccatgtagctgggagccatgctgccttagccatgtgtgccaccacacctggctaatttttaaattttctattttgtacagagtcttgctatattgcccaggcaggtctcaaacttacagcctcaagtgatcctcttgtcttggcctcccagagtgctgggattacaggcctgagccaccatgcccagcccttccttccttgtaggatgtggtccccactgctttcatcctcctggtcatcttctctggaacactcttggcctggtcccccttctctccatggccgccagagcctgatcatgaagccctcaggcatcttcccctccctgctgtagctggacattgtcccctttccctctgaggctttctggacatcgcagatgttttctccctgggcctctccctcctgctcacttgcttggtgaacgtccaccaagcagggggttcatggaggcagggactcacagccagggcaccccttccacctcggccctaggccgaatccttggcctttattctgactcccgtccagtttggcaaacagtggtaggaaagatgtccccatgacaccattttatccacacagagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaaggtaagggctgggctgcgcacgcagggacaggccccaactctggtcctgggccagccacaaagcactgaactcgtgtccctgtccgcgaggtgacaatgaggtgaggagtgactgctgcctaggaggtcgttcaggagagggccaccctccctgtgcctgccactccctcggggaccaggagggtccagcgacatcatggggtcggatgtaggttgaagtctcagcagagcaccgtccacagtaggtggacagtcactcctgctcccaacagcgggaggtcacaggaaaccatgcccctagtacagaccttgcctgaggctcacaggtcccactaaggtctctggtgccttgggaacccaggagagatgcctgaggtcaccgctgtccatctgcagggcttgggagggtgagctggatacacagcagtgcagactggcttgacatccagcccaggcatcccttttcctgtgctctcccctccaggcaggccagagatggtggaggttcctctaggccagagtggctatgggagttggtccagtttataggagcattcaacttgcaacattccatctcccgggggtctgtgagagcccctacatgtccatctgtcctgcctcctcaccagaccatgaggaagcaggcctggaaaggggaaaccaattgctcagggacattgtcacccgcaccagaaatccagtgatcccaacttcccattcaaccctgcttcacaaaccccaagcaggaaaggacttcacatgtaactgttggaatgtttaaattttagacttcagaacccgtggagggaggttagaattacagggttctgctgggaggtggggtgagaagtttccgtttgcccacaagagtgtgtgttggtggggctttgtggaaggaacagctttctataaggtggtctggccactgaagcgtgtcgggaatgtcggggggcccggggttacagctgcagcagaaatcctctcccacgcctcggctcttctctgttgcacagaatgttttctgcagcctttcagacctaaagttctagggttctggcacgtgtgttgggagggggtggggggttgctttgttttaacccctgcccttctcccacccctcagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctacctatggccgtgcaaacaccaatctctccctggagtcccagctacttgggaggctgaggcagaaggattgctcccacgagttctagtgcagcctggaaaacttagcaagaccccaaggaaataacaaaaaacctctccttccacataggcaagcatgtccataattacttttttttttttttttttttttacacagttgcattttattacctccacattttgaagcagttcatgaccagcatagtgctttgggggcattttttttttttttcaataaatgaaagcatttaagaa

SEQ ID NO: 13 - DNA, 35314 bp, Homo sapiens
ctagtctttcagccttcaggctgtttttggcttgaaggtggggtttcaccagggacctgcccctatctgcctaggcatttggctgcctcctgtcattatcaccagggaggtgcctctacctgccaaggttaccctggctctagaagcagaactttggccagaagctgccacagaacaggggtgggagagagaagaggagctgggtgacagagcagaagcattttggggaactgatccttcaggcagcagctgatgtacttcctctctcctccacactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggtgagtggaggtgcctctttccgggcctcctctgtgcatttgttattatgattctcaaccccattgcatttcggaaacctaacctctggggagattgaaaagaacaaaagttgcccaagctccacccctagacagcctgatttaactggtctgggaggggccccaggcagccagttttaaaagctctccaggtggagagcaggtgaggggcagccagggttgcctctttctccatcttctaaattaaaatcattctacaagtgtctttaacacctttgtgaaggctgtcctagtcgtactttcttctacacagaactccttctgggcacagaatctctatctatcccagcgctttacacctgattattgattctaaggcacctcttttggctttccaagactttcatgtgtgtcgactttgcctgctcaagagatttaagggaggcacttacaaaaaatagcttttatcccaagtgacaattctgatcaattataaaggagactcttttaaagatgctgaggctggcaagaggaaattgtactgtgattgactagtgatgtctgctgggggcatggtgtgggatgtctcgcatctttttcgttatgttttctcactcaaataccatagtatggagttaagcattctcgataattatttttttgattggttgtggtaaggtggaaagggtatggagtttggaaggagaagatctaggatcgaatcctagcctctgtctctctctggacttttagtcttaagcaagctatgtagcctatgtagacatctggctttcagcttcctgagtttctaaatatcatgaaaattaagtgagatgccaaactattaatgtctcgtggaacttcacaccactgtataagagttagttattatttttaccgattactgccagtctttgcaaggtgtggcagtggttgactccccaggtcccttaaagaatcagtcccttccacactccaacagtaggtaaacaagcctcagccacaccctcctgacaggaagacagagaagtgactgaaatgttctcacatagcttgacaagtcaatctcaggctctaaggcagagcatggcaggaccccccacctctggctggaggaaggacatggccccacctcctctcaggggcctgctgaggggctgagtgaacagcaccacacattctgagggctgatggacacaaagtgcacattgtccaggagaagagattggcagctagtctgggcacagctatgccagcagggactgtagcctcctgccttggcctggatatgggatccttggcaaggttgtgtgggccaccactcacttctcagctcccaggccttcaggcccacatgtctctgtttctcctggcattcctctgcttctagccttctcattccttctgcctttctttgttttcctgcttgagcccttcctactagcatttatatgcattcttattcattatcattttaattgtatactattcatgtataagtttgtatagtaaacaaatataacaatttatataatattttaattattttcatttgcaataaattttattatttatttaaactgaatgttcaatacattcataggaatacaagaaatgcaacaagggttaaaatttcattattacattagatatcattttttctttctttttttttttttttgagatggagtctcactctgtcacccaggctggagtgcagtggtgcaatctcggctcactgcaacctctgcctcctgggttcaagtgattctcctgcctcagcctcccaagtagctgggattacaggcatgcaccaccaagcccgtctaatgatgtttcatttttcaaagaagcttctcctatttccctatcttttttatcttccacagagcaataaatagtaattactactctcctggacaaggtgctctgttgtgttggataggaattgtatctttaagtttgacatcattatcacctccaaaaactctaccttcacttcatagcacagtctcgctgcattgtttcacagtaaaattgtactctactcaaactaggagaactcaaagaaattagagcaaacagcagttaaattcatatgaatgaaagacagaagaccaaagattttaaagtactgatttagtaacatagtgtctactggctcaaagcttctatctaatcatattaaatcatattattaaaacagcgataatagaaatgaaagctacactaatgaaaaaggaacttgggaatgaggtcattaaatataactaactatattttaaatatagatatgtattttttattagtatcaggtaaatgtctaaattatctattctgaattctagtctcagagaaggtcagagacagttacaaagaaggcgcttcatattgtcaagtccatttttaaaatgatgagctcctttgggaaaatgctttagtgtttcttttcttctaagatttctgttggtgataatccattagtgtctgcacccttatagtccactttgtctttatttgtatcattggattttttttttttttttttttttttttttttgagacagggtgccttactttgttgcccaggctggagtgcagtggtgccgtcacagctcacggcagtctccacctcctgggcttgagcgattgacctacctcagtcccccaagtagctgggaccacaggcatgtgccaccacatctgactaatttttaaatttttcgtagagatggagtctcactattttgcccaggttggtcttgaactcctgggctcaagtgatccacctgccttggcctcccaaagtgctgggattacaggtgtgagcaaccgcacctgggaattattggattcttgtgtagcttttctaggccatatatgactaacaaaagcagaaatcagatggtatatgtatggctccaggaatgttttgtagatccacagcagaactggaatgacaatacaaggaatgcacaccattgtcccagacttcagcttctaaatgtgagagcgaagtggggtgcaccgtgagagcacagggtgggcctcgaggtgccgacgagggcagacagcagagctgggcaccacagggagctagggctctgtgagccgtggctcatctcacacctcctcactgccttgcatcatggccatgtctggacccttctctcctcaggcctttaccagaagcattaaccgagacaagcacttggcagtggcttacttccaacgagggatgctctactaccagacagagaagtaagtggttcaatgttgcaccaactggaggatttcagagagaaacccaaggggtctcagtgttgcgggcttggtgtttgagcagtaccttcccaacctctgttgggaaatgtgactggcccttctggggacagttatgcaataaatcagcaggtgaggcagaagctctcactggggaggcaaggcaggtctgccaccagattataaatcagctgtgtcataggcacaatgagcctaggtaaccaccatgggcctgatactcagctggtgtgacaccccaccagtgtccctgatggggtcacccatgtaggtctcctatgaggtactgagctgtcacagaatggggatgatcatgaaactgcatcaaaacctggcttcatcccagcaaaatgcatttccaaaacctggtttaatccatttgaggaaatatacttcagctgcaaaaatgataatacaaattaacattatatgtataagaataaattactacagataagtaagtagcgtatgcacttatacagaaaaagtttgcagtagatgttaattttttttctttttccgagacagagtttcactcttgttgcccaggctggagtgcaagggctcgatctcagctcaccgcagcctccgcctcccaggctcaagcgattctcctggcttaccctcccgagtagctgggactacaggcatgcgccaccacacccagctaattttgtatttttagtagagatggggtttctccatgttggtcaggctggtcttgaactcccgacctcaggtgatctgcccacctcagccccccaaagtgctgggattacaggcatgtgccaccacgcccagccagatgttaaatttaaaaacagatttcaaaacagttcatatagcatagtcccatttctgtatcacagaataaagtctggaaggccatagatcaaaatgttatcaataattctctctggatggtgggattataggaaaatccattttcttctatcaccctgtctgcatttttaggtttgtttatagtcaacatggaataattagtacaaagattaataaattcaaaatgaaagttaatctcaattcctcctccctctcatcctgcacaaatacctcataacaaataacaaaggaaaaaaattctaagtgataatttcaaatgttttggggcatgggaaactgaccctttgtagaaactgttccaccagtgtgcatcagttctagggaagaggaatttggctcaggctaatgaagaattttttttttttttgagacggagtttcgccctgtcacccaggctggagtgcagtggcgcgatctcggctcactgcaacctctgccttccacgttcaaacaattctcttgcctcagcctcccaagtagctgggattacaggtgcccgccactacgtccagctaatttgtgtatttttcagtagagacagggtttcaccatgttggccacgctggtctcgaactcctgaccttgtgatccacccgcctcggcctcccaaagtactgggattacaggcatgagtcactgagcccagcctaataaagaactttctgacagtgaaaatgatctgtgcatggtgtgggtggggtgagggtgaggccgggcgtggatggagcagcagggaggttgtagacaatgtccagacatcagagagagggctgggctctgatcctgtgccaccctgaaaggctttgatcctatggtttggtcagaaacagagcctgtaaaacccatgtatgcagctgttgctaagggcaaccacaagatgctcaaaggaccttaaagatgtagatgcagttagttacctgaagaagtgaaagtagaagtgaagtcttttctaaaagaaaaaccacagacacaatggcaatctggggagaaagagagcctgggattgggagaagatatccaggcatttagctctctcttccccccatatttagtgtgacatatttattgtgactttataaattctttttttaattttaattttttattttaatgtttgtgggtatgcagtaggtgtatatatttatgggacacatgagatattttggtacagcaggtgtttatcttgaccgacgtcttgcctctaactgcctgtccccgctcttaacatccttctctttctcactcccccttaccccgtctccagactatagaatatgcagggaggcctaacaacaaatccttcagccgatcttaaatctcaaaacgcaaactctaaggtcattccttagtgacctctaatagtctataaagaagagatacaactggcaaaagagtgaaggctcccagaaagaatttcctccaaaaaatgcccgtgagtcccaggatctggaaggccacggttttgagtgattagaaagatcttggaaacttctaaaagtaagacccaggattcaattaatctgtgattggtaatattaatagttacacctgagagaaaaatctaccgagttttatctgtaattcaacaatgaggaaattatacaaatgaggcactaatctcaacctcaagcaggccctcttgcgcaattccctaggtgttggtattccctttgaagttctgttcttgacccttttcccttttacaactgcagcagtggttgttaaatggcaaaatgtgtttccagaaatacactttcaagcacacacattcgtttatgtacaattcaggggctatagatatgaagtccgtatgtgaaccttgaggatccattcctgggcaaggccaccctctcccatatggctggcctccatttctcacagaatctgtacctgagatccatccagggaatgtctctttccctaaacctcatcaggttgacctcttaaatatttcttaaatccacctatttctctccatccccactagcactgccttggttgagaccctcatttttcaccaggactactgcagtcacttccaaactgattttccagccactgctcttgtcccctccattcatattccagagtgatcttgtaaaataaaaaaaaatttaaaaaaagcaatctctgtgagaacttccagtggcttccatgactgcaagataaaggccaaattcccttgcctgttcctatgtggtccagctgctgccacccactcatgcatcctccgtgcctttgccccagccatgcccaaccactaaggcagcgtctgctccctcttttgagcctccttttgtaatatgtctggcccgtgacagatatttgcttcctgtatatatttgtcttctccactactctacgaatttcgtaagaaatctttacttactcatgcttgtatttcagtatctagcatagtagttactcaataaatgagtgttggattaaataaaagtgagcaaaatatagtctccgtttcaaggaacttataaattaaaaaggggaaacaagtcaagaacaccagtaactgtaatgcaaggcagaagtgggtaactgctgtaagaggtagttttaagtaagcgggatgggggctagagaaattacttcttaatgtgtgggacagaaattccctcagattggctgggcacagtggctcacacctgtaatcccagcactttaggaggccaaggtaggcggatcacctgaggtcaagagtttgaaaccagcctggccaacatggcgaaaccttgtctctactaaaaatacaaaaaattagcagcacatggtggtgggtgcctgtaatcccagctacttgggacgctgaggcaggagaatagcttggacctgggaggcagatgttgcagtgaaccgagataacaccactgcactccaacctgggcaacagagcaagattctgtctgaataaaaaaaaaaggaattccctcagattacaaaagggaattgtttaaggctgataatgttatggatggaggtttttccccctctatttccctctattttccccactttcgtatgtttttgtgttgctcttccgtcattataaagttccaacagaacaaagttagagcacatttctgaaaaggcaagcagagtctcagggataacagccaagctgtctcgcctctctagccccagcgttgtcatctgaaaggcacaggggctcgaagctgtctttcagatcctgtgccttatgaatcttagggcatgacaataagggtgagacccattccatggagctggcttaaagaggctccatagcaaagccttcttcctgctgacttggaaacaggaaagggagtgggcccaaacctctgtcacagcagccactgcagcatcccaaagatgcctgaagttttgacttctttcagcttgctgagattccattgtcctgggtgcaggtgtatgagctgtggactctggacgcatggggcactggcagcatgggaacaagcaggttactaagaaacctcccaggagtattacagaaatggggattataaactctctcaagcctggagcttgtgaaaagctatggcaaggttgctgcttcagctggtggatcccctgcctgggaggggaggggctttgggtccagtgcagccaaggcgccccaaggggtgtcactgaagtgtgggtgtgaagaaagcacccatgcccagcccagcagagccctgcaggaagctgccagcaccttggctgcctcctgggggatgcttccaaatggccacgaagagaaccgctgaagaagggctagagggaggcgggggctgccgcagcacggcccactggcacacagcgctgaatgctattttgggattctcatactgagattattgcgaacctgtgtaatgggaaaagagctgtgtgtcaaagcggaacccccttcagggctgcagctctgggtaaacaagtggagaggccgaaaagaggcctgcagcagggaacgagggggctgggaagcaggccggtgctttcagagacatgtttaaaaacgacacttagttggcgaggcgaggtggctcacgcctgtaatcccagcactttgggaggccgaggcgggcggatcacgaggtaaggagatcgagaccatcctggctaacacggtgaaaccctggctctactaaaaacacaaaaaattagccgggcgcggtggcggacgcctgtagtcccagctactcgggaggctgaggcaggagaatggcgtgaaccgggaggcggagcttccagtgagccgagatcgcgccactgcactccagccagggcaacagagcgagactctgtctcaaaaaaaaaaaacacttagcaaggatgccccttccccgttttaaaaattaattaattaggccctgtgcagtggctcacagttgcagtctttgtactttgggaggctgaggtgggaggattgcttgaacccaggagttcgagaccagcctgagcaacatagtgagacccccgtctctataacaaaattaataaataaaataagtaatctttttttttttagagaaggggtctcactatattgtccaggctggcctcaaactcctgggctcaagtgatcctcctgccccagcctctggcggagtagctggaactgcaggctcaaacctcagcccctggccccaccctgtttttttggttgttggactttcttttctttctttctttctttcttttttttttttttttgagtcaggatttcattctgtcgtccaggctggagtggagtggtgcaatcatgtctcactgcagtcttgacttcctgggctcaggtgattctccaacctcagcttcccgggtagctgggactacaggcacgtaccactatgcctggctaattttttgtacttttagtagaggtggggtttctccatattgcctaggcgggtccaccctgtctttaaaacaaagcaaaccctctgaataatttgtcagttctttctctctctctcctaccaggcccaaatctgtagacaccttttttttttttttgagttggagtctcgctctgtcaaccaggctggagtgcagtggcatggttttggctcatttcaacctccacctcctgggttcaagtgattctcctgcctcaccctcctgagtagctggaactataggcacgcaccaccacgcccggctaatttttaaatatttttagtagagacggggtttcaccatgttggccaggctggtctcgaacccctgacctcaagtgatccgcctgccttggcctcccaaaatgctgggattaccggcacgagccactgcaccgggcctctgtagacatcttgatgggctagggaattattaggaggattttgctgggctcatgcaatgccagatagacccaggtggtgtcacttcccagctgaaatccatctgcttagccaactcagcagggaggaaggcacgttggtaggttgatgctgacggcagttaaagtgtgtgccctctgagaccttcagcgagctcccaaacaggcaatagaacacagtggaaattgcagctgccaggaaacaggaaacctctgcttctgcctgtcctcttcgcgatggaagaggctcagtgaattgaagctagttaccccaccttctggcttagaaagcggaacctgatttctggcgtacttctgggtaccttcttcctctttccaggaacccagaaagatgcgtggaaaagacatgaaaggccccattgctacttaaagaatggcctgcatgcatttagtaggttttacaaccatctttattaacagggatactagagaaagccatcctcctatttcaaacccaagctctcttcttttatttcccgcatagccactgctaccatgtgtgacttacctcaaccctaatggtgatggcttctcccccagccacactggcacccgttccttatgactctcttggccaaccagcccttgtgctcagctctaaacttccatgagatcagagttccagcttctatgccatgtatttttaaaatatcctgataatagcttatatggcacggagctttaagtaaacacgtaataagtggctgatgtatggattaattggtagagtgttagagctaaagaaaataaaacaacaaaaacaatagtaaaaaaattatggtgtgtgccaggcactgtctgaagtacccaaatgcttcatctcctttagttctcacaatgaacctgtgaggtatatgctgttattattctcttttttttttttttttttttttttttgagacagagtctcactctgtcacccaggctggagtgcagtggtgtgatctctgctcactgcaagctctgcctcctgggttcatgccattctcctgcctcagcctcctgagtagctgggactacaggcgcccaccaccatgcccagctaatttttatttttttatttttttatttttagtagagatggggtttcaccattttagccaggatggtctcgatctcctgacctcgtgatccacccgcctcggtctcccaaagtgctgggatttcaggcgtgagccactgcgcccggccttattattctcttattctaaagatggggaaacagacttagggaagctaggtaacttgccgtttctcaccagatagtaagtgacggagccaagactcaaaccaggtggttttgactccagaagtgggatccatatgctggcaagctccctatatgatacattctttgcatataatatgtccctgtatacaatatgctgccataatattggtgtggaacttcaggccaggaaagtgacttgctagggtcccccagttagtggcagagctgttggatctggactctggctcctggcccctttactacatcacactgcctcttgaggattcctgccagcctgtgtccacattccaggcttatctccaagagaagccgggttggtagctctgggtcagatggtggcctagggacttacagacttacagtccagttgcccaggtgtgagccacaaccaggcagccaaatttgttcctgccaggtcaggggactgagtggagtgaggctggcgtagcttatgcctgctgctcccaccccctatagcccagcaatggctccctcccaccagggcctctgtggagcccatggtcaaggcctgggccagcatcctcagaagtgtgtgtccaggtcccacctacatgcctgtgggccctattgatgtggtcagctcccattctctgctacaagtcccaggacagcagccctggtatacatcgagccagtcagctccacgccaatccagcagcacaaggcagtgggagcagcattagaaaaactatctggggctgggcatggtggctcatgcctgtaattccagaacttttgggaggccaaggcgggcagatcagtcgaggtcaggagtttgagaccagcctggccaacatggtgaaacctggtctctacttaaaatataaaaaattagccgggcgtggtggcgctcgcccgtagtcccagctcagtcccactcaggtggctgaggcaggagaatcacttgaacctgggaggtggagcttgcagcgagctgaaatcccaccactgcactccagcctgggcaatacagtgagaccctgtctcaaaaaaaaagaaaaaaaaaaggaggaaatactatatagcataagtggttgtttttttttcttttccaaagtgtagggaggaggcagaagtggcgggcggtgaggaaacaaagaagaccacaaaaccaagctctaagttgaactcaaaagaagccatgggcgaaggcagtgggcaggagggtgatggtggcagctataagaaggggcccctccaagctgtgccaggctggcctggcctgatggtgggagccaggagtgagcagtattccaaatcagctctgaacactctgcagggacacaggcagggggcaggtgctggctctgcttggagctctcaagagagaatgagagctgcatcggaaagcgacaagtcaggttgtcagaaaggtgacagttgtatgcagtcaatagagaagaaactccctgtgactgtccaagacgaggcactcagggttgctttgaggcacagccctggggggaacaccattcccaaggagttgtatagaatacttggactcagggttgctgaaaactagaacaggtcaaaaggaactgaaaggcttcttgtcccagtgaaatagatggggaagggagaagcagactcacattttatgctgcatttatttctccatccactagactgctgtattttctccctctgtcctgcagatatgatttggctatcaaagaccttaaagaagccttgattcagcttcgagggaaccagctgatagactataagatcctggggctccagttcaagctgtttgcctgtgaggtaaggagaacagggcctggcctgggcaggaggggatcatggctggatggatggctgacagttcagatgcacagtgatctgttgacacctccaggagcttggaaaagccattttgcctcctctgccttgagactcagattttccttgaagaaaagactgagatggattatttcaggctcatcaaggcattgtcatcagttacctgggggcatacattttattaatgtgaagcgcaaaggaccatgcaaaaatgagccccccgggctctctgaagggaggctggacacgagtgtgttggcttgtggaaatattcatgataatttgcatgttttgattggcacttcagattgacaagctatttgttcagcattttgctagcaaatccaaaatcatgagttcattgtccgtgcaggacctgccagaagcttgctcagttcccaagtttatagaccacactctttactatccatggttcttaccccatgtacttgattgatacctaaagagagactgaggataatttggcataaatctgtcccctcttgctcaaagaacagctcaaggcacatatttaggtaaaggtttctgcaaaacaacttcttttctctattatcaaaagggagagacatgactggctttgactttgcaggttcatttactttttccggttggcccttcccacccctcccacttccaaatatatactagcagttttgaaaaccaaaattcctgtaaatgtcaaagacctttctttagaaaaatcactgacaaaagtccccttgctttagtttctcaggcacaagaagtcaagtgttcccagggtcgctcagggctaataatagagtctgtagccgccctcggcccctggggacatatggccccatcccaaccctgcagcaggctagcaactaacttcacgtctcacagtctgagaagatggggctttgcagttggaattggctgccattcgaccaacttctcgagtaaggtttctcagctgtagctctgttaatatgttggaccagacaatcttgtattgtagcagaggcgagagaggggttgtggtgcgtcctgcgcatcgtgggaactttgacggcatctctagcttttagatgctactagcactgccaccaccactccccacccaatgtgacaacctaaaatccctccagacattgctaataagccaatgacagccacttatacagattagaaagttgggggacaagtggctctagaaaaaggattatgtcacagcagcatcaaagtacagttccatgggaggaatgtttcccctggagttggggttaaaatggccctgagaggacagaaaatactggctgagtggccctctctgcaagtaaagctgaacttttcagggtctaaggccctctttgtcacatgggaccttccagtcatttccctacttataatccttctcttcctgatgtggtatgaccctggcttctgagaatcacatcattatttttgaagagtgtcaaggtttttctcatcattagttcataaaaactgattgtagagaaatgtcttaagagaaggtggctgagaaccaaataggaaattttaaacgatctgagttctttctttctgcacacaaggtcaggagtgggctggagaagccaacgaattcagaaggcagtagctcattgaatctcagaaataggactgaaaggagtccagatttccacttccggggttgatcctggcccccaccattcagcaccagccactaatgccacagaaacatcaatccttccacctgtctgagtttggcaagttcacgtcattgttggcaggaggcctcagttcttcgctacatgaacttctctctagggctgcctaagtcttgtcatgacatggcagctggcgtctctgagagcaagtgacccaagagcaagacagtgtcaatgtcttttataatctagcctcaaatgtcacaccccctaatttccataatatcctatttaaaaaatttatttcagtcgggccattttttagatcttggtaatgcatccaaacgattatttgattctgtgtgtaaattgtgaagcacaatagtaaaatagacactcaagaaccacagcccaactcaagacctggaaaagtatgacactgttgcatttaccattccccccccacctgaggtgaaggtgcccctggcttctgtgctaacctctgtcttctgggttcaagcaattctcctgcttcagcctccaagtagctgagattacaggtgcctgccaccatgcccagctaatttttgtatttttagtagagacagggtttctccatgttggccaggctgatctcaaactcctgacctcaagtgattcacccgccttggcctcccaaagtgctgggattacaggcatgagccactgcgcctggcctgtgttgctacattagtcttgttactcacatggtctgggccaggttctgctggtgctggtacaggaggttgcatcttgatccatcttccggctctgtacctgtccagtgtttcagcctaggtacagtggcaggaggtggactggaagaccacacacctgtattttattcccaaccctgtgtctgcctctagaaggggccttgagcaagtcactcttttactaaagcaactcatactaaaacaacacaacaattcttcttcttttttttaacctggtttgaacacactgtatacaataattcttgtcccttcctgacctatttcgttgttggaagagtacaaatgatgttgcatttacgcattccatggtgttttcttaacaccatgtttgtgtttgacataactcaatagcaagactaattgcactatattttagatattcccaggagagctgagaaagggagaaaggctaccaggcaacattctcagagtatacgtgtgagcctttccctggcaccttgatttggagtagtctcaagttttatgttgcggtctgtacttttctaggtgttatataacattgctttcatgtatgccaagaaggaggaatggaaaaaagctgaagaacagttagcattggccacgagcatgaagtctgagcccagacattccaaaatcgacaaggcgatggagtgtgtctgggtaagcgtattggtgatgcaggtgttgagaggatgtcactggattctcatttgtctcagaggacatgccattgagaagccataaaagtggtgcttttactttctgtgagtctgggtaacactgatcttagggtatagttccacttaagatcttgaatctgtgctgagaagctgaggcctagagtatgggatggcagagccctggcatcacaccacccttggagtggggctccttggcaatgcaggagaacaggatattggatgctggagcagtgctgcacagactctaagcactgagagggcagagtccatgtctgcttgatcaccactgagtcctcacagcctggcacagtgctaggcacataacagctctcagcaaaaatgttttgttttgttttgagatggagtctcgctctgttgcccagcctggagtgcagtggtgtgatctcagctcactgcagcctctgcctcctgggttcaagcaattctgctgcctcagccgcccaagtagctgggattacaggtgcatgccaccatgcctggctaatttttgtatttttaatagagacggggttttgccatgttggccaggcaggtctcgaactgctgacctcaggtgatctgccctccttggcctcccaaagtgcagggattacaggcatgagccaccgcacctgcctaaaatatgttttgattttgtgaatgagtgataaaaactatttatcgttcaagcatatttgtgaataaggctagctttaaatctgatttttaaaacacagagaagaggactcaagccagtctttatatgtctatcctcatcagcaaacacccatccaagggagcactgtcatgagccttgcttgatcccgggccagccttgtcgtggtggtgccctctacaccatgagagaaccccacggacagcacacagagtgggagaggagcagttcctctgggaaaagagggtgctgaatagcaacaaatagcagcaatgtccatgtggcctcgcagcagaaggtggtattgaaaccaagggttcctaccttaacaccctagaggaatgacaacactcatttggaaaagggcttctatgtggttatctcaatgaattcttgcatctattcactgagggaggcaggacaagcatcgtcacccccattttcacataagggaatgctacgttttctgtgttacagaagcagaagctatatgagccagtggtgatccctgtgggcaagctgtttcgaccaaatgagagacaagtggctcagctggccaagaaggattacctaggcaaggcgacggtaggtgggattgctcagcttcccctgagtctcctgtggcccgggccatgtggagcaaggtgggagggactcttgagaagagggtagcctccttgtggctctgtccctgggatggcaatgagagacttgtttataggacagaggtttggctgaaagataggcaaccatgtctagtttattttctccaagctgctcccatttctcccttccagctcgaccctgggtgagagccacagggttactcacaggatgctgagtcttagggactgagccaatggagggaaaacacagccatgaggagctcactaaatgtgaagagagggccaggcagggtagctcatgcctgtaatcccagtgctttggaaggctgaagtgggaggatcacttgaggccaggagtttgagaccagcctagctagtggagaggctgaggtgagaggatcacttgagcccaggagttcaaggctacagtgagctatgattgcaccactgtactctagcttgggcaacagattgagactctgtttctaaaaaataaaaataaatatgaagagaacatgttagggaaagagatcagcatgggatcctcttggattaatgctccttgtagttcacgttttagtgggctgaggagtctttccccacttccacagccctatgtttagactatgtcttaaattggacttcttctaaatccaggtcttggctgtgcatggtgactcatgcctgtaatcccagcactttgggaggctgaggcaggtggatcacgaggtcaggagttcaagaccaggctggccaacatggtgaaaccccatctctactaaaaatacaaaattagctgggtgctgcggtgcatgcctgtaatcccagctacctgggaggctgaggcaggagaatcgcttgaatccgggtggtggaggttgcagtgagctgagatcatgccattgcactccagcctgggcaacaagaatgaaactccatctcaaaatagtaataataataataaatccaagtcttaaattctttcagacatggtctgaagtgagtcagcagtgcccttccaaaaccacatttgacttgacacattcatagggctaaagttgcccagtggtcgggtagctgggtctagcatagcagcagaggtcaagaaagcctgggtgagtggaagccctccaaatatctatcaactgatgaatgagtaatcaaaatgtgatatatccatgcaacagaatactacgtagccataaaaaggaatggagtatgattcatgatacaacatggatggaccttgaaaacattatgctatgtgaaggaagccagatacgaaaggccacatgttgtacaattccgtttataggaaatatctggtgcagcctctaagcactgagagagcagagaccatgtctgcttgatctccactgagtcctcacagcctggcacagtgctagacacataacagctctcagcaaaaatgttttgattatatgaatgaatgatgaaaattatctatagtttaagcatatttgtgaataaagctagctttacatctgatttttaaaactcagagaagagggctcaagtcagtcacagaaagcaaaccggttgttgccagtttaggggaaaggggagtgtggacacactgcttaatgggtacagcattttcttctgaggtgatgaaaatattttggaattagagagaggcagtagttgcacagcattgtgaatgtgataaatgccactgaatcattcactttaaaatgattaatttgggctgggcgtggtggctcatgcctataatcccagcactttgggaggctggatgggtagatcacctgaggtcagaagtttgagaccagcctggccaacatggtgaaaacctgtctctactgaaaatacaaaaattagccgggcacagtggcgggtgcctgtaatatcagctactcgggaggctgaggcaggagaatcacttgaacctggaaggcagaggttgcagtgagctgagatcacgccactgcactccagtctgggtaacagagcgtgactccgtctcaaaaaaaaaaaaaaaaaaaaagataatttgatgttatacaaattgcacctcaattaaaaacatttcttttttaagagagaagaaagcaagcctgtgttagcaggggtggggtgaatgctcgtttcttcagttgctgaaatcctaatccagaggctcaggaatctaatccttagttactgtccacgtctgaaaccaggctcacgtaagaacaggtctagggcatgagcaaagagggagacccagaagaatggaaacagtgctggcagagcctcacaccctcctgtccttgattttaggtcgtggcatctgtggtggatcaagacagtttctctgggtttgcccctctgcaaccacaggtaaggcagtcctgaccttctccatggacctaggtctcgagagctttctgtgaagcattcaattcgagagactatgtgtgctgagttgcctgattgtaagggctccttcaagtggccctcagtgcagctgagggatctgcctgccctctctcagtcctggtttccatggctggtgaggaaataaggcagtgtcaggcttcaccccaagtcctctgaagctaactctcctgcttccccacaaatgccggtcttcacatctctaaagagatctgctgatcctctctctgaagcctcaactattctctcaggaagctgaaacacaagctatggaaggcttattaacaaagcctcttcttgagtacaggggcaagtggggaaccctgtggggcctgggcctgaggtttgggctctcctggctctacccatctgctcatgtgcaggggtttccttcgggaacacaggcagcgcactgagagtgaaccctttttctgcccaagctgggcttggagaggtgagctcagatgaactggatgatagtggatctagaaatgcacacagagcttccttgtgaaggaaagaggggaaaacacattaaggaaaatacgaactctgtggcaatgaacctgtgatgggcaagagtgttggtcagcactagcagagggcggttttctgagcaggggcaggtatgttccagatctagattccttgatctctttcttcacaataaagctgatgaaagccttgctgaagtcccttgagcttcagttcagccagaggccatgaggggaatgcagcccaggtaactggattccatggtattcagtgtagaacaggggaggagattcttgcccagtcagtggatcctgtgtcaattttaaatactcagaagtggccaggcacagtggctcacgcctataatcccaccattttgggaggctgaggtgagcagatcacttgaggccaggagttccagaccagcctggccaacatggtgaaacccctgtccctactaaaaatacaaaaattagcagggtgtggtggcacatgcctgtaattctagcaacatgggaggctgaggcaggagaatcacctcaatgagggaggcagaggttgcagtgagccaagatcgcgccactgcactccagcctgggcgacagagtgaaactccatctcaaaaaaaattttttttaaattaatttaaaaatactcagaagtgtcatgtgacatagtagacattaattacagaacagagcttttggaaactgtcctgggaaaaggacagagctcaaggtcaaagcattcttgtgacaccatgttgctgtgtgactgctaacctccagaaactagctctggctcaaaatgaattgctgtgctagtgaaacctgtacctggggagctggtgggaggtgttatttcccagtgtttagtcagggtgactgtgccctcttcctagacagtgttctcatcagtcagaaatgcgttatttgattttctggtctggaagaatgctcaaattaccattagccgtttgttgtctctcccctgctttccctcattgccttttccgttttcacttctcctgaatgttcaataggcagctgagcctccacccagaccgaaaaccccagagatcttcaggtaagttagattcaaatccataaatagaatatccaagcgccaagcctgagctgatggcaagaaagggagggaagaagatgaaggtggggtcagggtctaaatcttgttgaattttctggaatgtcaggcttcttctagaatgtcaggctagaaaggaatgcctagaagaatgtcttctagaatgtcaggctagaaaggaatgatatgatggggatgggagtcttgactgtggtggggctggccatcagggcttggctgcagctacgtggtgtcccattggccctctgtccacgtgcacagccacccacatggcaaggggttgttgctgaggggcagtggtgttctgtggaacatagctaccctggggaccaggatgctgacctcaggttggagatcggtttcgcactggctgcagtcccctctgacgggggcaggccagagctctctggagtcaggaatctagaatgacgtcctttttcctgtgtggatgttttccactccctatcggcacatgctttctgaagaagtaaagaggaaggactgaagaaaaggaagtccttcttctgtaagatgaaaaacaaagggtgacataacctacagctttcttaagaattctctcaaagtgatgaagcaagcctggtcctcccacccaaaaaggaggttttaaaaagtgattggccaggtgtgtggctcatgcctgaaatcacagcactttgggagactgaggtgggcggatcacttgagatcaggagttcgagaccagccgggccaacgtggcaaaaccccatgtctactaaacatgaaaaaattagctgagtgtggtgactgacatgtgcctgtaataccagctacttgggaggctgaggcaggaggctcacttgcactcaggaggtggaggttgcagtgaaccaagatcatgtcactgcactccagcctgggcaacagaccaagattccgtctcaaaaaaaaaaaagtgacaaaagtaccaaagcaactacaaaaatgagggggctggatgagctcattcctaagctccctgtcagctggaagggcctgtattccctacaggagtaggcacgatgtctggaaacaaggatgggccgaggggaaagtaacagagtggggagtaaagggagggaagcctgaaacctgaacaccagcctctcagtcacacgttccaaagtgatgccaatcagagcctcaaagcctaaaagcatgaagtcagacttaagggaaccgacactgcaccacggcagctgggcagcctcagagccctctatgtgcatccctcacgctccctgtcacctaccctgctcacggtctctctatcctggcccaacactggttctaggtggtttctccttcctcctctcccaccaatctttctggcccagctggctctcacctgacttctgctttgtgctgttcccctgaccacagtcacctgatccaccccaccccagcccagccttgggtgctggccaagatgacacagccagggaccttcctcctcagagcagaagggagggcaaggattgtaagtcctcactatctagtgttgtggggtttttgctttattcttgcccctctgcatatatggttatgagcaggtgtacaccagtttcttgctgagacctcttgggagcccaggcaggctcagtgtcatctcggcagttgcagttagatgtggagttagagccaggctggagccaagtccctggctccaagttcagtgtatttgcgccatggcatcatgtgaggggatgggggctggatcttgtgtctatcctctgcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcaggtatgcagaggatcaggggctggtgcgatgggcatgggatcctggcagcaaatgcagtctctgtggagcagtatctgctgccttctttgcagaccagccaagttcttttgtctgttcgtcatcccttccccaggactctgggctgttctgtggtgtgggtactgatgagcacatctttattttttcctttctgattctgtggtgctgcactgcagaaggggcttgttccctgcaactaccttgaaccagttgagctgcggatccaccctcagcagcagccccaggtaatgtgatgccaaggcctgacccatttcctctcaccctttagggatctctccctggaggggagaaaagcagtgtaaaagaggtgttgtcaggacccctggagaaagattcactagtcttgagcccgccttgagatggcaccagctacccagagctgaacctgggaatgaggggaaaaaagcccagatgtgctaagttggaggcatctgtaggtcccattgggcccacccacctctgtgactcttcctggtcagaagtcacttgggaagcaaagcctacagtatatgagtgggttaggtcttcccaagtgtgtctgcttcacgtggaagagtagtcaatgtgttggctggtacaatgccattagaaagaaaatgaggccagctgcagttgctcatggctgtaatcctagcactttggaaggctgaggtgagaggatcacttgaactcaggagttcgagaccagcctgggcaaaatagagagatgccacctctatacaaataaaaataataaaatgagatctgccttagagctttgaatcagagtgggccttgccagccactgcttctaaactgctgctactccctccctcacacttcaaaagtctgtccttctgccaggcctagagagctgtctttgtcagatctgagcatccctgtaagtgactcaatggcagtggagactgtctgtctctagactgtgcaaccagttgtatatgagctcagccctccctggtcagtcaccatatccaaatgctttgaaaagcttcaaatgccttgcaaatgagaagtggaatttttcctttctcaatgccctctgcagtggagacaagagctcagtcctgccccacggccagtggatttccaatatggctgaaagagttgctaaagcggcaagggcgttttagcgggttaggattcttctttctactgtgattttcattttcatcaggccaactccacctcctcttttggccaacatttccttcgtcttccccaaatgtcactaccattccaacttttaggacgttatctgcatgtggctcctttacatggggtctctgtaggggtgtttccccacatccacccctgcctgggaactttgaatgaaggttctgaccgtcgctccctgttgccttcaggaggaaagctctccgcagtccgacatcccagctcctcctagttccaaagcccctggaagaccccagctgtcaccaggtgagtggtcctggagccacagcctaggtctgggtgcagcagcatgccaggctgcttcctgagttcctctccctgccttccaggaaattctggtttcttcttctcccaacatgtcactcagctaatgaccacgcagccccagaatccccctttcctgcaccacccaccccaaacatgaaatcagtgccctctctccctgccttctgcagaacactcacggggcttgggtgaatgcagctggttcctgagtgactcacgtagtcaccaaaccccttgatcattaggtagggaaacgatgtctcaggaagaaaagttgaagtaactatacctgcttatctctgaggggcatggagtggctgttttcaaatgtctgaggcactgtatctggaaaagaaattgctctgtggagccctgaggatgaacaaagaaccaatgggcagatgtgaaatggaaatgttctctctgaaaggctgtttcctagtgtggagagggctgtcttgggaagtgcacttgaagcagattctggataagcgcttggtagagacgcagagtgagtggttggccagattctagatcaatgattgccacacgcgcctgatcatcagaatcactcgggatgtcccttcccccatttttattttgaaaaatgtccaacctacagaaaagctgacagtagaatacaataaacatcagaatatctttcacttaaactcaccaattgttaacattttgcaccatgaactcgccctgctccattctatttttctcccccgagccagttgaaaagttacagactcgtgacacttcaccctacacagctgcaaaaacgcagtctcctgcataatcacaatagaatcatggtatctaggacactaaacattcatatgatagtattatataatgtatattccatattcaaatttctcccgttgctcctgctcaatgtccttgacaggttttttgttgttatcttttgtctagaggctcatcaaggatcacatataaacctaggatgattttgtgaatacagagtcctaggctactggctctgatattttaggactggaatggggctcgggaatttgtattttagaaaaaaacttcccatgtgattctaatgatcagctaggtttgagatcagtggccttctctgatcatgtaccccctatagtaaatatctttatgcatgctactcttacataaattagattaatattagattgcttgattaatagattagattaaattaataaactttaggaaacatacacaaaaataaagaataaggtgaggatcagtggttctaatacttcttcctgtggcctctggctcaccttgcactccgattttcattgctttggatcccgtgggcttaattgacctttgggatccctgctaaccttgtgggttggtgaggatatgctggtcctttggtaattacctataggctccctagaagcagagactgagtttgttcatgtgttcatgaccttcatgcttccccagggcgagattttccccacagtttactaaggttaataattgccccacaaattaaagggtaagaggttgggggccctatttgaagaggtttcatctgtgtgtggcaggggctggccaaggatgttcattcaccatcttcttttgttttactccctactttttccattcaggccagaaacaaaaagaagagcctaaggtaacatttttccctcatactgtttcaagtggtagaagatgggatagcttgggctatcaaccacagacatgtctgtctggattataggaagagccccaaagggagggtcgaaccagttgctaccttacagagtccatgagctagggaccttcttaatagcctcctccactatcatgcacacacttcctactacccaagctagtgggccagatcttactcagtaggaattcctgtccaagcaagggttgggctaaaggacctctgaaggccttttaggctactgtgaaaccagttacttactggcctctcccctgctgtattgggtaccccctgtgccaaatcacgaaactgcggtgatccaggatgttgagagaaagcctcagacactcaggagttccctttgtttcctccccactcaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgaggtgagctccatgcaggcagctgtgaggggtacagtgggaaccttgtgctggcctggaggagggaagaggaggatggtttttgtgatgatgttctttgactggattcttactcattatccccacccagctatcggcctcgggacagcaatgagctggtgcccctttcagaagacagcatgaaggatgcctggggccaggtgaaaaactactgcctgactctgtggtgtgagaacacagtggtgagtgcaatgaggggcatctaaagttacatttccactgagccacttcctcaacaatttgaaatttatcaagcaccttctgtgtactaggcactatatgtggtgttggggatatggtgtgtaataagtcacagctctgcctcccttttacctgcatcctcaccccatttgcagcagggagagagtttcccacaagagaacagcaggcccagcagggcaggagctcacagaaagcctcctgcccctccatcagctccctgcctgactgtgtcaaacatcccatccattactgtcaagcaaggttggaatgaagtcatatcatagcttaaggctcagctcatagccattcttcaccttttttttttttttttgagatggagtctcactctgtcgcccaagctgggtgtgatcttggctcactgaaacctctgccgcccaggttcaagaaattctcctgcctcagcctcctgagtagctgggattacaggcacctgccactgcacccagctaatttttgtatttttagtagagacggggtttcaccatcttggccaggctggttttgaactcctgaccttgtgatccacctgcctcggcctcccaaagtgctgggattacagacatgagctgggagaagaagagtgaaagagaatgagcctagaaaagggcagtgtataaagctgtttaaggtatcttccccgttcagaaaattgccttcaggaaatacagccactggggatgagactccctggtgtctctggctgagacaaaaggccccaggatcctgggggtaagagtgagtgtgagtgtaaggggtctcttggaagtctgaaaagtcactctaggttttccagctgtctgtctttggactaaccccttcagcatcttttttaaaagattcttcctagaaggagttctgctctaaatgtgaactacttcacttaaacttttttttaattaaaattttttcctttgacagcagcttcaatctatttggtggctgcacatagccaaccctcttacaactccccacaatcttttgcaatttaatccaggctcaggagtcactgttgaatgttctttatcactatccattacttttggaggcaacaaagcaggctttcacttactaggagaaagaaaaccaggcgcagtggctcatgcctgtaattccaacactttgggaggctgaggcaacatggtgaaaccccatctctactgaaaatacaaaaattagctgggtgtggtggtgtgcacctgtagtcccagctacttgggaggctgaggcagaattgcttgaacccaggaggcggaggttacagtgagctgatatcataccactgcactccagtctgggtgacagagagattctgcctcaaaaaaaaaaaaaaaaaaaaaaaaaaaaaaaaaaaaaagaggcctggtatggtttatgcctgaaatcctagcactttgggaggccgagatgggccagatcacctgaggtcaggagtttaagaccagcctggccaacatggtgaaaccccatctgtactaaaaatacaaaaaaaaaagaaaagaaaagaaagaaaaataaaatgaactaacatttattaagcatctactctatgcaggaacacttaccattaaccaagtctaaatatttatacatatttagaagagtactgccacagagtaagtgttcaataaatgtcaactactattattgtatgtcatctcattgaattcttctagcctcaatttcaggtgaggtaactgaggttctgagaagttacactgcttgcttagggacacagagctggtaagcagtggaggtgggatacaaacctttctctgtggactctctagggccatttccacctcattgtattgcctctcaataaaaatataccaacgttcaacaaacaacattaagaagctagaacttataatgctcggtacatacaagcctagcagcatttctaatgttgatttgttaaattctatgattcacatctgtagaaaccgcatccttctccttcatttgtgaagcaaaagtgacaataatgtggaagaagtctaagatcataagtctaagatgtataagaaatgttgttacagataaaacaagtatggcattgtgcagtggtttttgaactttagcaagtatcagaattccctagaggacttaaaatacagattgcaggattcaccttcagggagtttctgatttagtagttttgggatggagttgaaagtctgcatttctaacaaggtccctagtgttgctgttagagttgatgctaagaaagccagttttgacttagggctctgtccccatctgtaaagaaataataatgcccattctacctgtctcaagattattgtaaggtttcagtaagatattttaagactgtatatgattttgcagaccttttggtttcatttatcccaggggtccccaacctccaggccacgggccagcacagggctgcacagcaggtgagctgcaggtatactggcctgagctctgcctcctgtcagatcagcagcagcattagattctcataggagtgtgaaccctattgtgaactgtgcatgcaagggatctaggtcgcatgctctttatgagaatctaatgcctgacgatctgaggtggaacaattttatcctgaaaccaccccccaacccaccacccaccaccattcatctaaaaactgtcttccatgaaactggtccctcgtgccaaaaaggttggggactgatttacccaaccatccagtattcataaagagcatataagctctacacaaggcactgatcacaaactttatgagtttatatcccaggttctactttgacatttcgctgtttcctttagtgatgttcagtgttcacttggcaggaaattgggaaaattaacaggccctttattatttcagggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaagggtaagtgctactccaagactatagaaacaaatttacatgttagcagaaacaaggtcaagggcagagagaagaaaatatcaataatctacaaacaaaactttagccagtgttttcaacccccttcctagcatctagctggagggagcaaagttgagcactcagactttccctgtctattgctctagtagccaggaaagcaacaagaagctgagttgttttgtttttgtttttgtttttgagacagagtccccctctgttgcccaggctggagtgcagtggcacaatctcggctcactgcaacctccccctcctgggttcaagcaattctcctgcctcagcctcctgagtagctaggattacaggcgcccaccaccatgcctagctaatttttgtgtatttagtagagatggggttttgccatgttgaccaggctggtctcaaactcctggcctcaagtgatccaactgcctcggcctcctaaagtactgagattacaggcatgagccaccgcacctggccggcgataaacatcttgattattaaagaggagtatgctttggaaaccatggattctcattcccagaggtaacaaattgggctggaatcactttgcctttgcatcaagctgtatgaccttctgcaaaccatagttctttgaattaatgtacttttcaaagagaaaagtaggtaaattttgccttaaaaaccagctattcagaactatcctgtgtctctggtgactttcttgattctgtttgtaatgaacagactaaaaattgaaacagcatgcctgtaatcctagccactagggaggctgaggtaggaggatcacttgaggccaggagttcaaggctgttgcctgggcaacacagcaagacccacctcttaaaagtggagagttctaagaatccctggaagagtttgttaaatcaattcctgggcccaccctccagagattctgattcaggtctggggtggggcccaccaacttgcatttctaccaagtttccaggtgatgctggtctactgcctacactcttaagaagcaccattccaactcgtggtttgccagcctaattctctacctcgacacaaaaaagtcccatcataaaagccctgctcatacgctgagtctgtgcactaccaatgcaaagcagtgaaaaactaccatcaattataacagaaaatccaacagacaaagagagggggaaattttaaagttaatgagggtaggctgggcctggtggctcacacctgtaatcccagcactttgggaggctgaggtggtggatcacttgaggccaggagttgaagaccaacctggccaacatggtgaaaccccatctctactaaaaatgtaaaaattagctgggcgtggtgatgcacatctgtagtcccagctgctagggaggctgaggcaagagaatcgcttgaacccgggagtggaggttgcagtgagccgagattgcaccactgccctccagcctgggtgacagagcgagactctgtcttaaaaaaaataaaaataggccgggtgcagtggattatgcctgtaatcccagcaccttgggaggtcaatgtgggctgactgcttgaggtcaggagttcaagaccagcctggccaacatggtgaaactctgtctctgctacaaatacaaaaattagccgggtatagtggtaggtgcttgtaatcccagctattcaggaggctgaggcaggacaatctcttgaacccaggaggaggaggttgcagtgagctgagattgtgccactgcactccagcctgggttacagagtgagactcagtctcaaaaaaaaaacaaaaacaaaaacaaaaaaattaaaattaaaaaaaaagttaatgggggtagagagagtatacaacaagtgtgtagcaattaattaaaaatatgagtagtataggctgggcgtggtggctcatgctggtaaccccagcactttgggaggccaaggtgagtggatcacttggggtcaggatttgagaccagcctggccaacatggtgaaaccccatctctactaaaaataaaaaaattagccaggcgtggtggcgtgcacttgtagttccagctccttgggaggctgaggcaggagaatcacttgaactagggacatggagcttgcagtgagtcaagattgcacctttgcaccccagtctgggcaacagagtgagattctgtctcaaaaaaaaaaatatgagtagtagtaatatagaagcagagtgttccaacaagagagaatggtaactcagtgggaagaactgggttgaacacctccaagtgccactttaaaggtgcctaaatcaaccaaccagctcaattgtctggagtttgggagagggagcaggaatacaatgaaagaacacactaaaacaaccttttgggtagatatggagagaagccagtatgcgtcttactatgacctatctgtacaagtctaagttgaggaaatacccatattgtagcacttcaacagaaaacagaatttagcggtcagggtaggacagaggggagttcaattgcattcaagttatgagatggtctcatctacaaagtgtttctcaaactttaatgtgcatgtgaatcacctgcgaatcttcctaaatggattctgactctggtttggatctgggatttttcatttctaatatgcttccagtccacgacctaccctgtaagaagaatcaagacagtgatttgcagttagaattacctaagggaacttttgaaaaaactgctgcccagtcacaccacacattaaagcaaaatttctgggggcaggatccaggcaccagtgccttaatgtctgatctagatgtacaaagacaaacttctgaactggctgtgtggtcaggtaggtgggctttggagatcatacctaagttgtctgatttttactggcagaatggctctgaacaaactattcatctctctgggtctccttttccttagtaaaatatggatacctacaagttattatgaagtctgaatatattttttaagtacaatgcctgcactctattaaaggctctgagtaggagctattaaaatatttatatttaacaaacatgtactaacccatcactagctccagctcacctgtttaatggagttcagtgaaaagaagaaagtttactaaagaactttcatttttaatatatttaaccaatggcatgtcccttttctgtagtcaaaacaaagattcccaacaaagcgcaggtaaaattctctcctctcttaaaaaattgggccaggcacggtggctcacccctatcaccacagcactttgggaggctgagttgggtggatcacttgagcccaggagtttgagaccagcctgagcaacatggcgagatcctgtctctaataaatacaaaaattaaccaagcgtggtggcacagcctgtagttgcagttacttgggagtctgaggtgggaggattacttgagcccaggaggcagaggttgcagtaagcccagattgtgccactgcactccagcctgggtgacagtgagaccctgtcaaggttgggggtggggaaaggacagaaattctatttaaggattcgttgttcaatttctttgacccttcttctctatctggtaactttttgaaaaacataatttatccttcttcattttgctcattatcatgtttaagacagatcaataagatggttaaaccctgtgttcactctcaaaccactttgcaatactgtcttttccctgttgatcacaattaggggtggggaagggtgacagataacaaattctgtgtggaatagccagacagggtaatcttcctacagtggttttagaaatccatgtgtacttttccttttatcagtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 14 - DNA, 438 bp, Homo sapiens
atgaagtttaatccctttgtgacttccgaccgaagcaagaatcgcaaaaggcatttcaatgcaccttcccacattcgaaggaagactatgtcttcccctctttccaaagagctgagacagaagtacaacgtgtgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagactgtgaaaagatccttgaacggaaagccaaatcttgccaagtaggaaaggaaaagggcaaatacaaggaagaaacaattgagaagatgcaggaataa

SEQ ID NO: 15 - DNA, 295 bp, Homo sapiens
agatgcccaagaggaaggggagctcaactgaagggatggtgaaggaagagcccaagaggagattggtgcagttgtcaactaaacctgctcctgaaaaagtggaaacaaggccaaaaaggcagcaggaaagaataaaccttcggacaaaaaaaagtgcaaacaaaagggaaaaggggagcaaagggaaaacgggctaatctaaaaaccaaagaccatttacctgcagaaaatggagaaactaaaccaaggagagtccagcctctgatgaagcggtagagaaagaagcccggtctga

SEQ ID NO: 16 - DNA, 1327 bp, Homo sapiens
aggtgggtcaaagtcagggtgatggtcatggtcctagacgtggcaagaaggatgaaaaggacaagaaaaataagtactaacctcttgtaccaactagagtggcggaaaaagaagaaaaaacaaagggacaagatgttgccagtaaactgccactggtgacacttcacactcagtgtcggttaaaattactgaagttagagagaattaaagactaccttctcatggtggaagaattcattagaaatcaggaacaaataaaactattagaagaaaagcaagaggagggaagatcaaaagtggatgatctgagggggaccccaatgtcagtaggaaacttggaagagatcatcgatgacaatcatgccattgtgtctacatctgtgggctcagaacactatgacagcattatttcatttgtagagaaggatctgctggaacctggctgctcgattctgctcagacacaaggtacatgcggtgataggggtgctgatggatgatacgggtcccctggtcacaatgatgaaggtggagaaggccccccaggagacctatgtcaatactggggggttggacaaccaaattcaggaaattaaggaatctatggagcttcctctcccccatcctgaatattatgaagagatgggtacaaagcctcctaaaggggtcattctctgtggtccacctggcacaggtaaaaaccttgttagccaaagcagtagcaaaccaaacctcagccactttcttgagagtggttggctctgaacttattcagaagtacctaggtgatgggcccaaactcgtacggcaagtatttcaagttgctgaagaacatgcaccatccatcatgtttactgatgaaattgaagccattgggacaaaaagatatgactccaattctggtggtgagagagaaattcagcaaacaatgttggaattggaactgttgaaccaattgggtggatttgattctagggaagatgtgaaagttatcatggccacaaaacaagtagaaactttggatccagtacttatcagaccaggccgcattgacaagaagatcgagttccacctgcctgatgaaaagactaagaagcacatctttcagattcacacaagcaggatgacactggccaatgatgtaaccctggacgacttgatcatggctaaagatgacttctctggtgctgacatcaaggcaatctgtacagaagctggtctgatggccttaagagaacatagaatgaaagcaacaaatgaagacttcaaaaaatctatagaaagtgttctttataagaaacacgaaggcatccctgaggggctttatc

SEQ ID NO: 17 - DNA, 439 bp, Homo sapiens
aatgaagtttaatccctttgtgacttccgaccgaagcaagaatcgcaaaaggcatttcaatgcaccttcccacattcgaaggaagactatgtcttcccctctttccaaagagctgagacagaagtacaacgtgtgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagactgtgaaaagatccttgaacggaaagccaaatcttgccaagtaggaaaggaaaagggcaaatacaaggaagaaacaattgagaagatgcaggaataa

SEQ ID NO: 18 - DNA, 1340 bp, Homo sapiens
agctcagggccctccgaacaaagcagcgctcggtgccggacctgcagctctccccacccggcagcagcgccctcagcacgcccgggaacccccgacccctctgagcccggggtactgcgcccgggtctccacgcccagagatgctccccggtctccaccgtcgggcaagccccaagcgcagcagcgcagagtcctggggtcaccagagctcgtactaggacatcgtctccccatttaacaccgcctccggtcccatctgagttgcaagtggtggggatgtggggctccggatcaaagtccccgaaaccgagcacttcccgaagcctccttggcctcgaaacaaaacaataacgcccaagtaagtcactggagagcctcttacctgttttccacttttgtgtttgcgtctctttctcctaccccttgacaagccttccggagaaggggagaaaacagaaccggggaaaaaacaaggagcaaagcgccctgagaaccggctctgttggtgcgcggagctccccgccctgccctgccgcagcccgggagagaagggtcggctcggctctgcgggtcccggccccactcactctcgctcgcaattacggggtttttgccgggactagttccttttatagattcggctgcaccgagcgcagaggttactatcggtcaaagcctgtgctctccctcctccccgccccgttcccggcctctgtttatgtagttcagtcactcagcagaaagcacgtggagccggggcccgccccttaaacgggcgacgttcagccgcccacgacacatctagggagttggggggaggtgggtggggtgggggtggagggtacagcaggtgtcttagggtccgcggtctgcgtccccttcccccgcccgggcccgccggcctaagacgcgcgggaagcgctgggctcggggctgcgccgcagactctctagtccacgttcccggcagccaagggcaccagtggaatttgcttcctctaaatcctgctttccgcaatttttttttcctttgttagtttcctcagccggagggagggattgggggagagagagctctaggctgaatctccctcaggacgccaatcattttgtcttgtcttttgtttcctttcaaaggcctaggctggggtgaggggaaggcggacagtcctctgggtaatgggctgcttttgttttccccccacaaacctggactttgatttttgataggcgacctactgccttggagattcccagcctgagctccccaggtccctcagaggacccgagaggaacatcttactgcttctcttcataaattgagaggaaggaggccacaaa

SEQ ID NO: 19 - DNA, 1401 bp, Homo sapiens
caggagctggagagtacttaccataaaagagagggcaagcgcctgttcgggaagaatccccagcgctggcaggtcctggactccctggagaggggtctgctgccgccgccgcccactcaggggcgcccgagtgacccgcaaatgccggctctctccgcacggccaggggcgcgtcctcacggctgatgcccggcagcagcgccccctctgcgctgcaggatggcctggagttaggagcgttcttggcgaagttggcgctcaggcgccgggggtcgggcctggagtggggaagcgccttactgaagcgatcctgggggcgctccaaggcccgcgctctagccgcttggaagcttggcgcctgacccggagggcgacgagtcccgcgctcagggcgcacgggccgcgcctcggccgctggcccccggcgcgccgggcgtcttccccagcgccctgagcgcacgcagcggtagcagcagctggggcccgggcccgggatgtggtgtgttcatcgccctcccctggggctgggtgcttttgtgcgcggggcgcgccggccgccacggccagctctggatgctgcagccgccgccgcctccccctcctccgccgccgccgcccgctccccgccttcccggccggcccggaggctgcagctgaaagccgatctggctgagctcatccctgaaggccactaatccaatagccgcggaaggcgcggtcgccgggaacgccccttcccccaccatcccgcgccccggccgtcccagctcgggccgctgccggcgccgccaccttctcgaggccaccagctggcgggagagggaagtggagcccgcgcccgcgcccctgtgccaaggcggcggcgcggtcgccattcactcacccgcccactcgcccgctcactccctagctctcgcattcattcctgcgcgcgggtcctcccggattcattcaagcgctcctggagcgccagggtgggtgcccctgacggggaggagacacccagtcactaggcagctttggtgcctttactcaacgcacgtgggaaatagcagccaggaggaaaaaagggtggtttattatcccccttcctcagacacacacgtccacactttatttttgagatcaggctccaactcatctcttaaagtccaatttcataccgcacctgctcaaggagcgttccccgcccacccgaggcgcaggaagtcggtctctttgctctaccagcgctgatggtgggccgcctcattgggagcctgaactgagcgatggggtaaagggcgtggccaaaacagaagcctcgagggtgcttctggtatctgcgcttccttggggaaattgaaagttcttggtttggtggccctcgtctgtgctcccagaattgactttaggtccatt

SEQ ID NO: 20 - DNA, 9059 bp, Homo sapiens
gttctgggtcaatgagaatgagaaacccagtgttcgggagagaggaggcagctgaaatgagcctgcatctctacaaaggaaaatgcagcccaggtcctctgatgcaggtaatgaataaaaagtagctctttcatattgccctgagtccactgaagaagcctggcaaggtcctgcaggcagacagaattagtaacacacagcaccagttccttggtctggtagaggatactcctaactcagcttaaaattgtcccagaaagtctgactgtgtttaacttggaacctgccccagggagctgcacaatggttggacatgctggccttggatgggacagcccttgtcacatggggagagtgtcaggtgggggtgcctctgggttggcatgcaccctgctccacggatcttcccaacctctgcagtgttccctgtcactgcagcactggaacaacccagctgcccctatgggtactgaaagaaacacatccaatatcagagaccaggcaggggaagcagaagggtgcttgcagagacagttggtgctaatttcatccagggcagggtgaagtcctcaggaatgggtccccaattccccgtggcatctccttctaaaaaggaatgaggaatttggggacagcaggacttgtctaccagatatcaggttacttaacactgtagcaatgacattgagtggtactggcataggagtaagtaatttaggaagttgcagaacaactaaaatgaaacaaggcattattgaggcacacatctgtgtacaaaaaatctataaggaaaagagcaaaggaataataagcacaaaattctgagagtggttgcctttcagcaagggtgcagattggcggagacaacacaaggggcacagaggtgcttgattatcaatgttctaggcactgggtagggtggtagattcatgggtatgcattaaattataaaggggtaaatacataaataaggaaattagaattaaagagggctatgcatgggaccaaagatgacagtgtattacaactaaggattatgtttaatccaattctgtatatcagaagttcagttaaaaacaaaaagagagagaggatttaggtctggcttccaagatggccaaataggaacagctctggtctgcagctcccagcaagactgatgcagaagatgggtgatttctgcatttccaactgaggtacctggttcatctcatttggactggttggacagtgcgtgcagcccatggagggcaagcggaagcaggacggggcgtcgcctcaccagagaagcacaagggttggaggatttcccttttctagccaagggaagctgtgacagtctatacctggaggaacggtacactcctgcccaaatactgcgcttttcccacagtctttgcaacaggcagaccaggaaattccctcccgtgcctggcttggcgggtcccacgcccacggagccttgctcactgctaccgtagcagtctgagattgacctgcgatgctgcagcatggcaaggggagggttgtccgccattgctgaagcttgagtaggcggttttatgctcacagtgtaaacaaagaggctgggaagctcaaataggacagagcccaccacagctcagcaaggcctgctgccttgctgtagattccacctctgtgggcagggcatatcagaacaaaaggcagcagacagcttcagcagacctaaacgtccctgtctgacagctctgaagagagcagtggttctcccagcatggtgtttgagctctgagaatgaacagactgcctcctcaagtgggtccctgacccctgtgtagcctgactgggagctacctcccagtaagggctgacagacacctcatacaggcaggtacccctctgggacgaagctcccagagaaagaatcaggcagcaatatttgctgttctgcagcctctgctggtgatacccaggcaaacagggtctggagtagacctccagcaaattccaaaagacctgcatctgagaggcccaactgttagaaggaaaactaacaaaccgaaaggaatagcatcaatatcaacaaaaagcacatccacaccaaaaccccatctgtaggtcaccaacatcaaaaaccaaacgtagataaaaccacaaagagggggagaaaccagagcagaaaagctgaaaattccaaaaaccagagcgtctcttctcctctaaaggattgcagatcctcgccagcaaaggaacaaaactagacggagaatgagtttgacaagttgacagaagtaggcttcagaaggtcggtaataacaaacttctccgagctaaaggagcgtgttctaaccaattgcaaggaagctaaaaaccttgaagaaaggttagacaaatggctaactagaataaacagtgtagagatgaccttaaatgacctgatggagctgaaaaccacagcacaagaactttgtgacacatgcacaagcttcaataaccgattcaatcaagtggaagaaaggacatcagtgattgaagatcaaatgaatgaaataaagcgagaagacaagattagagcaaaaagagtgaaaagaaatgaacaaagcctccaagaaatgtggaactatgtgaaaagaccacatctatgtttgattggtattcctgaaagtgatggggagaatggatccaagttagaaaacactcttcagggtattatccaggagaacttccccaacctagcaaggcaggccaacattcaaattcaggaaatacagagaataccacaaagatactccttgagaagagcaaccccaagacacataactgtcagattcaccaaggttgaaatgaaggaaaaaatgttaagggcagccagagagaaaggtcagggtactcacaaagggaagcccatcagactaacagcgaatctcttggccaaaaacctacaagccagaggagactgaggggcaatattcaacattcttaaagaaaagaattttcaacccagaatttcatatccagccaaactaagcttcataagtgaaggagaaataaaatacttcacagacaagcaaatgctgagagattttgttaccaccaggcctgccctaaaagagctcctgaaggaagcactaaacatggaagggaacaacttgtaccagccactgcaaaaacatgccaagttgtaaagagcatcgaagctaggaagaaaatgcatcaactaacgagcaaaatagccagctaacatcataatgacaggatcacattcacacataacaatactaaccttaaatgtaaatgggctaaatgctccaattaaaaggcacagactggcaaattggataaagagtcaagacccatcagtgtgctgtgttcaggaaacccatctcacgtgcagagacacacataggctcaaaataaagggatggaggaagatctaccaagcaaatggaaaacaaaaaaaggcaggggtcgcaatcctagtctctgataaaacagactttaaaccaacaaagatcaaaagagacaaagaaggccattacataatggtaaagggatcgattcaacaagaagaactaactatcctaaatataaatgcacccaatacaggagcacacagattcataaaggaagtccttagagatctacaaagagacttagactcccacacaataataatgggagactttaacaccccactgtcaatattagacagatcagcaagacagaaggttaacaaggatatccaggacttgaactctggaccaagtggacctaatagacatctatagaactcttcaccccaaatcaacagaataaacattcttctcagcaccacatcacacttattctaaaattgaccacatacttggaagtaaaacactcctcagcaaatgcaaaagaacagaaatcacaacaaactgtctctcagaccacagtgcaatcaaatttgaactcaggattaagaaactcactcaaaaccccaaaactacatggaaactgaacaacctgctcctgaatgactaataggtaaataaatgaaatgaaggcagaaataaataagttctttgaaaccaatgagaacaaagacagaatgtaccagaatctctgggacacatttaaagcagtgtgtagaggaaaatttatagcactaaatgcccacaagaggaagcaggaaagacctaaaatcgacaccctaacatcacaatgaaaagaactagagaggcaagagcaaccaaattcaaaagctagcagaaggcaagaaataactaagatcagagcagaactgaaggagatagagacacaaaaaaacacttcaaaaaaaatcaatgaatccaggagctggttttttgaaaaaatcaacaaaatacatagactgctagcaaaactaataaagaagaaatgagagaagaatcaaatagatgcaataaaaaatgataaaggggatatcaccactgatcccacagaaatacaataatacatcagagaatactataaacacctctacacaaataaactagaaaatctagaagaaatggataaattcctggataaataataagagctatttatgacaaacccacagctaatatcatactgaatgggcaaaaactggaagcattccctttgaaaaccggcacaagacagggatgccctctctcatcactcctattcaacatattgttggaagttctggccagggcaatcaggcaagagaaagaaataaagggtattcaattaggaaaagaggaaatcaaattgtctgtgtttgcagaagacatgattgtacatgtggaaaaccccattgtttcagcccaaaatctccttaagctgataagaaacttcagcaaagtctcaggatacaaaatcaatgtgcaaaaatcagaagcattcccatacaccaacaacagacaaacagagagccaaatcatgagtgaactcccattcacaattactacaaagagaataaaatacctaggaatccaacttacaagggatgtgaaggacctcttcaaggagaactacaaaccactgctcaatgaaataaaagaggacacaaacaaatggaagaacattccatactcatggataggaagagtcaatattgtgaaaacagtcatactgcccaaggtaatttatagattcaatgccatccccatcaagctgccaatgactttcttcacataattggaaaaagctactttaaagttcatatggaaccaaaaaagagcccatatagccaagacaatcctaagcaaaaagaacaaagctgaaggcatcaagctacctgacttcaaactatactacaaggctacataaccaaaacagcatggtactggtaccaaaacagatatatagatcaatggaacagaacagaggactcagaaataacactacacatctacaaccatctgatctttgacaaacctgacaaaaacaagcaatgaggaaaggattccctatataataagtagtgctggaaaaactggctagccatatgtagaaagctgaaactggatcccttccttacactttatacaaaaattaactcaagatggattaaagacctaaatgtaagaactaaaaccataaaaaccctagaagaaaacctaggcaataccattcaggacataggcatgagcaaagacttcatgactaaaacaccaaaagcaatggcaacaaaagccaaaatagacaaatggcgtctaattaaactaaagagcttctgcacagcaaaagaacctatcatcagagtgaacaggcaacctacagaatgggagaaaatgtttgcaatctactcatctaacaaagggctaatatccagaatctacaaagaacttaaacaaatttacatgaaaaaaacaaccccatcaaaaattaggcaaaggctataaagagacacttctccaaagaagacatttatgcagccaacagacatatgaaaaaatgctcatcatcactggtgatcagagaaatgcaaatcaaaaccacaatgagataccatctcatgccagttagaatggcaatcattaaaaagacaggtgctggagaggatgtggagaaataggaatgcttttgtaccattggtgggagtgtaaattagttcaaccattgtggaaggcagtgtggcgattcctcaaggatctagaaccagaaataccatttgacccagcaatcccattactgggtatatacccaaagggttataaatcatgctacaataaagacacatgcacacgtatgtttattgcagcactatccacaatagcaaagacttggaaccaatccaaatgttcaacaatgatagactggattaagaacatatggcacatatacaccatggaatactatgcagccataaaaaaggatgagttaatgtcctttgcagggacatggatgaagtgggaaactatcattctcagcaaactatcacaaggacagaaaaccaaacactgtatgttctcactcataagtgggagttgaacaatgagaacacatggacacagggcagggaacatcacacaccagggcctgttgggcgggggatgggggctataggagggatagcattaggagaaatacctaatgtagatgatgagttgatgggtgcagcaaaccaacatggcacatatatacctatgtaacaaacctgcacattgtacacatgtgccctagaacttaaaaataaaaataaaaacagagaaagagaacaaaattgaatgagaaagttactaggtggccccaaccaaactcaaagagcttggccagaagatgaattataaattctagctaaggagtaataatggagtcactcttgcctgcttggaacttagcgtggttgggcaaaggcagagctggaaggaaacagcagcccaggcctggacttagaagacctagagtcaggttctggctttacagggcaggctgcttcctctgtaaaatgggaacatcacctgcctcgtggggagtgctgggaggattagaaaagggacagagtccaggtacccagcataggccctgtcctttgtgggcaatcaatcaatgacagctattattaatatttcagagaagttagtgttcttcgggacaaggtgaaaaataggcggctggtgtagggagctgaggactggacatccaggtaggatgcttctacatcaataaccacagataattccacacagagtcctgctcaggacacagcatctaatgcatctgtgagctggggctcagatctggggctcagagccagctctgtgtgacctgtggcttctgccacacccatcagcctgctccactcttcaggatcctctttccaatcttctcatcagaagcagaggccttgggaactcatgagtgttgacatattttcaaagcccatctgagtgctcttactggactcttcaactgatttttttggcaataataatagtaacattatagttgtagtaagttgtagcttacatagtacttcctatgtcatgagacattctaagcactttctttgtcttactgtatttaatcctcataacaacccaatgaggtagttactattatgaatggccagctacagactggaggaaatggaggcagttgagaggataggcacttgctcaaggtcacagttaagtggtgagtatgggattggaactggggcaacatggtctgggatgcactctctgctgccaactcccatgaagaagtgggatgatggtcactgcaaaggaaacctcttcaccaaccctatcagttctgttcctgagtcccaagggccccatggccctgaccctcagccctgctccatgtggtggtgccagctggttttccaagctcagccagagtgagggaccctgcctagtggggggcagcaactaacgggttcaatccacctaattccaactgggatttggcctgaagaatttggaaagggaaagggagctgacatggactccacaagggggtcttctcccctccagacccagccaccagaacgaccaccatcaagcccccttcctgaagcagcctggggctgtgctcctcacaaccactgagactaactggcacagttgactcctgttttctagcaaacagctatgcttgagcaaacttcctctacttgggaaacgtcatctcttagcctcttgctaaatagtataaaccccaggggcttaatatgaaggccttctaatggatttattgtgtttatttgacctttccaagtgtgagctcagaaacaggcccagaggaggatggtggaagcttgtttttcttaagttaagtaaaactgatgagtaaactgaattcttggatggagtctgcccagttttctcactcaagctcccctcctcctttagtcaaatgatccaattaggcccaagaggaacccagtatttatgagatactccagaagaggaaaattgtgtctaagaagaagtggtaaatgatgaagtctgaaataaatgttttcagtttataaacagccatgatacaaaataatagttggcaaatttaaaaacagctactttacttccgcttctagtttcaaggcaaatgattttttgttttagataaatttttaaaaagctaatgatcagtgcattaatgaaaactatctcaagtaccacaaatacatttgcaatttagatcaaaggctgcaaactccggcatccatggtgccaggcaggtaacctaactgaatagtggggagcaggtgtaagctatgggcagggggcatttcctgctttttccagaaaactccaaaattcaggtttttatgtgacatttctgtgttgttttaatttagtatggccaaacaaaatatttctaggcccagatccagcactgagctgacagtgtcacttctatcgcagaataaagctcatccaccaccgttagggatgtcagtacctgccaacgccactggggacagctggtccctcagtaagctgccagagatcggatccaaccacagaggcccaaacgcagttggatccaggaatctgatcattgttcttccatacctcaaccaactctagctatgatgtccgtaactacgtaaaaaaccagaactgcttttaaacccc

SEQ ID NO: 21 - DNA, 42185 bp, Homo sapiens
acagtgaatcacagtgagacactggcagcaggcaccacggaagggaccctcaaatctgaaggctcaaggtcctgggaaaagatgaagtggagcatgcctcttgtttcctcctattagatgctgagtgttggaagttcttcctaggattcacaaagaaactcctgctcttcttccacatactttttcctgggaaagaaaacttgtttcactggcagaaaagatccccactgttaaagtgaggtaaggatatctcatgtcagggtaggcatctgcattctcactttgatttctgcttgaagctgattctcagctctgcactttgagaaatttgattttacctgacctatgcccttctggaatttattatgttgtgatggtaagcaataaactggcattttagtgtcatgatgcgagctatacttaccggaaggatggaaatgctctaggttgagcagtcatgctctttttctcttctcagtaggaaaacacagtgtggggaaggaaatgaggccagaagatggatattggatggtcttaaggaagcattttgtttctcctggttatgtctccaccccaccagaatgtaaatttcacaagagtaaggaccttgactgtctcattcagtattgtatccgcagcatctagaacaggcagagatactcagtgcacatgtaatgaacaaatgaatcaaaggctgcctagctggatggatgaatccttatttttcaagggtcagtgtcctctgggaagtcatctctaaccatttttatggaagttagatgccctcctctgagtgtctacaagtgctgggattctgcagcaattttttcatttaattataggcattttggcattttgcacagagcctggcacatagtatataggtgttaaaataataatactgtggaagcctcataaatatctctcagcatgtgaaaatactttaaagtagatcaggatcttacattaaccagagctcctgtcctgcttcagtgttggtgatgcattagcaagttcttactccctgattttcatggcttctaagggaagaaccacccttctattttcagctgttattacaataccatctatatttgttgaacccacaaaatgtgctgaatgattttagcgaattacgtttctgggatcaaattggtcgtctcctgttgttgcataaagaggcgacttcatctcatcagcaaaccatctgcaagtcttagggtaggacatcttatttctagtgggacctccttgaaacagtacattcctctggggttatgtggcttcttacagctttggtcacacaaacagaagcccccaatctggtccctactcagttttggcccctctcttctattgtctgtggtcctctgtccacagaccacactccctctgacaggtatgcttgcctgaccagaccacacttccttggggtccaggtggggatttgcatggcaccactctgaacacactgaaagagcaaatagcttcatgtgacccacaggcttggatcatccagaagtaatattcattgttttaagaccagtgatccaaagatcaagacatagaccaagtggcaaacagatttaagatgagggcagcctaaagtctgaaaaaaagctagatactcaagttacataaaattggcaataaccagagaatggtcatgtgggcctgattctttggcagagtttgccacagccgaggatttaatattctctgttaatttatgtgggcctgagcccatggatgtggatggcttaagtggccaaggaagtggtgaaaaagaaaataggatcttcatagttctattggaaaagtctttgatagaacagtactgaagcaactctcactagaccagagtgacacagtcttggatttattgagtgcacatgatgagctttaggcatcccagtcattgttcccttatctaaaggccatcctcctttcccagggcagggaaggtgcatcttatacccatgttgtcacttagatctgttcagttgtgttgttcactgagaatccctgtaatgactggttattcgtgctgtgattgggtccttcttaacctgcatcctgatggctttaaaaccccaaatgacaagtcactgagccaaaccacaaagttggctagaatctaaatttagttaactgtgcccttcaaacacttgtgtttccttaaattaggttctttgttggctgattcccttctgcaggcatcatttataagtttccttttgtcagatttcctgtcatttcctatccacagtgccagcctctttgcacagttctgggtttctggagagcctctttacctgcttctgtcttcctcaaaacagccttattaaccttgtggtgcccttgctttttccaggaggcttttcttgctagcctgtgtctgtactgactaggattcatcccaatattcctgctctggcttttcatgcaagagaaggaagactactttccccaaatcttcttggtaaaaggaaaaaggaacttgcttttcactaatccaaggtttgcagttttcatacatttcctccaattcaaaaaaataggaaattgatatgtttttgccacctctctcataacccataccagtgttcactcctgatccatccccaaatcaatgaaataaattttttgaggacagaggtcctatcccattcatctctgcaggtccagtgcttagtgtagttcctgacacatggcaggtgcaaaatacatgtttattgagtggaggaatggataaatgcatgagtgaatgtataaatggagacattgagatggggccatatattgaaaaattgtaattgattataagttatttgctcattcaaaagtggtttaatgataatatagctggagttttcaaagttagtaattttctttgtcactaatacttagaatgtaagttcttttgaaaaatacaaaatatagttacaaataatgttttcaaaaatagccctaataacagtaatataatttctacttgaaaataagtttattaaagtaaaagagaaatataatgatgatttaaaaaaatcacaaggataagtactgagttagctattttctctctatgtatgattcaaatttgtatgctgattctaaaaggcaaatataaatgctaatgaaagtaaccaaaaacattaataacttgacttacgtggactttgctatggaaaaatgcaagtccattcaaatagtaatagaattcgctgtgataggtcggcttataactctgccaaaaaaactttataaatatatcagcttccaataagtgagataaatcaattaaacagcaattaagtaaaagttcaagttaataatcaattatatgctaagtaaaagttcaagttaataatcaattatatgctaagtaaaagttctcagagcaggcaaaaggttaagttattccatggattttcagtttcagatatttaaaatcatacagctttcagatctgggcaggcaactctgcatggtgtgaacaaacacaatatgcattatgcagagacatctaataaagatagaagtttctaaccaagcaatacatattacaagcagatttcgaaattgagggatttctttttcatcagtgaaacaaatcacagcatgtgtaaaaggttagtaaaaatagctatgtgtaaattgtgctttgatttagggaaatagaattaagcctggaagaaagttcacactagtctccaatgctaagtcagagagagaaaatgaaagagctttgtggaatctgccaagactcttcgtggatttcaactttgccaagattgttccgataaagcatctggtttatggctaaggagaggcgtggcctgctgagacagaaagattgtgtcttgctgcgttaggatgaggccgctatctcaactacgctgtgagggaaagccatttgactatggaggatagcctaccagcacaacacaaaactcaccatcttggctgctctgtgttgtgttacaagctctaataatctaaaggtcctacataggcaaattaacttgtaactagcttaataattgcagtaaggcaacattaaaatagcttcagcatattttagaagtaaatgttggaagatgaactcaatagagacaaggcaattgaccaaagacaaaagcctttcagatgttgggaaatattattggcaatgaatcatatgctcagccacatatggcttgctgtttgctctttgtagtttattgacatcaattgacctttgacatctggagagacaaggagaaaaggaggaagaccatatgtttactgtatgccaggaaactgtcacaggttttggattgtataaactccatgacatcagagacttggtgcgtgttggtcaaccccagcacttaaatccatgctggggacacataggtagttggaattcaccacttgattgaataaatgttcatctgttgagcttgctacttttgttccctggttagttctgtgcttagttccttggttatttctgtgcctgcagagaactccatccatccaagtagaattgattgacttttagccagtatattatgatttcttataagtgcattatttaaatttctattcgaattcatgaaatatgttatttgttacatatgacaccattatagttaatattgaacaatctttttctgaaatcttggaatgacccctatgccttatttctcttatgtctgtctgtctctctctctctctctctatatatatatatatgtatatatgtatatatactctctatattttttgggagacaatttagtctgtatatatatagagaatatatctatatatagagtatatatagtaaatgcttgagcatatatattatatataatagcatatatatactatatatatagtaaatgcttgatcacatatatgtatatataaaggatagtaaaatatgtcattaaattgtatcctctgttcatataggtgttattattactgtaataagttagaatcacacatactcatcattatcaaaattgtaaaatgagaagagcttttctgccattattagcagctacttctttccaatactcccctcttgaatatttatttatattcaaggtttgggaatttgtttcaccctgccctgtccacgagtagtgttcagtaaagatgcatgtgcatattgtttttgaaaatatgtttttaaacatattttagaaaaggacgatgttctattaaaacaaggtagtgagtctctagatgaacgaatcttatgagtacttaaagaatgcctgtagaccaaaattttggtcagaaaagaaatgggaaagaaagctggagaattcgctttatatgaaaagaggcaggttaagactataaaagccaactgcctgggaaaccactcattagaaaaaagtgccattctctatcttcagaagtcacaggatatacctaaataggctttgtgatttcacccagttctccgtgtcacacctctgaagtgtctccagaggattaacgatcacagtgaatatttagtaaatgcttgaccttgatgttgagttcctggcgctcagtaaacactggttccctcccttccttcctgcctgctttgaggaggagaaatccaaagcctcatggactgcagtgatttttaaaataccaaataagtaagtctacaattagatcagagaaaaagacgagtttgaagagaagggagcatgtttactgtgggcgaggaggaggtctgatcattagggtagattgtaacagccattttggaatggccttcggccagcagctgctgagcatttgaactcatttctgcagttctttctcagctgatgtgttcttcccatcagcggtgagtcagattctggccctgaccttagtggcagacactggccgaatgaccgtaagcaccgcccctgccccaaaggcctcctccctctcagagaccagagatctttcctcctttagaaattccacatgtaggttctagaggagtctagctggacccatgggtaagccattctcagcctcctggcaatacgatagtaactggtagatgcttttccctatattcgtgtgctcaggctgccataagaaaatacaacagattggatgggctaaacagcaccagtttattttctcacagttcaagggccagaagtccaagatcaaggctccggcagggttgcttttccctgaggctccttttcttggcttgcagacggctgtccccttgctccctctctgcatggtgttctctctcagtgtatgcattcctggtgtatttctctgtcctaatctcctcatgttcttcttgtaaggacacaaggacaccagtcatactggatcggggccaccctaatagcctcatttcatcttaaaggccctgtctctaaatacagtcatattctgaggtactagaggttaggacttccacaaatgaaatttgggagacataatttagtctataacaaccactcagttgcagtcttttttctgtgtttaaattcacacacaccaatatgacacttggaaaaaagctaaacaaacaacaatagcaaaagcaatggtctcagaaatcagaagagctgggtttgaggccaggcttcgccattaaccaacatctcccttcacctccgtgttcctggtcactgcctctcatgaagcagggatgagaccaccactcatttttccagcctctgcagcctgttgggaggaccgagtgagaagatgtgtggggagcccttcacggctgttcaatgttgaccatcacttatgtgggggctcctggtccagtggcttagagagtgggctctggagttgaactgcctgatccaaattccagagtcactgtcatgagctggtaaaccttggctaggtgatttccttcctctgtccctcagttttcttttctgaaaaatgggaatgatgatagctgatatggtttggctgtgtccccaccgaaatctcaccttgaattataataatctccacctgtcaagggtgacaggtgtagataattgtatcatggggggtggttcccccatactgttctcgtggtagtgaataagtcttgtgagatctgatggttttataaatgggagttccccagcacaagctatcttgcccaccactgtgtaagacatggctttctcctcctttgtcttctgccatgattgtgaggcctcctcagccatgtggaactgtgagtctgttaaatctctttttctttataaattacccagtcttgggtatacctttattagcaatgtgagaactgaataatacagtagcgctgactttataggcttgttgtacagattaaagaagtcagcactcactaaaactgtgtcacagtaaacaacccagcacatattttctatggttatgttttgtatgggtcatcaacctcttgtgctctcttccagtctagccccatctctcacatccagtgcccccttggttttctcctgaaggggggtgtctttagcaatggtggtgggcttacagtggccttacagtccctcagagatgagagaagtgagaaatttccccagcctggtgccccagcgcctgtgatgaggccaagtgtattagtccattttcacagtgctggtaaagacaacctgagactgggaagtaaaagaggtttaatggacttacagactcagttctacattgctggggaggcctcacaatcatggcagaaggcaaaaaggagcacgtcatgtcttacatggatggcagcaggcaaagagagagcttgtgtagagaaactcccatttttaaaaccgtcagatctcatgaggctcattcactatcacaagaacagcgcaggaaaaacccatctcccataattcaatcacctcccaccgggttcctcccatgacatgagggaattgtgggagttacaattcaagatgagatttgggtggggacacagccaaactatatcattccaccccgacccctcccaaatctcatgtcctcacatttcaaaaccaatcatgctttcccaacagtccccaaattcttaactcatttcagcattaactcaaaagtccacagtccaacatctcatctgagacaaggcttttctgcttatgagcctgtaaaatcaaaagcaagttatttacttcctagatacaatggaggtacaggcattgggtaaatacagctgttccaaatggaagaaattggccaaaacaaaggggctaccgtccctattcaagtccgaaatccaacaagtcagtcaaatcttaaagctccaaaatgatctcctttgactccatgtctcacatccgggtcacactgatgcaagaggtgggttcccatggtcttgggccactctgcccctgtggctctgcatcctccctcctggctgctttcacaggctagtgttaagtgtctgccactttttcaggcacacaatgcaagctgttggtggatctaccaatctgtggtctggaggacggtggccgtcttctcacagctccattaggcagtgccccagtagggctcccccacccacatttcccttctgcactgccctggcagaagttctccatgacaccaaggtggcaattgccctccatggaaggaagctgtctcactctgcccaaactccctgacacgtctctgctgctggcctggaggtgcacaggacagagaggagtctctttcagagacgtcatgatagtggctctagaatttagaccagacagttcaactagagagcccactctttaaggcaccaggccaggagtccccacataagtgatggttgacatccaatggctatgaagggctcagcacacagattcatcagcctcctggagaaatgactcaaggtgcatgtactgttgcagagccaccagagccatcttttcatactgatgtagaaataaagaccaaccagatgagaacaagcaaaggctatgtattcagagcttggattttggcagagacccaaaggcaggcagagtgaggaagcttcataatggaaaaaagggaaggcttcaggtgtgccttgattggaggctgttaacgtggggaagctgtgggcagttaagtagaaacaggacatcctatgtgataggttaggggagcatatttagctctctctgactggtcctaagttggaaatttggatttaggaaagctgtcagttattaatcaagtcctggcccttgggggtgggttattacaggggctattgtttgcttcctggattgttactagagatagcagtctgactcctgcaagtctgacttacatcaggctggcttcctaggtggttactggagataaagggttggtttcctgggctgggtgctgcaggttgtgagtcagagttctatttttatatgtggtctggtcatatttgtttgtatattcagtttctcttggaggacagcatgttgtccacagggctcttacaaggagatctctcaggcttcattgttcgtgtataaatctgggccagtccttaacacccatctgcttcctgcaggacttttgcagagaatggcagtggctgccttttattttgtcagggtacttgtggatataatgtaattttttgctgaagtctcttggctccaggtcttatttcaaagctgaaaccaaagtaacattttgggccagaaggaagcaggtgtttcccattttagaatttcagaagaagaaggctctaagaatgtggctaagtggagtaaacatgtatagatgggagctaattacataagtttggttgccacaagctcttgatctatgcaaatatgcttctgagaggaaatgtgaatttggagactgggagattctttctgcatgtatgatactgaataaattactaatcttcctgaggtcttatacataaattaaaggcaataaaaccaggcctcaacgattttgcagatatccaaccctcctggagataccacgtgtacaaaaagtattctgagccactttctgtggtagtattgtcctcactgtgcaaatttctcctttgctgggctgcctgctctgcagacagagctcgtttcaaatgccactatgcacaggtgggcatctcatgctggctcttaacctgtggcatgtgctgctactaattttaattgtgcaagtctctttactgcttacaaaatggattttcacccttggaatagtatcaaggtcctccagatctggtcctggccttagtccgtccctagtgctctaaacaagtccttactctcacaaaacccagatatatactcattgtctcctgaacataccaagtttggtttcacttgggctctcacagttttcctttgcctggaatctgcgtggctccttttccctccccaactcacgcctgaccctgctttgctctggtttttatccacgaaaggcctgattcaagcctcacctcctccaggatgtcttctctgactgtatcagaccatggtgatctgattccttttatttctgaacaactctcccatagcacacttgactttcttattcttttggtaagtgggtaaaactatacatgatgtttttggttatctatatcatattctgcatcttccactggacagtaagcttcagtatgtcagcaactttttttttttttccacacaggatctcactctgttgcccaggctggggtgcagtggtgcaatcatggctcactgcagcctcaacttccctaggctcacgtgatcctcctgcctcagccttctcagtagctgggactacacgtgtgcaccactatagctggctaatttttctatttttcgtagagacagagctttgcaatgtttctcaggctggtctcaaactcctgggctcaagtgatctgcctgctttggcctcccaaagtgctgggattacaggtgtgagccactgtgcccgggctcagtgactgttttactaccttataacctcactgcttaggattatgcattgtatgtttcaatgctcaatgaaggttcgttgagtgcaatgatgaaacaatgtgccatgtggattaatgtgttaagcatattagaacactaaaggaaccagtccctgctggtcccagcaataaatagttgcctgaaaccatttcagatccagagggagggggttttcgggacttagcctttattatagttgcatctgcagtaattcaaggggaaaaaagaatagctttaaaatttttattgtaacagaaacacaatgacagccactgcatgccctatggagggttttgggtcttggaacacagctaggcaaagcccaacccatggccctgagggttctgacaaatggaatggggcaggtgtggggggcaggtggtgagcccccatgcaggtacagggagtctttttgagcagaaatgaaaaatccagcagggatgcttcaaaagatgactgggattctgggcagaatgggggtgaggagcaagaccaaataatggggactatcacccatcagctgggccaaccctggcaacagtgagcccaggattgtgtgttaagaggcctaagcagacagggagaccagcactattgtggactctgctggcagccacctccatgtatctcggggtcggctgggtttcaggtccggggaggggacattgcaggacaaggcaggctctgtcctagagagccagggcttctattcagatcagcaagaaaaggctcaggcatggagaaatatcatgagggtgttttggggttggggcaggggtgatcttgttctcaggaataaagtaaaagcgcagatgctctgggcccaagttcagagttggctttgaggatgtgagtgaggatgactgtagaaatagaacagatgtggagcctggtgatgctgcacagctccaaggaccacagaagcaaagcgacttcaatatccaaagtcacagtccttgttagcagcaaatctaggcttcaagccacattcatgtgatccgcctagtccaggggcggagcattggttctaacttaccaggattttcatacagtcttcattagggctctcagtttctatggtggtgccaagacggtttcagggtgtgctctgacagtgagcgattcaggaaaaaggacttgatgggagcagatatgcattttcctgcttaatattaagaggtttttgtgttagatcttgatcaaaaagtctgaccttaaaagacacctgcagttcaaagatgatgactttcacaatgacaatgaccattacaattcagttcctctctgaagagctggagagaagagaaaataaatgcctggagttcaaaaacaagacaatggcaccaaaaatccatcagaaaaaagaaagttttcctcaaaaagaggacaacacaatacccaggggggaaaattatgccttcagtgagggatttcataaagagttatgacatttcagattctcaggaagttaaaatagttgtatctccattgtgatatgccctttaggaaatcaatataatttattgtgcctcttcagggcccattttttatactttgaagtctacaggacagagtgaaggaatagaaactcatttaagatagttcaaataatagaggggtgtatcatattttcagaatccgaggacagaaattgcagggcatctcagtggaactggaaattcaggagcaaaggttgttttgtcttcttgcaagggcctttgtggacactcagaggcctcatagtctcacttctctctgcttctctcctacctccctctgtgtcttctgctcacaacatgactggcaggctaattgcatgacattactctgagactacattctttgtgtaccttgtgttgggtttttgagagacatattctgactcagtgcagtctagtgaatgacttgcagtgagtcagatgccaatcaactttgctgggggagaaggtgatgctgtagttgaggatgaaggagcaaggcagcaaaggcttacagggtacatcactttggatggggtacaggtggggaggggcaggcaacagtcagtatctgcatcatagactatcatggcaacaacaatgatgctataatttgggtgttctcccaggctgccacacagtggcattgctgtgcacacttgagaaaactttatgaagttaccatgcacagcttgtcattttggtggtcccattccctcagcaaccctgagatcccagtatcttcctagatactagaaaaggatgcataagcggtaaaaccttgacctgaatttgagcaattttctaagtacaaagagtatatctttcaaacctttgcatgtgtgtggataatttgtgtatatgtccctcctctgaaatattaatataaataacacccagaatctgatattcataggtttggggaaagtgtgtggggtatttttctttgctttaaatctggtgggttttggcatttttgcattttcccagtgttttaatcctctgatctatgggctctggaataaagagctgcaaagcagattacaccattggatgtgttgtcagctatggtgtggtcacactgtcaacagcagagggctagtttagaaaaaaaactcagccatttgaatcaataactctagtcctaatggtctcatcagctaaggctgaggacctgtctttcactcaacctaaaattggtgccttcatttgattttgaaagaaatatgagtaagtcaaagttatttgtttggcttacaaacttgactactgtgtacactgaattggcttcagtgaaatccttttaatgtctttaactttaaacccaggccagtgtttttagcagtgtgctctaccgtgtatgagcagttaggcaggtcttgggaatatacttgtttttagaaactgagaaatagtccatggttaatgtgaagggaagaagtttggcttttcccattatactaattaagggtggattcagctgcatataataaaaatacagcaacaaaataacagtggcttccaaaagttagagatagatttttttttctttttctttaagacagggtctggctctgtcacctagacctgagtgcggtggtgcaatcacagctcactgcagccttgacctcccagcctcaagtgatcctccagactcagccccccaagtagctgggcttacaggcacatgccaccatacctggctaattaaaaataaatttttttttgtaggaacagggtctcactatgttgtccaggctggtcttaaactcttgggctaaagtgatcctcccacttcagcctcctaaaatgttgggattacagatgtgagccacagtgcccagccgttttttttttcttatgtaaaacaaacctggaggtacataatccaggcctgtgtggccactccacagtcaacaagctcattctcttctgttgtgccatgattactgtgccacctcatgactcaagatggctgttagtgtgcctatcatcacaggcacactccaacagaaagcaggaaggagcaaagaagggtcggcacctttcttctgtagacacttcctagaagttacacaaaatacttactttttcttatgtcaaattggtcaacatttagtcacatgggtatgcctagtaatatggtttggctctgtgtccccacccaaatctcatgttgaatcataattcccaatgtttggggagggacctggtgggaggtgattggatcgtggtggtggatttcccccttgctgtttttgtgatagtgaatgacttctattgagatctggttgtttgaaggtgtatggcactccccccttcacattctctctctcctgccaccaggtaaagaagattcttgcttcctctttacgcgtccgccatgattgtaagtttcctgaggcttccccagccatgctgaactgtgagtcaattaaacctctttactaattacccaatatcaggcagttctttatagcagtgtgagaatggactaatacagaaagttggtgccaggaaagtagggcattgctataaagataccggaaaatgtggaagcaactttagaactaggtaacaggcagagattggaacagtttggagggctcagaagacaggaagatgagggaaagtttggaacttcctagagacttgttgagtggttgtgaccaaaatgctgatagtgatatgggcagtgaaatccaggctgagtggtctcagatggagatgaagaacttattgggaactggagtaaaggtcattcttgctgtcctttagcaaggagactcgtggcattgtgcccctgctctaaagatctgtggaactttgtacttgagagagatgatttagggcatctggcgcaagaaatttctaagcagcaaagtgtttaagatgtgacctggctatttctaaaagtgtaccctcatatttgtgaagaaggacatggtctgaaattggaacttatatttaaaagggaagcagagcataaaagtttggaaaatttgcagcccgaccatgtggtaggaaaaaaaaaaactctttttctgtggaggaattcaaggctgcagaaatttgcataagtaaagaaatgttaatagccaagacaatgggaaaaatgcctccaggacatttctgagacctttgtggcagccccttgcattgcagtcctggaggcctatgagggaaaaatggtttcgtgggccaggctcagggccatgctactctgtgcagcctcgggacatgatgccctgtatcccagctgcttcagctccagccatgactaaagggggccaaagtacagcttgggccatggcttcagagggtgcaatccctaggtcttggtggcttccacgtcgtgttgggcctgcaggtgtgccaaagtcaagaggtgaggtttgggaacctctgcctaggtttcagatgatgtatggaaatgcctggatgtccagacataagtctgctgcaggggcagagccctcacagagaacctctactagggcagtgcagaggggaaatgtggggttggaacccccacacagagtcctcactggggcactgcctagtggagctgtgaaaagagggccaccatccttcagacctcagaatggcagatccaccgacaccttgtactgtgcacctacaagttgagtgccacaggcactcaatgccaccctatgaaagcagctaaggggctgcagagccacagggctagaagttcctaaggccttgggagcccaccccttgcatcattgtgtcctggatgtgagacattaagttaaaggagattattttggagctttaagatttaaagactgccctgctgggttttggacttgcatgggacctgtagcccctttgttttgcccaacttctcccttttggaatagaagcatttacccaatgcctgtaccgccattgtatcttggaagtaactaacttgtttttgattttacaggctcatatgtgaaagggacttgccttatctcagataaaactttggaattggactttgagttaatgctggaattagttaagactttggaggactgttaggaaggcatgatggtgttttgaaatgtaaggaggacatgagatctgggaggagccaggggtagaattatatggtttggctctgtgtccccacccaaatctcatatgttgcattgcagtccccaatgttgggggaagaacctggtgggaggtgattggatcattggaggcagatttcccccttgctgttctcatgatagtgagtggattctcatgagatctggttgtttgaaggtgtgtggcacttccccctttgctctctctgtcttctgccagcatgtgcagaaggtgcttgcttccccttcgcccttccaccatgagtgtaagtttcctgaggcctcccagccatgcttcatgtacagcctgtggaactgggaatcaattaaacctcttttcttcataaattacccagtctcaagtagttctttatagcagtgtaagaacagacaatacatctagcttacatggagaaaagaaataaattttagctggttagctgtgtcctcagccaaaaattgggattcttaatactaaggaaggaagaatgagtatcaggaggcaaaattatttcaaggatcagtttggtttcaaccaagtaaagtataaagaaagacagtggatgggttatggtcaccacaaacatatactctgtttttcagcatgacatacaaatacagagttaactgttcaggatgccagagaactttagttgtgttatattcacagttttcaaagagaatggcatcaataagaacactgacctggtttaaacatggaaatccactaataactttaagcaagtttgaggcagcagcatgaaatatattctttcacagaagtttatgtgtggcatttctttagagaaagcatccatttctgaatcagtcaggattcagttctagcaataagaatcatcaccctaggtattttaagcagaaaggacctaatacaggaatcagatgctgacaaagtccctagaaagctgaaggagtgaaattgggaccccaaaccccatgcctgattgatgtcaagagtaaaccactgcaaccagcatgatctggaggttaagcagctgccaccaccacagctcctcctgccccttgacactcatgcctttgtgaatttgcttgccagaagaaatagtgagagggagacggcctccactcccttccatcttccaaatcttacatcattgcttctaactggtagaacctaagtggcatccagaactctaaaagtaaagaagtcttggaaatgtagttctgagtttcatagatttggcaatgctggaagttaccacaaaaggagggtaaaatgaagattgaatgagccaatccataggatctgcctttactgcatttaattttacctacaggcaacaacagcagcaaaaacaacagatagcatttattgagcaacaacggcaaccctaacatgatgcgagctattttataaacaatatgtcacatcctcacaacaattttatatataggtatgattatttctgattttaaaatgagaaaaagctgaggcttacaatggccttacataaacctaggaggtcggggccttccctttaacatttgtcttgtacactacttggcccaaggtgatcatttcctcactgttgagagttgggccaattgcgtgggagattcaggcctcgattctccactgtgctttgggtgtggacacctggatcatggaagaaagcctttttcacccattgttttgattacattctcctgtcctcaggccttccttgttttcaggctctagtggtttctactacattttgacttcaagttttcttgcttctctctaggtgttataagtcttgcccctctccaaccccaactttgagaaaacaaagcatcactttttcttttccattgctcaagtatctttccagggaaggcatcaggtcttagtacctttgtcccccaggggacccaacacggggcctggtggactgtaggccctcagattaagaaacggattcatcaaccaataaaacatacctttctacaaaccccttccccataaaagccaagctctctctttattttggttaacattttttttttcctgagtctgcttgctagggaactgttgaaatattaagccatctaagagcaaaggatatctttgttccccagaaagtaaaagaaaaagtaaaaaaatttaccaagcttaacttatatataagtcctagatctaatataagtcatttaatttatccttaaaacgtagaaaactattaaaactctattttctgatctcaaaggtgacttctgcttgtaacattaagtgctaagtggtagtttcatactttcaaatacaaattatcaattttaaaattaaaaaaattttgaattgggaatctaagtggtgtaaaagtcaaagggttcaaaatgatatttagtaaaaaaaaaaaaaaaaaaaaatcttttcctctccattttcccaggtctcccactcttctctaagagtcaaccaatgttaacagttcttctgtgttttccttaagagatgatctacaaaaggcaaagtattgagaatttatcatttgtaagataattttggttttgatatcatagatttagattggaaagttgtttaaactggtatttagagttataatttatgtcacaaatgagagttcatgatatcagcaataattaacttcatgatgtgaaaatcctgtgcacccctgggaaccttaaactctgggcaagatacaaaagggaagggaagagaggaagtggtaggtaaagttacttgcaattgttgagagttcttgtaaaatgttcgttgctcatattgaatggtgcaatgatagtgagtttaaagtcagatagtgtgggaggtttgggcaaatgttcagagaagatatagctttcataaagctctaagaataaattgctttaaggataaaatgtgaattatctcaaaatttctaagttcttatgaatattttatttactataactgcaaacacattatttctgcatgaaactaattctggcttctacgtagatatgctatataaacacatattgactactttaagaataaacttgggcaaaatcttaaaagcaagaatagaaaagtagtagttcataatactcatcataagaaaatgttgaatgaattcaggccattgtttagaagaagttcaagactgtaaaatcagccatgcttatggattttaagctttttttttctcctctgagaaggtcaaagtctgtttctggaactacctgcctgatggccatacaaacacatatatatgcagtggagagaaaactgcacattggtggaggtggggagaggatgtcagagtgttcttgtgagccaagaggacttacaagtagggtctggctttgggttattggaaacgacctgtccaaagggcttcatgccaaaggaaaggggcctcagccgaaagaggctggaggttactattggtagcagaggatgaaaatagagtgagaagcacctggctaaagacaaggatttcccaagagtccaaaggggataacttagacctaggatcccacagtgtggtatagaaaagaaagaatcaccgctgggaatctgccctacgcagaagatgcaaatgtcatattacatctgcctttgttaaggatggcctttcctgcccgtttcatgttcttccaagctctgttccaacactgaaggagtcacaggtgggtaggggaagcagacaagaaaccttaattccacctgcaaccttaattccttcttgtaatgcagcacaacatagccatataacacagccataagctttgtgggagtggggggatgttattctgcctattatatttactaaaatgagattgttctttggagctgataatgaccaaaggacttttattatttagaataactaggcaaaatgcaattcaaaaccataatgagttatctcctcacatccattatgacagccaccattaaaacaaaacacagaaaataacaagtgctgctgagtatatggagaaattggaacacttgtggattgccggtgcagttgtaaaatagtatgaccactatagaaaacagtatgaaggttcctcaaaaaatcaaaaataaaattaccatatgatccagcagtcccacttctaggtatatatccagaaagaactgaaagcagagcttgaagagatatttgtatgtccatactcattgtagcatcattcgcaatagtcaagaggtggaagcaacccaaatgtccatcatgcctcatggatgaatggataaatgcagtgagatatatatatatatatatatatatatatctcctatatatacaccaaattatgacataatttccttcctttttaaggttaaacagtgttccattgtatatatatatatatatatatatatatatatatatatatatatatatatgtaatttcccaatggcttaaagaaggaacaaattattggtaaatgtcttgatcttattacatattataagatatagtataaacaaactataagttgtgtgtgtgtgtatatatatatacacaatggaatatttatatatacacaatggaatgttgatatatatacacaatagaatattgatatatatatcttatatataatatatgtaacatgtaattgatatatatcttatatatgtaattatatatgtatgtaatatgtgtaatcttatatatgatatatatcaatattataatatatgtaatatagtatgtaataagatatgatatgtaatattgtagtatgtaatatctatatacacacaatggaatattgtttaaccttaaaaaatctggaatattgtttaaccttaaaaaggaaggaaattatgtcataagctacaagatggatgagctttgaggacgataatgctaagtgacataagccagtcactaaaagatgaatactgtatgattccatttatcagaggtgtttaaagtagtcaaattcatagaagttgaatataaaatggcaactgccagggctggagagagcagggagaatgaatagttctttaatgggcacagagcttcagttctcaagatggaaaagttctggagatttgtttcatagccatgtaaacgcacttaacgctactgagctatacacctaaaaatggttaagatggtacattttatgctgcgttttttttccacagtcttttgaaaaagtgactagacaaaactatgggatctcatctaagatttcatcctagggaggtaaaggttggatttgaaaatagggtttgaatgggccccaggaaaaagaatcaagctgtttcttgcttgcatactagtatgtcttgctatttcaatataaaggttaccagttaactactaacaagatcactattcatcattaagaatctgttaatggctaatttgaaaggaaattttatttctagttgtgatatataggtatacatgttacctaaagctaagtatagtatagatgctatgtgtatatgcatatgtatgtgtatagagaaatttatattcctgtccatatatacaattataggaccattctgggccaattgaatctagactatttccatgagttaaggtcagatgaaccttagttgtaattattatacttacagtttatgtagcactaacaattttttaaaaatcagaaacatcagtcaatcatttgctttgctttggatataaggactttttctgcccatgttctcacgttatctccatatctaccaccacagatctcctagttaaaggcaaataaccacaacacaggcaaaaataagagagcatgtgactgagagacagtgatatattatttccatggatccccaggtgctcattctttttacattttaatgtaaaatgtaaaatctagatgtgtttttcaaaaagactaaaaagtgctgtccagcttctgtgccatggcctgtgcgtctatgacctcagacattattccagggagcatcttagggcaagagcaatcccctgatgtttcagtcagcagccatttacaaaccattagaggaaggaatgtgagtccaggtttttgtttgaaaattcctcattgacaccttgttgtaataagatcaagacatttaccaataattagtcccttctttaagccaatgggaaactcgaacttctcctatctttttgagattaggtgaagccatgtgtacttttttcattgtctattcctgtgtaataaatcaccctccaaacctagaggcctattatctcactgtttctgtggatcgagaattcagacaggacacagacatatgggaggtgcctcatctggaagactggaaggctgaggggctgggatcacctggaggcttgatggaggctggaggatccactctgagggacccactcacacacccagtgggttggtactggccaactggttcctctccacataggcttctcttcatctggtgctctcaaagggctgctcgagtgtccttgtgacatgatggctggccttcaccagaatgcaccatctgaaagtgggcccacaccagttgaaggtattctttttgcatttggcctctcgggtcacatatttcaatgtctgccatagtcgtagcgaggcagtaggtctggcccacatgcaagggaaggggaattagtctccaccttttgaagatgggtagatacatttttaaactactggtccgtgtgactggttttgcaaataggaagtgacacctgtcacttttgaaggaaagcctgtaagaggtggtgtgtgattttccacattctggtcccctgtcaatattgagggtgcacgtgttcacatggaggactaaagctgaactgttacacggggtggctgccctagaaagtagccctgacccaccagggatctcgtatgagtgagaaataaacctttgttttaagccactgagatttggggatagttactgcagcataactaactctatcctgatgaatattctcctgcaaccaaatgtgagaaacagctgtcagtggcccaaagagaatcctggagactgcagtatatctttttaaaagatacacttggctgggcgcggtggctcacacctgtaatcccagcactttgggaggccgaggcaggtggatcacgtgaggtcaggagttcgagaccagccgggccaacatggcgaaaccccatctctactaaaagtacaaaaattagctgggcgtggtgacacgcacctgtaatcccagctactcaggaggctgaggcaggagaatcgcttgaacccaggaggcagaggttgcagtgagccgagattgtgctactgtactccagcctgggcaacaagaacgagactccgtctcaaaataaataaataaataataaataaataaataaaagatacactgcattaccaattctcccagtggcatacagtcggggctggcaaaccacggtccacaggttaaatccagcctaccatttgttttgtatagcctgcgagtaagaatgttttttttttttttttttttttttttttgagacggagtttcgctctgtcgcccatgctggagtgcagtggcgcgatctcgactcactgcaagctccgcctcccgggttcacgccattctcctgcctcagcctcccgtgtagctgggactacaggcgcgcgccaccatgcccggctaatttttgtatttttaatagagacggggtttcaccgtgttagccaggatggtctcgatctcctgacctcgtgatccgcccgtctcggccacccaaagtgctgggattacaggcgtgagccaccgcgcccggccgtaagaatgttttatacatttttaaatagctgaaaatagtcaaaagaagaataatagttcatgacgtgaaaattatataaaattcaaatttctgtgtccataaagattgtttttggaacacacccacgcccattcatttcagtattgtgtatggccggctttgcctcacagcggcagagttgagtggctgtcacagagagcacagggcccggcagagtctgaaacttgcagaaaaagtttgccaactcttgactgtagaagacaagaaagtctgataaaatatgaaatttgatgactttgagttgaaatgtgattcagaaaagttggacgaaacaaatttaaggaacaccctaaccaactcattttctttgcatctctattttaatgtgaccaaaggtgatataggatgaacatctgtccgaataagcttcaataaatatacagtacaactcctaagaaatgaaaaagcatggtggcatagtttactttgcaacttattttcctgccttatacgatctatggtgtcctggatgcaatgatatatggtagcatagaagataaaaagtgaaaaaacagtcctctggaaaagcctttgaaagctcattgtgattatcagcctttctgagtcagtagctctttttcttttgaaacagagtcttactctattgcccagcctggagggcagagataagatcacagctactgtaacttcgaagtcctgagctcaagggatcctcctgcttcagcttccagattagctgggactacagttgcatgtcaccatgcccagctaagtttttcctttagagacggggttggggggagggggagtggtctcattattttgcccaggctgatcttgaactcctggcctcaagtgatcctcccaccttggcttcccaaagtgctgggattacaggtgagccaacgcatctggccagtaggtctttgtttcatttattctacccctagcagttggcaaaataaacaaggtggtgagctccgattttgtgcacctggtctgatagctaattagcgcatcagcatcctgaagtcctcagtctagggtgttcctggattttattcagctgtttagagcacctggatgggggctgggcgcctgtaatcccagcattttgggacctgaggtgggtggatcacttgaggtcaggggtttgagaccagcctggccaacatggcaaaaccccgtctactaaaaatacaaaaattagccaggcgtggtggcgggcactactcgggaggctgaggcaggagaatcgcttgaacctgaaaggtggaggttgcagtgagctgaaatggcaccaccacactccagcctgggcgacagaatgagactccatctgaaataaataaataaaataaaaattaaaaatagagaacctggatgggatctgcagcagcactgcccagcaggtgcttttcctgctctttctgagaagggctcctctccaccaagaaaagtgactgcagccaaaataggtctgggctgagcatgaatttattttctgtggtctctgctgtcagtacttccaaggatgatagccagagtgtcctcgcttcagagaatccaaccatggctttccagtacaatagacagaaacaaatgccctgagtcaatataggctgtgctgtccctttaaaaacaattctcatttactttggcaataaaatattaatcgcagatgacagaaagaaaagtaggcaattaattctaaatcattacactggcttaaagtggggaagagctcaagctcataatgatacactgatctctcctgggaacttcttctttcaaggggccctcctctaaaagataattgcaggaaaagactagaaaacacatgtgttacttcgaaaagtgtgaataataataatgatcaatttaggggatcatgtgggccaggtgggaccaaatagggggttttatttttagtggaagtggggatcatcatgtagtttttatagaagtcagatatattcaggtataattgacatacggtaaaatccactcttttttttttttttttttttgagacggggtcttgctctgtggccaggctgcagtgcagtggcatgatctcagctcactgcaacttccgcttcccaggttcaagcgattctcctgcctcggcctcccaagtagctgggattacaagtgcccgccaccatgcccggctaatttttgtatttttagtagagatggggtttcaccatgttggccaggatggtctcgatctcctgacctcatgatccacctgcctcggcctcccaaagtgctggaattagacatgagccactgcactgggccaatccactcttttaaaatgtaggtttgttttgttttgacaaatgtagaaccacatgacaccaatacagtcaagacccagggcagtcccatcgtgccagacgctccctcagtccctttggcagtcactcctcttttgccgtgccatccctggcaaccaccaatccatgttttgtccctgtagttttgcctccactagaatgtcatataatggacatcatataaatgaaattatgtcattaccggcctgttgagtctggcttttttcagttagcctaatgctcttggagttcatccctgttgccgcatgtatcagtagcttgtcattctttattactgagtaatgttccattatatggatgtgctacaatttacttaccaatttacttgctgatcggcgtgtgagttccttccagtttttggccattacaaataaagctgcaatgatcatccatgtacaggtctttgcgtggacctatgtttttatttcagtgcctgggaaggggttgctgggccaaatgataaacattagtgtaattctgtcagaaactaccaaactgttttccgatgtgattgttccattttgcatgcatgagatttccagttgctctgcctccttgtctgctcttagtattgccagtctttctaattttagccatgctaataggtgtgtaacagtatctcatcagggctttcatttgcatttccctgatgactagtgatgttgagcatctttttatgtgtttaatttgccatttgtatatcttctttgatgaagtatctgttcaaatcatcttcccttcccacttaaaaaaaattgaatattttgtctctattgagttctaagatttgtttttctttctttctttttctttttctttttttttttttttttttttgagatggagtcttgctctgttgcccaggctggagtgcagtggcttgatctcggctcactgcaacctctgccttctgggttcaagcgattctcctgcctcagccttctgagtagctgggattacaggtgcctaccaccacatctagctactttttgtatttttagttgagacagggtgtcatcatgttggccagactggtcttgaactcctgatctcaggtgatctgcccacctctgcctcccaaagtgctgagattacaggcatgagtcgccgcacctggctgaggatttctttatatattctggattccagtccttcatgagatatgtgtttttaaatattgtcctcatcttttcttgtttcttttttaactttcttaaaagtatcttccaaaaatcaggttttaatttgatgttcagcttattcttttttttttctcttatggtttatgtgttttatgttctagctaagaaatctttgcctaacccagggtctctattatttttctactgctgctgtgaaaaactaccacaaccttagtggcataagacaacacaaatttatgatcttacagttttgtaggtcagaagtctgagctccttgactggtttctgtactctgggtctcaccaggccaaagtcaaagtgtcggctgtctgggctcttaccaagaggcttgggaaaaatccactacagtgttcactcagggtgtgggcagaacccagttccttgaggttgtggggctcagctgccagcttcattgctggggtcaactggggtcgcccttggaattctctctgatcctctctctgggcctctctctgatccttgaaaatgaggccctcactctgctagctggcaatcctgactcataaactcttaaagaacttctcatgactggaatatctaattttcccttctgctgcagctagagaaagttctctgctattaaggggtcatgtgattaggtggggcccacctggatagcccaggatacactccctgttttaagatctgtctctttccttgcatctgcaaagtctcttgccaggtaacataacatgttcataggttccaggaactaggaggtaggcatttttgggaaagcatccagcctaccacctcctcaaatattttctctcctgtttcttctaggagctttacagttttacatttaggtctatgatccattttaaattaatttttgtatatggtatcagattcttggattatgattgagattttttctttctcctcctttttttttttttttttttttttttgcgtctggatatccaattcaagaaacatatgttgaacaagttaggttttcagtttctatcatgatgaagaatttgtgatttgtatagcttcagaacccacagaaccatggctcatgtttcatcatgatcacagctgacttcacggactgatttcatgaacagtcccatcatgttttgacactcacagaaagtatttttctctgggaatttttaggagtgggaacgtatgcttccctgttctctgcctcacctcttgcacatacacagcattgcagatggcacggaacccctggttcagcgggctatgggtgctctgcaacactgaaggtgaaggtagaaggaagcagcaaaaaaaaaaaaaccctggtccctgatcctgttttgggggttggggtaggcatttccttgggagcatttaaacaacagcacatcgaggagggacaaaactccttggccagacaggtaaaggtcagaatttgaaggcaggaatggaagtagcaggtgaattctaggctgatgtaattcaggtatagggggttgggatgggcacagacaggattgggatcagattggcagacagggaagggcaaagctgcaaaggtggaactgcagaccgaccacggctcgtgctactagctgtgtccacacccacaccctgcagagggccttggtgacatggggcagagccgtccccagccctggagagccagagtgccccaaaagtttccttggaggaggacaatgggacaggcccaagtgccccacaaggcactcaatccccaggagacttgctggttcttggcacctgcaagggaaacccaaggggctgtctcgggtccccagcccctgttgctgcccccagctctgaccctggcttaggggcagatgcctcaggctgctgtgcctgcagattttgcagaaggaacaagaggctttaaactcagtacacttagccagtgcaactctctttcactaaggaaagaaatagttaagaattcaagactcctcaccttatgcattgatctgtgtctgctctttgattccaaagacaggacggtctatgagccaagccagaaaatttcacactggatcccttaatggatcccttcaggcaccaatactgctgagagagacaagaggcgacagggcctggcctagatgtgggcaaattcctatttgaagtggcatgagctgtgttctgtctgacttccacctttttagctttttctttccaggccattctcaggaaccccgtccacaggagtttcccccagtccccagccatcggcctccctgtgctggggctgaagtcaccgttctctttgggatcaccctgccaaccttatctggggtcactgattgtggctggcatgacagaagctgccacccgtgctgtggcacctgaagcctcgtgggacctcagttccagggactcctgatgagaagggtcaggagggagaaacccaggacactgcatgtgaagggaagggtaccctccctggtcccaaccacagccgtgactcagctttaccgagtagctactgtgtgcgaggcactttgcctatgtggttggatcaaatggcattttttcttcccttctgagaaattaaaatgattaatttgggcacttccactatctgtctgcaaaagaaaactttatagaatctaattctggaggcaggcatttctttagcctaataaagcccaagccaggttagtggttgtcaagaaatagtatttgttgaaatagaccaggttagatagttcaacagaagaaagtcaagtagaaggatgatgaatctctcctggggatcaggatgatgtgttagaaggaaattaaattttcagggtaaggtttttttttttggagatagggtctcccttttgccacccaggctggagtgcagtggggtgatcttggtccactgtagccttgacctcctggctcaaacaatcctcctacctcagcctcctgagtagctgggactacaggcgtgcgccaccacacccagcaaatttttatttttatttttttgtagaagagatgggggtgcgggggtggggggcggtctcactatcttgcccagtctggtcttgaactcctgggctcaagcaatcctccctccttggcctcccaaagtgctgggattagaggtgtgagccaccacgcctggctgggtttattttgattttaggtattttaggacagaagctgaagcccagtgttcactccaacacccccctcctgaatcccaaaaagtctgggtggtgaaaacttgatcctttgaaagccccagcccccaccccatctcccctcctcacctggacccttggcagtgggggtcccagggcttctttcaggaagtcctgtctcagggcgtcctctggcctctggttctcagctccaatccctgctgtcttccccgccttccccacgaagcacagagtcaggcatttcttccctgggcctgtccacactcctcactgcttccttgagagaacaacgaccccagctccagtccaggagggactgtgggcctagaggggccgctggctaggggctgagaggagctcccggaggtgtggttcccgagactggtcttctcctgttctattttcctgggtgtcattttcacggcaggaaacctttttagaaagggagggaggcacatttttctcagggacattcacagcaaggcctcatcctgcccacgtcccacagccgcaggattttctggcctggtcctgttctggatctgcctgattctcaaggcacagcagcaggggagggcgggctccgcaccctggtcaagctagggcaggcgcttggcttgccagcaaaaggtcccgcttcccaggacaaagactcgctctgaggccgcacttaagtcaggctcctcgaagctctctttcaacggggcctcaaccctgggcttctgtgcctgtcatcgttgggcctgcatcagccagttttagcaagtccctcctaagtcagtgtggagagaggcccccatccttcgcatctgaccaccctggcctgccttcagcaagaatcctaagcctgtttaaccagaagctttccttccccctgctgctttctcttagtaatttcctccatcccgactgccagcctgctccatggctataaatccccactcgttctggttgaattaaccactgagtccgttctatatgcactgaggcctctttccccctttgcaatacttcctgaataaaatgtgcttttcctactttacctactgtcaggtcctgggtttctttaacaggagggcaaccttcagactgggtccaggtcagtgacatagaaggggaagtggcacagtgtgtccacagagggcagagcccagtgacgggagctcacagcagagacgcccaggctgcattcgggagggcagtggcaccgatgagaggggcataggcaaggacaccacggggcaggatgcagaagggagtcctggggcagaaccagagcgggagcccagcccatcaaacatcaagacgtggcctggtgcatggggagtgagattccagtgacccaatggggaccaggagtcgggagatgctgctcggagaagctccggacctgcaaaccagcctgctcagactgactgggagcctagaggcattcattcattcatccattcattctacaaatctgtattaagcgctgatgagtttgacggtagggatataccaacaaacaaaagagataaaaaattttgtccctgtggagcttacatgatagtgacaagagacagacaccaaacacaataaacaaatcatgttgcgtgttagaacatgataaatgggatattttgggggaagaaaggacacacgtgagagggagcaggagagccaggtgtgggaggttgcagcattaggggtggttggagcaggctcccccagggacatttgagcaaaaacattaaagatgtgagggtgaactgtggggacttccagggggaggaagctccagacccaggggattgctggtgtaaaggccttgaggcaggagtggcctgggttccagggaggccagtgggtgcagcagacctacgagggaggggagaagcccctcatacaggcctcagagggggtgctctcaccctgaaggtggagtaggtaggattggactcatcttaacaggctaagtctggctgccatattgagaataggctttgggggtaggggttggggttgtgacgtgtgttgggtggggtaggaacaggccatgtaccactgccattaaagcatttcaactggggacctgttaatattcttaactgctcccctgcatttcacagctgcctgtatccaaatacaatggggccacctgacagcacacctcagggtgacttcatgttcaaatataatatcaacccaatatccaataaaaagcttcaaaaatcatgccaacatcttaagtccctcaaggcggtgtcaaagcaggagccaatccatgacctaccgagagaggagaaaggaagaagccagtcaggcaggcagttagggtgggccctcagttaaattctttcaaacaaaagaacagccaacttgcacagaggggcttgcctaagacacgcccacagccacatagataagaaaagctacacaggtgactcacccagacacgcctgcagtggaaagttctgtcccgtaacacatgtacagtaaggggaacaaagcaatatggagtcactaagctaagggcccacatgcacacttggaggatggggtggagctaacagaaatttgtgtcttatgcaaatgagatgcccagccctcatcagtttcttataaaagcctttgcattcaactgtaaagacagcaaccctcttctgggccccctctccatggcagaaagctttcttcttttgcttagaaaacttttgctccaatctcaccttttgtgtccacactccttaattctctgggtcatgagacaaagaactccaggtaatacgtcacaacgagagactgctacgtcgtggtgcattggtgagactttaacactaaaagagaataccgtgtgggccacctccactcatccatctctctctgaagttctcatgaccatggctcaatattaatctcctccctccatccacatgcttgctccctgcacccccaaatctcatctgcccagctgcttttttatttagttcccttctcagtttagttttttcttctgcagttggcttcacattctattcttattactgtttctgaaagctgttaataaataaacaattaaactacaaaacattacaattaaacaaaccaagcaatcaaccaaacaataaactctcggttgtcacctcacaggacaaggacagctcttgtgattaagttgcaggctctactgctgcccacaccacagataccttagttagatttgctcctttgtcaaatgtttaagtcagataaaggaccagtcgtagggcagtggatctcaaacctaattgtggcaaaacaaaacaaaacaaacaaacaaaaatcacctagaaaacttgttcaactggttaaaaacacagattcctgggcctgaatcctagagattcccacccagagccaacatcccagaatctgcattttaggcaagctccctgtgattctgaagcagcgggccataggcaattcattgggaagcggtcagtgtccagatatctcagaggacccctctctaagcactcttgattggtcccaaagaccccccttcccccagtaggctggcttcttcaccctgtcctcatcctctagcatccccgagaggaggtcacctgggacattcttgcaaatgggaggatctagaatccaggtctctgcctgctgccggccatccccaggcgggcctcctaccagattccaatctatgaaacgaaaaactggggatccttttccagcccacgttactgagtgcatctcagttgtttcattatgctagctgtgaggttttgcacttgtgacaaacaacagaagggaccttttgtcacagtaaggaaatcctcgcaagcatgtgcctaaacgtgactgcctgctgcttcgtctttgccagtctcatctggagaggacctggcgcatgctcttggttggttttcctccatctgcatgaaataggagccactgagagcatcttcctccccttcaaagccttcactacttctttctgctagttccttgtccttgcaggagctttaatagctcaattcctttccgtctctggaggggcccacagtgccctctggtggttgaacagcatgctacacttttttttttttttttttttttgtggggtagggagagggtggacagagtctcctgtcgcccaggcaggagtgcagtggtgcaatctcggctcactgcaacctccgccaccccgccacaggctcaagcgattcccttgcctcagcctcccaagtagctgggattacaggtgtacaccaccacactgggctaatttctgtattcttagtagagtttcaccatcttggccaggctggtcttgaactcctagcctcaagtgatccacccgcctcctcccaaagtgctgagattacaggcttgagccaccgtgcctggcctatggcacacttttgtagaagtccagggtgcctgctgctctcagggctaggtcctgtgcccatcctgggagaatgggaaagcctctgtatgcattctgctctgcctgagccctccacagagccagaaccaggcctaggggttcaagggtaaacttctttgaggaactggaaactgagatgatgatgagattagggattggctatgaatacaaactgggtcatggtccagatacagaaacatcaaaatctgacctgtgggctctgtctgggaaaatttagggcaaattggcacttgtaggtggcaaggagtggcttgtttaccctgccctcctcactgtcccttgtttggaccaattctgccttcttaggaggacatgacaattcttcccccaggatcctaggatgcactgaagcctctagttttttcctgctggtgagtactaacatatgcccattaacttgaatgcttatctttcactggccaagaccaagctttgacaggtacccccagagcactttcataggcccgtgagtcaattctgaaccaagtcatgggggcagctgagtcagctcccctcaatcccggccttgatagctgggcacagttgtggcccggggtctgaatgctgcaaccacagtgcttaaggtctgggttgtggaagctggagaaccactgctgggcctgaaggctggaaacctcgctgttgcccttgcgaaataaggacatttccactttatcccctagggcagagcatttagtgagtcaaaaccttaactccacatccaacagactctgtttcagaacagtgtgtcagatgcttcagtatcagctgacatcctggacgtgtaaccacccctttctgctcatacttgggccttgtgtccaggtctgggtgactgtcctcaccattgagtttttgcttgaggccccgggctgtcttctggaaagtggctatcatgggttcctcagggttctacccaacctctctgtaaatgatcagacgccagtagctgctaaaggggaaaagtgtcccctctgccaatgcatctgagctctggtcttgtccaatggggatgactggtgccaggttgcctggagtcctgtgctgggagggacttcgccaggtggtcttccttgttctagatggttctggagattcaaatggcccagttgagaccagaggtgaagagagcaagacagtgccttcttgatttcattatttcacatgtcacttcataggggaatgactgctaaaatgaatacggtctgtgcattttttctaagtcacaattacagaagagatagaatgacaggagagttgtgaatcccatagtccccacacctaatttcaagaggggaggagttccattggagcagctttgggacgaaagagaagcagtcagggtcctcagggctcagggcaggaaagcaaagagtccaaggcacctgccaggactgaccccgcccaccgactcccataactacttgcagaatgtgagcttgctctgaaggcctggctctaccagagcttggaaagcatctgagaaatgtacccactccagatgttgatgccaatgaagtctacctctcctgagggaggctgcacttcaccaggagacaatgtctccccagtttctaagaatgaatcttccaaggtggaatttctgctatcagctagaggggggaatgtatttttacatgtaattcctccagtcattcctgataagaaagctttttttgttgttccatttttgcaaccttttggagtcatgtaaaacctcccacatcataacctgaaggtagtcctgagctgatgcaggctccctggccagttggggaggaaagggttcaggaaagagtggaacccagctggatcagatgggagaaattgaagcagtgttgttcacctggggtaatacttgaggtttgtggtctcatgccaaggaaatcaagaacatggacacacctggagtgagattaagagtggacgtttggccgggcgcggtggctcacgcctgtaatgctagcactttgggaggatgaggcaggtggatcaccaggtcaggagatagagaccatcctggctaatatggtgaaaccccgtctctaccaaaaatacaaaaaattagccgggcgtggtggtgggcgcctgtagtcccagctacttgggaggctgaggcaggagaatggcgtgaacccgggaggcagagcttgtagtgagccaagattgcaccactgcactccagcctgggcgacagagcgagactctgtctcagaaaaaaaaaaaaaaaagaaagagtggaggtttaataggcaaaagaaagagaaaaaagaataactctcctgcagagagagaggagtgcccaagtgggtcttccagcccacgccaaaatgcaccggattttatagactggcttgaggaggcagtgtctgatttacatagggcccacagattggttggaccacatgtgacatttacatagcacaggaggaagttggccaccccaccctaatcttattattatgcaaatgggttttctacttggtcagcaccatgttgtctgctccttactgtacatgtggttggcaaggaaaagggaagatggagccaccgtgttggacatgcctggctcccagatagccctttcccattggcacagctgccggcattcacccgtgcaagcttccagcttgcttatctatgtctgcagctcaattttacaggctgctttttgttagaaaagaaatgacttgggggctgcttttcattaaaaggaaaacctcagcgaggacttccttaccctcactatctgcctaaataatttctttttaacgcctatgttattatggcctgggtgcaggactggaatgggtccctggagagaggcaattggcattgtctgcaggggcatcactgatggtgggttcattaagagtttttaacatctaaggaggtacgtgctgaacgtggatgaggcctgagcagtgggaaacgaccaggagggcaaatcctgcacctacagctcagagagtctgggggaaggtgaggaccagctgggctaagcagaataacccaaaccctgctctcgcaggcagaaatcacttgaaaaccaggggagcagtacagcaacaaacaggagcaagggaagagagtgttccgggaataggggtcttggctgtcatggcaatcaaactgctagtgtttgaaagtctcaacttgaaagaaataaatgactctttagggtaccccccaccccctgcccaagatacagagaaacccagagccatgattagatgatagacagacagacctggatcagcttaccaatgcgagaacggaagacagggttaggtcatgaatggatataagatttttttacccagcaatcctggctgctggtaaactggtagggaggggaatcttttatcataatgcattgagcttatgctaggaatgggaacctttagtgtacctctcagaaggatttggaagtctaaagtctaggctgataaaatcatcatctctagaactcagcattcactccaaaatggcaccaggagtggccatctttatggccatatttgttgtctttccatacaatgaagggaattctactttattatatgcttttcttgagccagtgctcaaactgcctccgccctttcctggatcataggtgaggtcaatctatttcacagttcacactgttgtgaaaacactgagaaataggagcaaaagaaatctctatacattttctgttcattagtctgtgacactgggtacctaaatggaaactccaacacactctactcccagttcctcactgggaggctgaagggggcctgctggacaggttctgcctccttatggggcagggcctcggtttttgatggtcttactcctccatggagactaagaatgaaaagccagaaacacagaccaggacaatttagtaagttgtaatgatttgcaatttttgtcttgagaaaagcattatgttgagaaaagtttatgtcctttgaacttttgtttaaaaatagcaattagcattattaacatgctaaaaaataggtttaaatactatcaaattgcaattatattaatatcagtttcatactaatggcctaagacgaggagtgcttcttgaaacatttttaaaaaatgataaatagggagaacagagagcagatagcctgtagataatagatgttcttgaaagtgagcccaggacaaatggatcagtaaggtttaatggggctgcaaaaataaccaggcatgtatatcgaaagggctcagtgtgccaggcatgatgaatgaaaaggtactatatttgaaacctatcctggcaaaaataactaaatatagaactattgggataataggggaaatatcattggtttccacacactaatgaggaggcagaattctggctggacttagatttcagagttgtagaataaaatccccaaagacagtggaacaaagtttaaatcaattttgaaggtgagaagttatgataagttatatattatgttattaatttatgaaaacaatagaacacattctaagatatggtgaatcagaaaacataccatccatgtaattcttttcaaattacttaaagacacacttcagttgactgaaaggcagagcaaaaaggaagtatggagaagtcgtgtcaagaaaagaccagcagggaatcttaaacagtgaaaacagaaacacattaatactgttctcaaaaatacaggttatcacgtaacacacacttttaatttttgcttttgaattactttatatgacataggacatgacaaataatttacataatgtgaaactaacaaataatgacataatataattgaatagaataaacattatagagtaaaagcaaaaaaattaatactaattcatgtctgtatttcaagagagtgaaaagacaggaataagggagctgagaggtatcaaagtgataaacgcattgccttaagtatgtgacacattacagatattttatttttgactttgacattaaaaaaataagtcaaaatgcattgggaaaacttatgggtaaatattggaactaaaagccgttacgatgccttccaaaatagaaggcagaagaaaaaaaatagacaaaaataacattaaaacattaaaaagagaaatattaaaatatgacagaaataagaccacctatataacttttttttttttttttgaaacagagtcttactctgttgcccaggctggagtgcagtggtgggatctcggctcactgcaacctccacctcccgggttcaagcgattctcctgcctcagcctcttgagtagctgggactacaggcgcccgccaccacgcctggctaatttttgtatttttagtagagacggggtttcaccacgttggtcaggctggtctcgatctcttgacctcgcgatccactcgcctcagcctcccaaagtgctgggattacaggcctgagccactgcgcctggcagaccacctatattacttttaaccacaaatgaaatagatgacttcttagaaaaacataaaagcagagctgtctcaaaaaccaacagaatatcttcatagcctgaaaaccgtaaagaaagcagataatgtggttaccactgtctctccagtgaactctgggtcacacacttttggttaatttaaaacactataaattattccagaatatattaaaaggtagaaaattttacaagttattttaccgaggtaggataaccgtaaatctgactatgacagtgtgtaaaaactatagagcaatctcatttataaatacaaatgtaaaatcctctgcaatggtatattaaataccctctgcaatggtacattaaataccctctgcaatggtatattaaatctataacaaacaaaaataaactccacagaaatttagaaatcaacttagtttgtttttcatagtgatctgagtgttaaaattctgttaacttttattgttgtacctggggattgagcaagtgagtaaataatactgttggagaagggagacaccaatacagaaccgaggaagacaaggaagaagcctgtggggtaggatgggatgggatgggaattagaggtgtatcatacatataaatcatgtatcaaggaaaatttcctgccctgggattagggggaactagcaacatgtgcttgactggatttcagaattgctataaatgagtgactgctgcttcctttttccccgtttgaatggaagtgtctatagtagttgttcagtccctgtttcatcactgactgttggcagcagggaagaaacaatttttcagctcacaggcctctagttcaagaggaggtgcacccaaggagctgcacccaataaaccatacctgaggagcctatttcttttgttttctttcctttttttttttttttttttgaggcagggtctctgttgtccaggctggagtgcagtggtgcattcttggctcactgcgacctctgcctcccaggctcatccttccacctcagcctcctgagtagctgggactacaggtgtgtgccaccttgcccagctaattaaaaagatttttttttttttttttttgtagagatgaggttttgccatgttacccaggctggtcttcaactcctggactcaagcgatccacctgcctcggcctcctaaagtgctgggatttcaggtgtgagccactgtgcccagcccgaagaagctttatctgatctgaacctgatttagataaggaggtcctggactttgttccaatgctgcagagagtgagacttct

SEQ ID NO: 22 - DNA, 1841 bp, Homo sapiens
tgtggttctggaagatgaggcgcatgtcttgtacaaacccctccacttgggggtaaccgtgctcattcagccttttcttgattttatccaaccacatgggctccttcaggccttgacacgcctctctaatctggtgacaaatataccaatggaaaagctaccagcatagttcagtgtctaccttctgtggattcccataaaatccagcagaaatacaacaaggtgaaggcaactaacgacagcgtgtgctcttgccccgtgggattaagatcacaaatctcacgagggcccatttcagggtcaggtaatgtcatggcagcctgtaatcatgggttgctgttgttacttacataataatagtatggaatcttggcaaaaaaggagctctcagaacagcaatagactttcaagaggaggaactcacatttctgcaaaagaaagaggccgtaaatgaaaagcagcttggagagaatgagcccacatgcatgagacacagcacagaactcacacccttcttcctcaagtttctctaacatgtgtggctcttggaaacagacatgtcatggctgagttattttttgtgcaaacaaggtgtggtgttctatcagtgccattgaagtgtggcgcggaagagcaggctcctttcagtacattcccctgcccttgcgcttgttcatggttctcacgtgtgaggggaaaggagaaggcttggggtttgcatctgatttaccaactgttcctcaggacacatctgcctctccaggacctcagattcctgacaacactgttggcttcccggagactccttcatcctgcagaagatgcaattccacggggtcctgagagattggacatgggtgagcagagggcagggagcttggaaatggccaccgttcctgtggctaccactgtcttccttcaggaatggctgatgggctcagtcatgggagggaggggaacacctcccaaagtatgcaagattcacacatggggtctccagccattggcctttccctcgcatcagtggtagcagcaggcaggaagtctgaggaaggtggtgtcaccgtgagtgtggactctcctttctctgtctgagctgctgggagcacagggaaccctgtctgtcaggcctgagtttcagaaactgggttttcagccccagggacctcgggcctccaacagcccaatgagatcgtgcttcctgtcttgtatgaataagcacaaaatataaacaactggtgtttcttgtctccaacccacccagctgcaaaacttcaaggaaaggacaatgccggtatgtaggcaaaggtccccaacactgccctcagcatatcagaggaggtgtccctgagagcacagaggacattaacctcctgctgccagcgtctcccactgctctctggatcacactgctgggtcccagtacccgatgaacctgctctttccccatctagacacaagccggcactctgctggagagtgcgcatggcaggtggaagatcccttaaaggacaaaaagagagacgcctgcatgtcacttacctctcagcttccacaggcgggatgtgacagtcctcatggaagactcttgaacaagtgtcgcaacagaacagctcccctccgtcccggcacacctcacactcatccaggtttctcatctagaagataaaacagtgtccacgtcactgggaaccgcaagattcaggaaggccaaccctctgggcaactagaacacactgcctttgtgtgaacctgcatggacaggcaaatgcttctccctgggatatgaaggaaaaacatggcatggagatttcagaacaaatcctggtctgcagtgaagt

SEQ ID NO: 23 - DNA, 434 bp, Homo sapiens
tgtggttctggaagatgaggcgcatgtcttgtacaaacccctccacttgggggtaaccgtgctcattcagccttttcttgattttatccaaccacatgggctccttcaggccttgacacgcctctctaatctggtgacaaatataccaatggaaaagctaccagcatagttcagtgtctaccttctgtggattcccataaaatccagcagaaatacaacaaggtgaaggcaactaatgacagcgtgtgctcttgccccgtgggattaagatcacaaatctcacgagggcccatttcagggtcaggtaatgtcatggcagcctgtaatcatgggttgctgttgttacttacataataatagtatggaatcttggcaaaaaaggagctctcagaacagcaatagactttcaagaggaggaactcacatttctgcaa

SEQ ID NO: 24 - DNA, 514 bp, Homo sapiens
caggtgcgccagaactaccaccaggactcagaggcggccatcaaccgccagatcaacctggagctctacgcctcctacgtttacctgtccatgtcttactactttgaccacgatgatgtggctttgaagaactttgccaaatactttcttcaccaatctcatgaggagagggaacatgctgaggaactgatgaagctgcagaaccaatgaggtggccgaatcttccttcaggatatcaagaaaccagactgtgatgactgggagcgggctgaatgagatggagtgtgcattacatttggaaaaaaatgtgaatcagtcaccactggaactgcacaaactggccactgacaaaaatgacccccatttgtgtgacttcattgagacacattacctgaatgagcaggtgaaagccatcaaagaattgggtgaccacgtgaccaacttgcacaagatgggagcgcccgaatctggcttggcggaatatctcttcgacaagcacaccccggggagacag

SEQ ID NO: 25 - DNA, 305 bp, Homo sapiens
agtaccaaccagtcacctctgtggccaattccaatgccttcccttcaagttcaactggccttagcagggaactgatcactctacagcccctcatgcagttaccagagagaattgccagaattctgacaaagcaggagcagatttaccaaagggtcttgctagttgactacctttgctttttaacctgggacttgggcacttctgaattccagaggtccctgctctgactcatttcagcatcaatttttacttcccagaacaaagagcacaatgcccttgaagatcttgtgataagatttaatcag

SEQ ID NO: 26 - DNA, 722 bp, Homo sapiens
atgaaggacactgatatcaagagactattgtataatcatcttttatgcatgttttcaattagcctgatcatcttcattccatcattctttttggagaacttctcaatattggaagcacacttaatacggttgtgcatctgttgtgtttttctaactgctgtcaatcaagtattatatttagtagtgaagccaaatgcatcctctaaaagaagtttattatcacacaaggtgaccggatttttggaatgctgtattaatttcttatgccttgtttcttgcatgtaattcatgtaatttttgttctatatggagagccaccattagagttgaagatggaaacatttttatttgtggttattttgtctgcttttactactctaccaagtttatttttgttaggaccaaatctcaaagcatggataagagttttcactggaaagggagttatattcacttgggagaatagtatccagatcagtacaatttctagttttgtgggaacatgtcttggagtactttctataccactggattgaaaaagaccatggcagataaggaaactaacacctagaggatatgtaacattctcgatgtcagtgagctcgtacatatggcccatctcctcctatatgcttggagcaaactttggcaacatggctggccttgttatttcaccactctggatacactggaataaaaagcaacttacatataacaattaa

SEQ ID NO: 27 - DNA, 16317 bp, Homo sapiens
tgactgaaaaggcagagtgtcatttgaggatgcgagtagtataatcatacttttttgcatggaagaaagcaagtgagtactttaaactgtggaattgggatagcaggggtggggcctatgatatgaatattcatacttttcatttacatttttatttttattgcagtaaaatctagaaaatgttgagaggatttttaaaaatttaaattacattcaattcccatacatctttctctagaaaggttctaaaggaaaagaaaaaaatagctacatagagaagtaaggtatgatgaactatcttgaagactgagggttttctactgttaataagtaagttttcaaattatagattgaatatctactttgagccaggctgaggactagggagacaattgtgagaaaaacattacacaatttctacccctttggatcttactgtctataataaagggaaatagacaaataatagtcataaagcatgatagacgctttgatgggggaatttcaggatataaggggcaaatttctgccctctgtgggggtaattaccaagtctaggaaaactgaaaattttcccagagaagacgacgttcaaactataatctgacgtaaggttggaaagccaggaaaaggaatatgaaatgaagggagaaagttccaaagaacgggaacaacatgtgcaaaggtcctgttgtgggtgagaataaagcaatttggaggaattaaaagccagtggagtatagaattctagagagatatggattgagcattcctaacctgaaatctgaaatgctccaaaatctgaaaaaaaaaagtattttcttattcttttttgtcttcttattaagagatggggtttcaccatgttgctcaggctggtctcaaactcctgagctcaagtgatcttctcacctcggcctcccaaagtgctgggataacaggcatgtgtgagccactgcacccagcccaaaatttgaattttttttttttttttttttggagacagagtctcactctgtcacccaggctggagtgcagtggcaccatctcggctcactgcaacctctgctgcaggttcaagcaattctcctgtctcagcctcctgagtagctgggattacaggcatctgccaccatgtccaactaatttttgtatttttagtagaggcgaggtttcaccatgttggccaggctggtctcaagctcctgacctcaagtgatctgcctcccttggcctaccaaaatgctgagattacaggtgtgagccaccatgcccagcccccaaaatttgaaaacttgagtggtgacgtgatgccacaagtggagaactctgcacttgacttcatgtgatggattgcagacaaaacatgggtagaaactgaaagcctgccattgtttgttattgttgttgtttaacagctaatataggtattctggggatgatactgccctatttaggtaccctgaacacattattttttcactgtattaagggtatgccatactttttactgttaagtacttaagtgtgaatggtataagaaaaaaattgcttatgggtagcatatatattcagagacaggaatgatgatgatgccagacaatcacagattgtccatatcagtagctcacatggtgacacctctgctttctgatggttcaatgtatacaaactttgtttcatgcataaaattaaaaatttgtattaggtcggtgcaaaagtaattgaggttttgcctttaaaagcaatggcaaaaacttcaattacttttgcatcgacctagtataaaattatcttcaggcagggagtgatagctcacacctgtaattccagcagtttgaaaggccaaggcaggcagatcacctgaggtcaggacttcgagacaaccctggccagtatggtgaaaccttgtctctgctaaaaatacaaaaaattagccaggcatggtggtgggcgcctgtaatcccagctatttgggaggctgaggtaggagaatcgcttgaacccaggagatggaagttgcagtgagctaagattgcaccattgcactccagcctgagcaacaagagtgaaactccatctgaaaaaaaaaaaattagctgggcgtggtggcatacacttgtgagctcagctacacgggagctgaggcaggataattgcttgaacccaggaggtgaaggttgcagtgagctgagattgctccactgtactccagcctgggcgacagagggagactccgtctcaatcaatcaatcaatcaatcagtcaatacaattatcttcagcttaggtgtataaggtgtgtttaaaggctgggcgcagtggctcatgcctgtaatcccagcactttgggaggccaagacaggtggatcacaaggtcagcagatcaagaccatcctggctaacatggtgaaaccccgtctctactaaaaataccaaaaaaaaattagccaacatggtggcacgcacctgtagtcccagctactcgagaggctgaggcaggagaatcgcttgaacctggaaggcggaggttgcagtgagccaagatcacgccactgcactccatcctgggcgacagagtgagactctgtctaagaaataaataagtaaataaataaaaataagatttgtataaaacaaatgacttttgtgtttatacttgggtctcattcctaaggtatctcattctgtatactcaaatattccaaaatccaaaaatgtccaaaatctgaaaaacttgtggtcccaaacatttcagatgagagatactcaacatgtagtagtgagaaaagaagctaggaaggtggacagacaccagttccaagagggccgctcaaactgtaataaggaaattgaactttattctgagggaatgagaagtcacagtaacatttatgcagaggacggaagtgatgctacttaaactgtagaaagatcaacctaactgcagtttggagaatggtttagaagggaggaaaagtgaaggtggagaacccagtaaggagacaaaaccaattagccttcctaggtaaccactttggaatgaaaagttgaatgaaaagttgagttttgttttcttatgcagtgtacaatttttgtcttttgtcttgccttgaagcagttttagtgtgatatgtctagatgtggctttctttatatttatcttaatggagtttgtagaatttgttgaatatgtgttttgaggtctttcattagcttggaaaattcttggtcattatttcttcatctattgcttttgtttcattgtcgctctcttctccttctgggacattaattacataaatgtgagaccttttcaccaaatcacatttgtctcctatgtttgtttttttattttataatttttttttgagacagggtttcacactgttgcccaggctggagtgcagtggtgtgatcctagttctctgcagcctcaatctcctgggctcaaacaatcctgtcacctcagcctcccaagtagttgggaatagagacatgagctacctgcctggctaatttgtaaaattttttttgtagagacagggtctcactatgttgtccaggctggtcccaaatctcctgggctcaagtgatcctcctgccttggcctcctaaagtgttatattcttctgtctcttcatgctaatctcaatatgttcttctgcctctcttctcattcacagattctccctcagctatatctaatcttctgttttttttttgtttttgtttttgtttttgtttttgagatggagtcttgccctgtcacccaggctggagtgcaatggcgtgatcttggctcactgcaacctccgcctcctgggttcatgccattctcctgcctcagcctcccgagtagctggggctacaggtgcctgccaccacacctggctaattttttgtatttttagtagagacggggtttcaccgtgttagccaggatggtcttgatctcctaacctcatgatccgcccgccttggcctcccaaagtgctggaattacagatgtgagccaccgcgcctggcctaatctgctgttaagtctacttattgtgttcttaattttagttattgtatatatttctataaattcacttcaattttttatgagttccacatctgtgctgaaactatcttgtcatttaatttctcgaacatattaatcacaactgttttatagtttgtgtctgataacttccatacctggatctcttgtgggtctgtttctattgtctgattttttctcttgattatcagtcacttcttatatttttatcagcatagttttttgaaatggaaaattgtgttttaaaaactatagagatgacctgaggttctagttgatatgttatttaagggaggattcactttagtttcaacaagcggttgggaatacatataataagcaacttaagtcctgctgtgcctcctcactggccacgctccttccaggcaccagcttctctgagccaccaacctgcggctgccctggcccacctgcgcctctggcagcaccatgacagatcaggtctttgtgacactgaccacaaatgatgcctacaccaaaggtgccctggtcctgggctcatctctgaaacagcacaggaccaccagaagactagtcatgctcgccaccccgcaggtctcagactccatgagaaaagttttagagacagtctttgatgaaatcatcgtggtagatgtcttggacagtggtgattctgctcatctaaccttaatgaagaggccagagttgggtgtcaggctgacaaagctccactgctggtcacttacatagtattcaaaatgtgtattcatgggtgcagatactctggtcctagcaaatattgatgatctttttgagacagaagaattgtcagcagcacctgacccagggtggcctgactgcttcaattctgaatttatcagccttcagttgaaacatataatcagctgttgcatcttgcttctgagcaaggtagttttgatggtggagaacaaggcatacggaacacattttttcgcagctgggcaacaacagatatcagaaaacacctgccatttatttatagcctaagctgcatctctatatagtcctacctcccagcatttaaagtgtttggtgcaagtgccaaagttgtgcatttcctgggacaagtcaaaccatggaattatacttatgatcccaaaacaaaaagtgtcaaaaatgagtcccaccatcccaacgtgactcatccagagtttctcatcctatggtggaacatctttaccaccaccgttttacctctgcttcaacaatttggccttgtcaaagacaccttctcatacgtaaatgtggaaaatgtctcaggagccatatcacatctgtcccttggggggatcccagctatggcacagtctgtgtatcctcagaagaatggaaggagcggtgggaacagggctagaccgattatatgggagcagattcctttgacaacatcaagaggaagcttgacacttacctccagtagaaacactgcattttcctgtggacacatccacttcacaagccttgtttctgatacttagtatctagagctgggttgagaaaagtctgttatggttgctagagattttcacaaaaacttatcagatgagaggtttttgtaggacaacaggtgagaactgggcaaaagttgtgaagcagcaattccgttgttacatggacagtgttttgctttttaatcctgtttagcttgtttcagaaattctcacttttgttgactgccaacatacaaagtaggggaaactcaatattaagctgttaagatggctgcatcaattcttaaaatctgcagagcctggttccaaatcagtcactcccttcagaagcagacatggcatctgatccttgcttgcttgctggttgtacctacctttcactagacctgcattttggaattgcccagtgctgccagagtgagtgattgtaattctgttttcaggtaaagatagcttatattaacactgctgagtgattcataaacgtatcaacaaatagcattaacccattttatttcctggtcttagtgtctgaagatgttcaccagttttctatgtacagtaaggcagcatgctaaaatgcttttgttcagtctgtatatttgaaaatagcaaggtgttctctgatggttacctgcagtggaaccctgtatgaaaaataaagacttactgccataaaaaataaaaaataagcaaactttgggaggccaaggtgggtggatcacaaggtcaggagttcgagaccagcctggcaaatatggtaacaccctgtctctaatacaaaaatcagccgggcgtggtggcgcacgcctgtattcccagctactcggaatctgggaggcagaggttgcagtgagctgacatcgtgccactgcactccagcttgggcaacacataagactccgcctcaaaaaaaaaaaaaaaaaaagcaacttaattcaatcagggattaggagggtttctgtgggtttctggacctcagtctttgtgagggctagtctatttttggcccatcttacttgtaggattctttagggttcccaactggtttagttgttcattgctgtatctcaaaccacttcaatatttgtggcttaaaacaatagtgatttctggcaattatctgggtcgactgaacagttcttcatttggtattggctgggatcattcgtaaagctgcattcagctgggcacttggctggggcattttagtaagttttcacatggcatctctatacaatattccatccccgagggcctctccacatggcctatttctccactgggataaccttgacttaagcatggaggctagattctaacagggagaaatccaaaagtacaagtcccagtgagcaagttcatatttaatctttgtttgtttcacctttactaatgtactattgataaaaacaaatcacataagccagatgcagtggtgtacacctgtactctcacctactcaggaggctgagacaggagggttgcttgaggccaggagattgaggagggagtgtgctatgatcacacctgtgaatactgcactccagcctgggcaatgtagccagacccccatctctcaagacacaaacaaaagaaaacaaattatatggctaagcccgaaaccaatgtgaagaggaccacccataggcataaatcctggaaggtttggttcactagcagccagctatgtaacatattaccatatcaaatgaaatcctatggtgcttaccagagtacctcctctttaatggctcctgatctccaattcttgtcatctcagccctgtaagctctcttcagcttttgggcttctcagttgctgattaggaatcagcaaaaacattaaaggaaaagcaataccaaatgatgggttcacctctctgtacttcctttctctttgggattggtcctttgagttcacgttttcttagaaactttccagtgccttcaaactggtatttcctgtattcttcccagcttttctagttgttctcagtaggagggatggtcttaagcaagctgatctgtattgctggctcacagtggccaggggagtagaaagagctcaaagagaagtgactggttgggtcccaggacttctagtctcagaaaatccctcagtctctagcagggcagggcagaggagccccagaaccacctttcctcaaagtactttagcctatgcaagcttagactgttgtcctttcactgttaaccagtattaaccagttaaccagttcttctgcagacaaaagcatcaggaagtacccaccatgtaccagtgggcccttcttgatgctcttgattgcagaggagccctgcaacctgaataaatcctcctggaaggtaagtgggggagccctaattaaaactgtaattcaatgtctcgatattttggcaaatgaaggttcaggtgagttttaattagtttcagaaaaagcaaagtaaaatgatatttaatgtactggattttgatggatacaaatctatatccattatatactatatgtttgttttttctaaaaaaaaaaaaaaaaaaaaaaaaggcaaccagaaaattgtcatcaatgttcataccttgaatactctaattgagtattgactttttttggtaacagctttcttgagatgtataatttacataccatacaatttacccatttaaaatgtacgattctagttttcaatgcattcacagatatgtgcaactatcactgttggcaatttcagaacattttcatcacctaaaaggaaactctgtagcctttagctatcactctcccatttccctgtttcccccaacgcccccagagataagcaaccactaatctacttttggtctctatagatttgcctactctagaaaattcatataaatggaatcttatgtgatcttttgagtctgcttctttcacttagcatacctttacaagatttattcatgttgtagcatgcattagtacatcattccattttatggctgaatagtattccattatatggatattttgtttatctattcatgatggacatttgagttgtttccaacttttgggtattatgaatgatgctataaacatttaagtaaaagtttttgtgtagatatatgttttcatttctcttggacataaacctaggacttggattgcgggtcaaatgttaattctatatttaattttttgaggaactgccaaattgttttccaattttatattcccaccagctgtgtatgagggttttgatttctacacatcttctctaatacttagtaataagtattaagtatctgactttttttttttttgagatggagttttgctcttgttgcccaggctggagtgcaatggtgtgatcttggctcactgtgacctctgcctccagggttcaagtgattctcctgctttagcctcctgagtagctgggattacaggtgcctgccaccacgcctggctaattttgtatttttagtagaggtggggtttctccatattgttcaggctggtctcgaactcccaacttcaggtcatccgcccgcctcagcctcccaaaatactaggattacaggtgtgagccactgtgcccggtgtttgtattttttttttttttttttagtagaggcggggtttcaccgtgttggtcaggctggtctcgaactcctgacctcaagtgatttaccctccttggcctcccaaagtgctgggattacaggcatgagccaccacacccggtcaagtcttgtccttcttcaggacatttgtttctaaatattttaccttttggtgctattataaatggaattgttctcttaatttcacttttgaattgttcattgcaagtgtataaacatacaattgaattttatgtattgattttgtaacctgcaaccttgctgaatttgtttattatttataatagtttttgtgaattccttaggatttttaatacgcaagatcatgttgttatcttgtatattaatgatatataagataatatatctttccaatctggttgtcttttatttatttttcttgcctaattgccctgactagaacctccagtagagtgtagaatggaggtggtaagagcagccatccatgtcttgctactgatcttatggggaaaatacccggtctttcaccattgagaatgatgttagctgtgggtttttcatggatgcctgtatcaagttgagagaggtctcttttgttctttttttccttattattatttttttatcatgaaaggtattggatctttgtctccaaatgctttttcttcatctattgagataatcatgtcattaaaagaattctgttgatatgatgtgttgcattaattgattttcagatattaaaccaaccttgcattcctggagtaaatcccacttggtcgaggtgtataattcattatatatggtactgggattcagcttgctaatgttttcttttaaagcatagtggccaggcacggtggctcacgcctgtaatcccagcactttggtaggccgaggcgggcggattatgaggtcaggagatcaagaccatcctggctaacatggtgaaaccccatctctactaaaaatacaaaaaattagccaggcatggtggcaggcgcctgtagtcccagctactcaggaggctgaggtaggagaatggcgtgaacccgggaggcagaggttgcagtgcgctgagactacgccactgcactccagcctgggcggcagagtgagactctgtcttaaaataaaaaaacagaaaaacgataatattggggaaagagagcaattagttttatttttttaattttttattatttacttcattttatcatttttttttgagatggagtctcgctctgttgccaggctggagtgcagtggcatgatctttgctcactgcaacctccgcctcctgggttcaagtgattctcatgcctcagcctcccaagtagctgggattataggcacgtgccaccccaaccacctaatttttgtatttttagtagagatgaggttttaccatgtttgccaggatggtctcgatctcctggcctcatgatctgcccaccttggcctcccaaagtgctgggattacgggcatgagccaccgcacccaacctattttttttttttttttttgagatggagtctcattcactgtcgcccaggctggaatgcagtgttgtgatctcggctcactgcaacctccacctcctgggttcaagtgattcccctgcctcagcctcccaagcagctgggattacaggtgcatgccaccatgcctggctaatttttgtattttttgtagagacagggtttctccatgttggccaggctggtctcgaacttctgacctcaagtgatctgtccccgctccttggcctcccaaggtgctgggattacaggtgtgagccaccgtgtctggccaagagcaattacttttataggaatctaggttctgagtctgtgctgggaaaaaaaaaaaagtcagtatggtcaatggagaaagcttgaagaaaaataattcttaagtttccctgtcccttagtaaagacagtatattcctcaatggagagtcatttgaaatttaatgtggtattgtccttcacttaagaaataatgtgattgataatctgactgatctaatgacaacccaacattagcttttagctatttttccagcagcagcagcaatgagttgttctcagcccccatcactaaggcagacctatttcctgggcactgcaaattggttccactgcctccactttggaatacattttacttatagtagttgagctggattcatacctgatagtccatagcattaaaaaatgcatgatattggattgtcaaatagagaggagacatgggagttaagaccaaggttttgactaccaaacccaggacttttccttgattcattaggcaataggcaaccattaaatgttttgagtcagggaataccatgattgaagctgtactttaagaagattaaactggcattagtgcattggatataaaagatcaaataaacagctgggtgatgagaatgaaaagcagcttgcagaagtaaggtaaattctgcaggagctggtaattagatttgatgatcaagggaaagggaagactactagattttaagactgggtaattgaaacaatactggtggtattttctgaagtcagagttcgactagaaggaaaggtgatggctttggccttagatgagttgagatttaactaggaaagtttgcctgcagacttccacaatcatatcccatgcaaacaattggaaacaaaacagccaaagctaataagcatttacaaggaaaggacactggggctatttaatttagaaagtgaaaaaaatttagcaaaaaaagagaaaggtgaaaggatctatttatttctctgatgacctagttcctagcctttaactcagcatactgacctacccgtgacactatatgccaggtgaagcaagcaaagcttgttttgggagaagtgccccaagcacacactgtcctttttgagatggagtttcactcttgtcacccaggctggaatgcaatggtgcgatcttggctcactgcaacctctgcctcccaggttcaagcgattctcctgtctcagcctcccaagtagctgggattaaaggcgcctgccaccatgcctgcctggatcattttgtatttttagtagagataagggttcaccatgttggccacgctggccttgaactcttgacctcaggtgatccacccgccttggtctccaaagtgctgggattacaggcgtgagccaccaggcgcccagcccacaccatccatttttaccccattgatcctcattttcatctccctgctcctggatagctggttccatattccagctttccatattgcttttgatctgcattgtggtctcttctggctattggatacctctttccatgggctcttagaatgctcagatttcagcaattgcatagtttctagcagaagacttcctctgccagtccagcccctcaaaaccctcctgctcagattggccccagaatctctgccaggagatggagattggggcagtttatcttaatttgattagcaggtttagcttctgcaaagcacattcttacaaggaatatttgagaatatgtagtcataatgtaacagcttgcagttctctttcttattctataactgattgaaaattctaataagaaatatgtgtaccttgatggcaatgttgaaactcagttgtttagaaagatggactcccctatatttagctgaaaaatcagggtttgaggcttttagttccctctgaaaccatgaggacttagcccttgagatccagtttaattctaacatgatttagaagtctgtttcatttccctgatgttgagtcaccaggctggattaattttccagggtgttgtgctaattataggttagtggaggaatgggctaaaccaaaatggcaacaagcgaaaaagtagcaggttactctgagtgctgctggagtgtaaagctatttataacatcacaattgaatggctactattaattaataagcatcgcagtgaccttcaattttcaaagacgttcaccatcattttctagttaatctttcccatccattactgcattcgttttatatgaagggcagagctgatgaattacttgcctgaagtcatgtctgtggttaagccaaaattacactttaaacagatgaataataataaaaataatatatttgtggagtgtttttcaattttcaaaggatcttttccttcgttattttatgactctttattcttcatgcttactaagcatccctatgaaggttttctgctggttagctcaggatagcagaagagaggagggttcagtttatgggtatcttggttaaatttgaactgaataggaacataagaaacacaacattcaggagtttagaggtctgagttgtatgatctttgttcctcatcacctttttttgttaggttttcttggcctttgaggacccatagagcaaacattcagtcacattaagtctttgtttttcaaggctttgattttgttccattcaaacctaaaatgtatgaatccgcagaatttgatgtcaaaagaagcctcaatttaagaaagtttggttaatccaaagattacttacattagaatactggaatacaatctccaaatagcttagctgatcctggtgtctgctctgaaccttcatgctgtataccatttctgctccctttttctcactcaacacctgggcttttcttgacccttatagacccaggatgtccatacagtacagttgatcctcccagaaccttctatactcccacaagcaaagaaacacatagttgcatggatgcttaaaaggtcatagagtctaacattgtcatcttacaaataaaggaactgaggctcagggagtagaagtgacttttccaagtcttatagtaattgccagcgctggtgtaaaagctgtcagacttttgctcctgtagaaaaggaactgaaaggcatcagaaagtcaaactctcactgcagcaatatttaccgtagcacaactactgagttagccacatatatcatagagcagttcccaagatgttcacggatgttctttgacatagggttttgtggtcatattactttgtgtagttgggaattcatgatgcagagttgaagattggaaactctggaaagtctcttaggaaggattttgttaagcatttctcaaatcatttcttcgttattttcttcccaaagaaaatctagtaacagctcgtgtaattagtgttcattggtgatagtgacactttgatgaacaaatacatggtgtctgttaaagcagataccaagcagtcacaagcaggctgaactgttgagttctttgttgcaggttattttatcttcacaacatcttaggattaggtattactattcctactttacagatgggctttggacttgttgcatgtgacagaaattgagctcaaacttgcttcaaaggaaaggagtgttattagttcctggaactgagaagcttggaacattgaaaccaacaacgttctttctcctatctgtgcttctgtctttgtcaagtctattcatcccttttacagacagatgtcctcacaagaatgaggatatggctgtgcacagcttagattcactccgtaacactgcagctagagacgaaaggactactgccagccccacttaaccagatcctggagagggactctggccagcaaggccagcccctctgctgtctgtctctgtggaggaaaatgggtaccattgttaaccgaaaggggtcctgatccagactccaagagagggtttgagaacgaattcagggtgagtccatagagtaaagtgaaagcaagtttattagggaaataaagaaacaaaagaatggctattccataggcagagcatccctgagggctgctggttggctatttttactgttatttcttgattatatgctaaacaaggggtggattattcatgagtttcctggaaaagggaagaaccccagaactgagggttctactccctttcagaccatatagggtaacttccagatgttgccatggcatttgtaaactgtcatgatgctggcgtgtgtcttttagcatgctaatgcattataattagcatataatgagcaatgaggaattttgtcaccactttggttttggtggggtttagctgtcttcccctgccccccacccccccaatccagttttatccgcagggtctttgtgatctgtatcttgtgctgacctcttatcttatcttgtgacttaagaatgcctaacctccttggaatgcagcccagtaggtctcagccttattttacccagcccctattcaagatggagtcgctctggtttgaatgcttctgacgccgtgattggtttagactcaatctcacactctctttgtggcataggagatgtgttttcagaaatccagaaaggagcttagacaaaacagtagtctcagggaacatagctagttaagtgatggaactgagatttgaagtcagatctgtctgactccaaagtccatgttttttttgtttgttttctctgtggtttgttgtttctatgatgtggcttctgtcaccctgactctccttttgtcttttgtccctcaccaccttctgtagtttcccagtcctcctgactcataccagggaagcctcctgtgtccatatacaatgaaggctcagggacttctaactcctggtggactggctgattgagccctggaagtgtactttctccttcatttccctcctgactctcgctgggagagttgtagactcctgggaaacacaggtctatggcctgcctaagagaggaccagcccacaccaaagaaagtgccactgcctcctcctcctcagtggatgccaccaagccccgaggaggacaaccttttccttaatctccttgaaacccaggcaaactttgacaaaaggaaaggtgtttccagtgtgttgttaactgaaccttggttgcttggcagtatgcagttcttgtctaatttaccccaaggaaatgtctgtgtgatgtatttttaatttgctgaagaaggataagtgttcaaacctttgtacatttatgctgaaattaatttttcaaagtccacataacttcagtgctgtgggatagtccttaagaacagaaattatgaccaaccataataaatgacacatttttgtgaaatgtca

SEQ ID NO: 28 - DNA, 2048 bp, Homo sapiens
gctcccggaagcggcacgggaggcgaccgtgctcgccgttggcaggctagggttggcggcggcgtattctgtttgttttaaacgaaggagcggagggaggggccgcgccgcggagcgtgcctaaggtgaaagggctgccgtgcagccaggcagaggcgaggaaggcttctccatcgtcgccaccgcccgcctgtttcgccggcaacaggttcccccgggacgggaggggccgcagcgccgcgcagctcgcagcgctgaacgtcgcggaaatcccttggccggccgagcctccgcagccgcgacccggcttctctccgtccgagtcccccgagcctctccgaacccccgttggacttcccctccctggccggcgccgcccgacccgctcccccatcctagagggaattccctgcgccgcggctgtgaggcacctccaccccggcctgaaatgcaccgcagtcctgaaggaaatccaccctcatcccacgcagattcacccgcaacgctgcctgaatacgcctcgctgcccacagaaattcctgcccaaaccagacgcgtggaccacccaagacgaaattcacactcgaccctagccccgccagcccttgccgaaatcaccctaaacccgttgaaattaattcccagctgtccgaattttccttccaacattaactgactacctgtctccgccaagctgactgaactctaccgaactcttaccctgaaagcccctgagagtccaaaatatatttttccagcccgaaatctaaatcccagttctctgtatgaaaacctccagaaacccagactcttacttccttcggccacggactcgttcgaacatcgtggacatcaccttcccacatttttaccgcagtctttggctccgattctttgtccctgcctcttgggcagcatcctatccctgtttctttccacctttgaggattcctctacctctttaaaggcctgctttctttgctttctcttctcacctttggcattggcacactggggtcatatctttagttcccttgactccaccatctaagccaagggtgtccaatcttttggcttccctgggctacattggaaggagaaaaattgtcttggaccacatataaaatattctaacgctaatggtagctgatgaaacttttaaaaaatctcatcatgttttaagaagtttacgaatttgtgctgagccgcattcaaagccgtcctgggcctaagtccttgctatttttcctcttcaatttccttcaatccatagttctctaggttattttcccaccctttcccaagattcggatatcccttcattcttgctgagttcatctcctatgcctattcctacatacttgctgagttcatcttctaatgtcctcatcctggtttcttcctgaacctgaaatccagctaaccttactttttcatcccatcaaacccctgctgttgccagcccagcactcacgaagatctttacatacaccaaatattaaattagggccggtacctagacattgtctctgcactctgctggcatattttcccctggaccacgaacccttcgtacctagtaacttgccacctgtgtttataaataccagcaatttgatttacagggtgaatttgtcactattgtttacttttaaatgaagttactgtatttgttgtttccattaaaggcgacattataaagcctaggcctcatatccaaagcaaataaagtctcaattttttaattaaaagtaacaaaaggaaacctcacacttctgaacaacaatgacaagaaggaatgcctataattggtttgggtcacaatgtacatattgaaataaaatttttattaagtatcaacttccaggtacacaatgaagttttaaatgtttatctgtgacatatgaagaacaaagcaatctaaactgatgtaagcaggctgtcataaggtacatgctgaggaatttattcaacaaattgaataaatttattcaataaataaataattattcaataaataatatatttaataaatttaataaatagaa

SEQ ID NO: 29 - DNA, 1658 bp, Homo sapiens
acttgggaccccgtttccacccaggaccacaggctcaagatggcctggtagatgcagccggcacgcgcctctcctccgacgggaacagaaggagccggtaggttttcacacttgcagcagatccgctaagagaacgagggattcagccgagaagccactgggagcccgaggagtggagcagaggcacccaggcagcctgcgcggagaaatcggatcggctgggacggcctgcagcccccgcgcgcggggaaagggtgagtgagagaccccggggctccgcagtcccgctaccgacttccacagccccccgaccctcgcgggcctccagaatgggcagcggccgagagattccccagcggcgttgcaggagcccacgtggagcccacgggcttccctgccctgagcagctgcagctgcagcccccgccaccccgagagtccagccccgagggcagctcctgccttgcctgcggttaccgccgccgccagctgagggccaaggagggagaggggaggccaggcgctctcaggagtcccaaaggacaaataaccccgccgctgccgcgggacccagacgcgagccagctgctcgcccgccctgccccgcctgagctttccgccggcagcctggggcccagcccttccctgtctgtcacagccagagcccaaaccccgggggcctgaggacagtccgctggcggttccgtcccgcgaggactggagcacaggggcctggggattggtggctgcgggttttgtccgtcaccgttggcggctgaacactcctccccggggtctgaggtctggggcacagcctgccgataccaccacggacaggccaggggactcgcttgcccctcccacccatcaacacctgctgcccccgggcctgagattagccgcatgcccaggcagggactgtcactaccagcattcgagcagggcacctagacgcccacgaagagacccacaaatcgctcccctgaacccactaacgccagggccagtgtacactgctctggggctcaagaacaggcaagcacagtctccactaataaccacaccttaagtcacccaagtaatgtacagagcctacacttctacctcaaaccaaagccaagatcccctacttaaccacatcatatctacatcttcaggaagaagtcctcccctacaaagcgaattcacaaacggaagaagtgactgttccacaggatgcgcagatctcaacggaaggacccaggagacatgaaaaagcaaggaaatgtgacgccttcagaagaaaccagtaattctccagcaacagatccccatccaaaagaaattcaggaaagctcaaacagagaattgagcagagaattgaccggactgattgtaaagaaggtcatcaacatggaagagtcttttgaacaacaacataaagaaatgaggaaaagaggtggggagatatatgagatgattacctgccagaaagaggttttaaaattcaacagaagagtatttctggaactgaagaaatcattggatgaaatacaaagtacactcaaaagcttcaatgatagactagaacaaatagaagaaaaactctcagggcataaaatctgaagcatttttctcactttaaagattcatgggttgtactctggccattaatgtgaa

SEQ ID NO: 30 - DNA, 2640 bp, Homo sapiens
atgcagccggcacgcacctctcctctgacgggaaccgaaggagccggtaggttttcacacttgcagcagatccgctaagagaacgcgggattcagccgagaagccacggggagcccgaggagcggagcagaggcacccaggcagcctgcgcggagaaattggatcggcggggacggcctgcagctcccgcgcgcggggaaagggtgagtgagagaccccggggctatgcagttcccccagggacttccacagccccccgaccctcgcggacctccagaatagggggcagcgggcgagagattccccagcggcgttgcaggagcccacgtggagcccacgtggagcccacgggcttccttgccctgagcagctgcagctgcagcccctgccaccccgagagtccagccccgagggcagctcctgccttgcctgcggttaccgccgccgccagctgagggccagggagggagaggggaggccaggcgctctcaggagtcccaaaggacaaataatcccgccgctgccgcgggacccagacacgagccaactgcgcgcccgccctgccccgcctgagctttccgtccgccgcctggggcccagcccttccctgtctgtcacaaccagagcccaaaccccgggggcctgaggacagtccactggcggctccgtcccctgaggaccttgagcaggagggccaggggcctggggattggtggctgttctgccctttccgccaccgttggcggctgaacactcctccccggggtctggggtcagggacccagcctgtgggataccacccaactgcaactgtcctcatccacatcacactcactgctccagggcctgggatcaaccacgagcttagctggggcttgcagggaccagccccacagggtcggggggcttctccctgtgtgcggcgacgagagagtgtagaaataaagacacaagacaaagggataaaagaaaagacagctgggcccggggcaccactaccaccaatgcgcggagaccggcagtggccccgaatgtctggctgcgctgttatattttggatacaaagcaaaaggggcagggtaaagagtgtgagtcatctccaatgataggtaaggtcacgtgggtcacgtgtccactggacagggggcccttccctgcctggcagccaaggcagcgagagagagagacaaagagaaagacagcttacgccattatttttgcatatcagagacttttagtattttcactaatttactactgctatctagaaggcagagccaggtgtacaggatggaacatgaaggcggactacgagcgtgaccactgaagcacagcatcacagggagatggtgaggcctccagataactgcgggcaagcctgactaatgtcaggccctccaacaagaggtggaggagcagagtcttctctaaactcccccggggaaagggagactccctttcccggtctgctaagtagcctgtgtttttccttgacactgaggctaccactagactaccgtccgctcggcaaggggcgtcttcccagaagctggcgttaccgctagcccaaggagcccttctggtggccctgtctgggcataacagaaggctcgcactcttgtcttctggtcacacctcactatgtcccctcagctcctatctctgtatggcctggtttttcctaggttatgattttagagcaaggattattataatattgggataaattaattactaccaactaatgattaatgatattcatatataatcatctctaagatctatatctggtataactattcttgttttatattttattgtactggaacagctcgtgtcctcggtctcttgcctcggcgcctgggtagcttgccgcccacaggggctgccactaccaggattcgagcagagcacctagaggactccaaattgctcccctgaacccattaatgccagagccagcctacaccgctcctgggctcaaagactggcccaccttagcctcttagtccccagcaaccacaccctccactaataaccacaccctaagccacccaagaaatcatacagagcctacagtactaccccaatcaaagccaaagtgccccacctaaccaacaccctatctacatttttaggaagaagtcctcccctacaaagcaaattcacaaacttggaagaagcaatttacacaggatgtgcagatctcaatggaaggacacgggaaacgtgaaaaagcaaggaagtgggacgcctccaaaggaacccagtaattctccagcaacagatccccatccaaaagaaattcaagaaatgtcatatagagaattgtggaaactgattttaaccaagattagagggattcaagagacttctgaaaaagaaagtaaggaaatgtcaacagcaattctggatatggttgaggtatttaccaaccagatacagagttttccagagcacatggcaaatgtggaactgaagaaatcactggatgaaatacaaagtatactcgaaagcttcaatgatagactagatcaagcagaaaaaaaactctcaaaacttaaaatctgaaggcttttactcaattcaaatatttaatgggttgtactctggccattcaggtgaacaaaatctgctggg

SEQ ID NO: 31 - DNA, 2290 bp, Homo sapiens
agacacaatggtaagaatggtgcctgtcctgctgtctctgctgcaccttctgggtcctgctatcccccaggagacccaagatggtgagtagggaaagcaaaggatggatgctggagaggactggaaggaggtgaggaacaggacatatggctgggagaagggctggatgcagctgggattccctggtatacggcaggaacgggtgcccaaggctgtcaactccctcagctcacacacttccaggagcattcagggagcctctgccctcacccaaaataagaccttcaggaatctgaatctaaaaccccttagtttacgtgaaaacaaagactccaaagaccaagcgacctgcttggggtggagagccaggacggagcaggaaccacatgcctggagctgcttctgctcctgttccttccctccttccgatggctgggtacacctgcctgacgctgagggaaagagagagcagccccaaggggaaagtgggaagggaggtcggctggagggatggtgctagaaggaaacccgtgcccaaatcccacactcagacaccactgcagtgggtctggaaggctagtggcccgaaaagaagacagtgggagcttggggagatcaagagtcacttctaggataggggaaggaggctgtggcatgagaatgtgcaggataaagacatggaagcgaatggcttctcagttgtgtgagttaaaaatttatgacatttacaagttgtcagaataggtgtttcatgttagttttataataatcacatttacaatattaatcccattctgcaccaaaatcttaattattcggggttctccagagaaacaaaactaatatacattgtatacacatgcatatatgtatatatgaatatacactgtgtatatacactaattatatacgtgtgtgtgtatacaaaagagagaaagggaggagttttatttaatatttcttgtggctcatacaattctgagggctaaaagtcctaaatcagcaaagcaagccagcaggctggagacccaggaaagagttggtgttgcggtcctgagtccaagggtagtctggaagcaaaattctttcttctctgggggacctcagccttttctcttgatgccttccactgattagatgaggctcacccacactgtagagggtaatctgttttactcagggtctactgatttaaaagctaatcacattcagaaattcatgagcaagaatgacttcagtacttaaattagaaatctgccatatgacctccaacgttactaacactcgtgtaaattatattctaaattaactatggaactaattgtggaaatgtcccactctctcaacttccatcttgtaccaaactgcaaggtacaatgccaggaattccgagaggtctcctagccttaccctatgctgatccattctaggtcacttcttgagttttctagtaaatccacctccctacactttctaactatatgtatttgtccggttagactagaaatgtttatttctcatgttaagttcaatgcagattgggcaaggttcctctcctccacagggtgactcagggatccgggctgtttgcatcttgggactcttctgtttcatcctgtggtctccatagtcatcaacaaaagggataagagacagtaggggaaagccaggtggtagggtcttggaccagaagaaagacatcagtcacttccagtcacattcttgtttgacaaagctcagtcgtatggttccaatctatctataaggaggctgagaaatgttatcttcttctgtgccaagcagattaacttctgtagtgaagacacagaatggtctctgaaatatcatccccagcatgaaagtagagcctgtttccttgagtgaggctccaatggtgtgaagctgatggcagaggagagagctggggaggaagaggccagtggccaggcctcccctcctggccctctgcagccccacaatgggacacccttgcatggaccccagccctcagagtcttttcttttgcaggtcattactctctgacctatctctacactgggctgtccaggcctggcaaaggcacccacaggctgcagggtactgtcttcctcaatggccgtgccttcttccactacaacagtgaagacaggaagcctgagcccctgggaccatggagacacgtggaaggagtagaggactgggagaagcagagccaagttcagaaggccagggaggacatctttatggagaccctgaacaacatcatggagtattacaatgacagtaacgg

SEQ ID NO: 32 - DNA, 1628 bp, Homo sapiens
cagctcacctgggccggctctctgcccagcaacctcccagcagtcagggctcctagcagctgccccctgccctgcccactggggcccaggaaaagcagagagttgctgaaggtctcccggcagtagcggctgtcactgctacggggggtgatctaggtaggggtcctataggggtttctcagtgggatgtgggtagggttgggcaggagagccacgttgaaggtgacaacacccactttttactacccaggttcctgctgcacccaatgggcccggctggcccataccttagctgtttaagttcccctaatgtccctgaagatgatggggtggggggatctgacaacagacagaactgagttcaaatcccacccgcaactcttacctcctgggtgaccgatgacaagtcacttaagtgctgtgtctcagtttcctcatctgtaatggggatgagagtaacagggcccaccccacaggagtgaacgccacgaggcaggtggggaaggctgctctgaacgtgtctgtgactacagctccgtgagaaagttgggacccagaaggtgagtgaccgacccggggtccccgcgcctccgcctcctcacagccccctgcccccactcctggcagcggcggcggctgccaggggccgggcggggtgggggctggaagccgcagtgcggccccaggccggtgcgcggggggaggcctggcgcggcgcccgccacctgcccgggccccagcccgcgccgcccgcgcccccgggcctcccagccgcgcacttaccccgcgggcagggctcctggggcgccgccagccgaggtcatcgccgaggggcgcgggcggcgctgccccagccggacgccaatcgcggcccaggtgctgccgccgcaaccccgagccgggcgctgtgcggtcgcggacgcggcggccggggaggggcgcgccgggggcggggaaggcggcggggccgggccgagcctcggtctccccacccgcaccgtagggccatggccgcccgcggcgacccgcgctcccgcaccgccgggggttctgggcggcccccacccccgctccgacaggtgagagcccggcgccctctgcgcagacaccgcccgggccgggagctcgctccctcctcacacgtccccacctatttggcgctagaagttcttctccgggacctgaggtccactttactgtcacttctcctccccacagcttccgccccgaagcggcccccacctgagccgtcaccatcctcccgcattaatgggggcattcgtgcagacaaagacagcccccagagtcaggcctggattttaatcccaccatctcgcccactgagtgactgcaggagaccagaaggcggggaaaacacggtttagcactcactgctagctggcagttcacactgccttctcaaatgatccccataattgctattttacagatggggaaactgaggcatggggttcatttgattcacgcatggtcactcacctaataagtggcaagctaggactggaatccatccctcctgaatccaaagccaacactctggcccctttcccccttggccccctctcccctgcattcccagtgcctgtgtgggggtcacccacaacgct

SEQ ID NO: 33 - DNA, 10210 bp, Homo sapiens
attaaaagcaagtcccagccaggtgtggtggctcatgcctgtaatcccagcactttgggaggccgaggcaggcggatcacttgaggttagcagtttgagaccagcctgaccaacatagaaaaaccccatctctactaaaaatacaaaattagccaggcaacagggtgtggtggctcacacctgtaatcccaacactttgggaggccaaggcaggtggatcacaaggtcaggagttcaagaccagcctggccaagatggtgaaaacctgtctgtattaaaaatacaaaaattagccgggtatggtggtgggtgcctgtaatcccagctactctggaggctgaggcaggagaatcgctagaacccgggaggcagaggttgcagtgagccgagatcactctactgccctctggcctgggcaacagagtgagactccatctcaaaaaaaaaaattagccaggcgtagtggcgcatgcctgtaatcccagctactctagaggctaaggcaggagaatcacttgaacccaggaggtggaggttgcagtgagccaagatcacgccactgcactccagcctgggcaacagagcgagactctgtctccaaaaaaaaaaaaaaattattttcactttttctggccaggaaccttgctagatgcgataggtccagaaattaaaaactgtcctgctcttgagaaaacagcaggttaggccacgtgtggtggctcatgcctgaaattctagtgctttcggaggccgaggtgggaagattgcttgaggcaaggagttcgagatcagcctgggtaacagagtgagactttgtgtctaccaaaagtaaaaaaaattagccaggcatggtgatgcaaacttgtagtctcagctatttgggaggctgagatgggaggatcacttgaacccaggagttggaggctgcagtgaactacgatcacaccactgcactccaggctgggtgacagaataagacccagtctctaaaaacaaaacaaaacaaaaaaaaaaaaaaaagaaagagaagaaagaaaagaaatgagtgtagaaagggatcctttaagatgaaatcgatgcctcctcatggagttctaagccctcagaagtggaagtcaactggagtgtgcaattttctatctttcaactaacccaacagtttctacctcaccctcctgccttcctaggactctgtgcacacacccaccagagtgttatcacattgcaagacagaacccaattgtctcctttatctcctctaccagactttgtgctccatcagttgaagagtaggatgaagaaaaaaaaaaaaggttacatgaagatgatggaattataatcaggccttgaagaacggagacaattccagccattgttgtagatgtggaggctgaaggacattccaatttgaaggaacagagtaagtaaaggagggtggggccagatcaaagaagacatgcaggccaggcgcagtggctcctgtctgtaatcccagcactttgggaggccaaggcaggcgggcggatcacttgaggttagcagtttgagaccagcctgggcaacatggagaaaccctgtctctactaaaaatacaaaaattagccgggtgtggtggctcacacctgtagtcccagcactttgggaggctgaggcgtgtggatcacaaggtcaggagatcgagaccctcctggccaaaatggtgaaaccccgtctctactaaaaatacaaaaattagctgggtgcagtggcaggcgcctgtaatcccagctactaaggaggctgaggcaggagaatcccttgaacaggggagtcgcaggttgcattgagctgagattgcgccactgcactccagcctcagatagagcgagactttgtctcaaaaaataagtaaatagataaataaataagtaaataaataaataaataaatgggttgttgaatttgagatctttcttctttttcactgtaggcatttacaactataaatatccttcaaaatattgctttagctaaatcctttaagtttttggtatatcattcagtttcatttatctccaagtagtttctaatttctcttgtgatttctttttctttctttttttttttttggagatggagtctcactctgtcacccacccaggctggagtgcagtggcacgatccctgctcgctgcaacgtctgcctcctgggttagagcgattctcctgtctcaccctcccaagtagctggggttacaggcatgcaccaccacgcccagctaattttgtatattcagtagagacggggtttcaccatgttagccaggctgattttgaactcctgacctcaggtgatccacccaccttggtctcccaaagtgctgggattacaaacgtgagccaccatgtccagccgtgatttcttctttgacctatgagttatttaggactgcgtttaatttccacatagttttaaatttctcaaatttctattattgatttattttatatttcattttattttattctgagacagagtctcgctctgtcacccaggctggagtgctgtggcacaatctcagttcactgaggttcactgcaacctctgcctcccaggttcaagcgattcttgtgcctcagcctcccaagtagttgggattacaggcgtatgccaccttacctggctaattttttgtatttttagtagagacaaggtttcatcactttggccaggctagccttgaactcctggcctcaagtgatcctcctgcctcggtctcccaaaattttgtgattacaggtgtgagccactgtgcctgggctctattattgatttctaattttgttttattatggttagagaatgtactgtgtatgatttcaatctttttaaatatattgagacttattttatggcctaacatatagttcattctggagagtgtccttgtggacttgagaagaatatagattatgcagttggcgggttgaatattttatagatacctgttaggtctgatcagtttatactgttgttcaagtcttctatttccttgttgatcttctgcctaatgacttctccattatttaaatggggtatggaagtctcctattattattactgacttgggctctgacattcagagtctaaaaatgattagccagcctaatgaaatccccactgcttaggagggtaacagtgagagagaaaaggatgccatgcaggaggctatgcgggccatgaaagatgaaagagacagtggccagttcccagccaacctcaaattcttagattttcagttccagcccacctatgtccttatggtatgtccaagcccttttttccccctaaaatttgcagttagttcttgtttcttgcaaatgaaataccaaactactctaacaagcacagaattctattccaggagcggggttgcaagcaacagaatctccaaagaggcatggaatcttcatagtaacacaggagagagagtcagagatgatttccatgtccctgaatgggaggttagaagtccatggattgataaaacagttcgtaaagtcttagtattcagatactatgtcctttgaaagtaaagttttgggctgggcgcagtggctcacgcctgtaatcccagcactttgggaaataaggacaggcgtgatggctcaggcctgtaatcccagcacttagggaggctgagtggtgaggattgcttgaggccaggagcttgagatcaggctggacaacatagtgagactctataactacagttttttttttttcaattagctgggcgtagtggcactctgtggtcccagctactcaagaggctgaggtgggagggtcacttgagcctgggagatcaaggctgccgtgagccgtgatcatgccactgcactccagccttggtgacagagtgagaccttgtcaaaaaaaaaaaaaaaacggagaaagagagataagtagaaggaaggaaatgaaaaaaaaaaggaggaattaggatgactgggtagaatcagaaaacaacattcagccgggcacagtggctcacacctgtaattcccaacactttgggaggcctaggcaggcatatcacctgaggtcaggggtttgagaccagaatggccaacatggtgaaaccccgtctctactaaaaatacaaaaattagctgggcatggtggcatgtgcctgtaatcccagctacttgggaggctgaggcaggagaattgcttgaacctgggaggcggaggttgcagtgagccaagatggcaccactgcactccagcctgggcaacagagcaagactccatctaaaaaaaaaaaaaaagagagaaagaaaacaacattcaaggccattctgtataccagcaaaaaaaacacatctttgttgttgttttgacttttttttttttttttttttgacagagtctaactcgttcacccaggctggagctcagtggcaccatcacagctcactgcagcctctacctcctgggctcaagggatccctccacctcagcccccaaagtaggagggactacaggcacacgtcaccatgcctggctaattttttatttctttgtagagtcgagatcttgttatgttgcctaggctggtcttgaactgctggcctctggcgatcctcccaccttggcatctaaaagtgctgggtactttgggacatgagccactgtaccttaccaaaaaacacatttactactatcagccagtgattggaaaagactaaaaattagatctctaaagtgaatattgactacattctacttatgttgagtggtgggtttaccagtgtttttttgtttgtttatttatttatttatttatttatttatttatttatttattgagacagagtcttaccttgtcacccaggctggagtgcagtggcgcgatctcagctactgcaacctccgcttcccaggttcaagcgattctcctgcctcagactcctgagtagctgggattacagactcgtgccaccacacccggctaatttttgtattttcagtagagacatggtttcaccatgttggccaggctggtctcgaactcctgacctcaagtgatctacccacctcagcctcccaaagtgctgggattactggcgtgagacactgcatccagcccagtgttcatttatttttacgcatcataatcaacaggtataatacagagttatttgtatattttaaaatacattataaaatttacctgccaaatattttataatacaaaaagatactgtaaattgacaaatcacagtatttgctaagttcacaactgtgctggctttctgtagttaacattaagattttgattatcaaagactgaaatcctggaggttggaagagcaatatcttgagggcatggggcttcccagtcccctgggcccctccaagtaatttctcctgtattcatgattgccaagcaaatgtgatgagtcacttcctaatgaggaacatctgatcacaggaatttggaaatatcatgcaaccatggatggtgtgcaaaatccaagcagggaaaaaaggaattagaggctaattttctagggagttgttacagcagcaactatgtggactcgaatcctgtggggttgtaatcaaggaagacagaccaaatcaaggatagaacattcatttccttcctgcctcttccctcccttcatttctctttgtctctctccctctctccaccccatcccctcatttcccttctcctgcacgtggcctggttgatcatacttttttttttttttttttgagacagaatctcaccctgtcaccctgcctagaatgcagtggaataatctcagctcattgcaacctctacctcctggattcaagcgattctcctgcctcagcctaccaagtagctgagattaccgacgcgtgccaccacgcccggctaatttttatatttttagtagagacagggttttgccatgttgaccaggctggtctcgaactcctgacctcaagtgatctgcccgccttggcctcccaaagtgctgcaattatagacataagccaccatgtcctgccgatactggttgttgaaatactgaaaagctttcctagcagttggtaaattactgccaacagcctcctgagttccccaccccatccacctgcctccaggcccccagacctccctcttcttatttttattttttattttttgagacggagttttgctctgtcatccaagctggagtgcagtggcacgatcttggctcactgcaacctctgcttcctgggtacaagcaattctcctgcctcagccttctgagttgctgggattacaggtgcacaccaccacgcctggctagcttttttagtagagatggagtttcaccatgttggccaggctggtcttgaactcctgacctcaagtgatcagcccacctcagcctcccaaagtgctgtgattacaagcatgagccaccgtgctggccagacctccctctctttcagcaactaaagagttaatccccagcatagctgttgatctccaggaacaggacttagtgctaaaatcagtgtctgttctaaatggctgccggccatgtggtaaccagctgtgaaatattttgaatatcacccctggctgtggccacaaaaaggcaaaagccaagtaggtgtggtaaatttgctgcaagaaatggcctaacatactgagttgaggttttggcttctgtttgaagtagtggcaggaacagagcagatgggcgggcctgggttcagcttggtttgtaaaacaagataattccttagcttaatgaacaaagatctaagtcaagtcaacacactacatagtcacagtccttctagccttaaccatcccttctctctttttttttttttcgtagagatgggatctcactctgctgcccaggctggtctcctcctgccttggcctcccaaagtgttggaattacaagtgtgagccactgtgcctggccctgaataagtttcttgacccagagttcctgaagaggaggatgggaaccttggaggctgtttctccaggctggttagtaccaaagatggacaggacttgaaaaataatggaggattaccttgggcttaattacgtgggtacttgatatgctgtcttcaatttagagaaagggtctcactctgttgcccacagtggagtacagaggcacaaccacagctcatcacagcctcaaacccacaggcacggatggacacagtggctcatgcctgtaatcccagcactttgggaggccaaagtgggtggaccacctgaggtcaacagtttgagaccagcctgaccaacatggttaaaccccgtctctactaaaaaaaaaaaaatacaaaaattagggcgtggtggcgggcacctgtattcccagctactcgggaggctgaggcgggagaattgcttgaacccaggaggcagaggttgcagtgagccgagatcacgccattgcactccagcctaggtaacagagagactccgtctcaaaacaaatcaaaacaaacaaaaaaacccaaacaaacaaataaaaaactgcaggcacatgccactgcacctggctaaatttttttttaatttttttaatttttttttttaaagagatggcatttcactatgtggcccagactggtctcccaactcctagcaccaagcaattctccctccttagcctcccaaagtgctgggattataggcatgaaccattgcacctggcctctgtttctctttacccatcccagctatttatctttacctggaaggggtagcagtatcctttcacagggacctagtccactttacctagggaccagccatctaggtttacctgaaactgttattcgggcactgaaagttctgcatcctaggaagcccccaggtccctggcaaactgggatggttgatcacactaactgactcctctgtaggatgtcatcctgatcgtcattgacaatatcatgctgatttgccttggacttgaagtatcaaagatcccccaggtcttgctgagacgtggatgtaatggggttgtgagatataactggcagaaatgcaaggacctgtcacatcagtagagcttagaaaatcattagtaatgaatagtaagttgtaatgaatattcattagtaatgaataataattagcaatgaatattccttagtaatataagatctccttcaaaatgtgggggatgggagggcagagaatgaaggacaaattgctgcattttatttattttattttttgagacagggtcttgctctgtcacccaagctggagtgcagtggcatgatcatggcccactgctgcctcaacctccagggctcaagtgatcctcccacctcagcctcccacctcagcctgtggagtacctgggaccacaggtacacaccaccacacccagctaatttttatttctttttaaaaattattattatttttgtttgtttgtttgagacaaagtctcgctctgtcatcccggctggagtgcagtggcgcgatctcggctcactgcaagctccacttcctgggttcacgccattctcctgcctcagcctcccgagttgctgggactataggcacccgccaccacacccagctaatttttttgtatttttagtagagacagggtttcaccgtgttagtcaggatggtctcgatctcctgacctcatgatccacctgcctcagcctcccaaagtgctgggattacaggtgtgagccaccacgcctggccttaaaaattatttattaatttttaaattttttttctttccaatcatttgtcacagtcatattatttttaaattatttgtagagatgtgggtctccctatgttgcccatgctggtcttggacaccggagctcaagtgatcctgtcttggcctaccaaagggctggaattacaggaatgagccactgcatcaggccaacttgctacattttatactttcaactaataaggaattctggaagcagcatctacctctattttagcagggcttttttcactgcaagaaacaaaaaagttcactcaacaaagctcaagtaagagaaagagatagataagggagacctgatctcttagaactaagccatagtggaatcagaattcatgtaggttgaaacccaaggaagttctgagtccaggaaaaactctaggtgcttcacaataggaattggcgaatgggccagacacggtggctcacacctgtaatcccaacactttgggaggctgaggcgggcagatcacaaggtcaggagatggataccatcctggctaacacggtgaaaccccgtctctactaaaaatacaaaaaaattagctgggtgtggtggcacacgcctatagtcccaactactagggaggctaaggcaggagaatcgcttgaacctgggaggcagaggttgcagtgagacgagattgtgccactgctctccagcctgggcgacagagcgagactccatctcaaaaaaaaaaaaaaaggaattggtgaatgttccctctccctccaagtgtcaatgtgatttagccaccacctaccacttgttagtgtttgtctccttctacccggttccacatttctcacctaaaaggcccaagaaagaaaatctgattaatttatcttttcatatttatttattttttaagatggagtttcgctcttgttgcccaggctagagtgcaatggcgcgatctcagctcactgcaacctctgcctcctgggttcaagcaattctcctgcctcatcctcctgagtagctgagattacaggcatgcaccaccaccgcccgggtaattttgtatttttagtagagatggggtttctccatgttggtcaggctggtcttgaactcccaacctcaggtgatctgcccgcctcggcctctcaaagtgctgggaatacaggcatgagccaccgcggccagcctatcttttcattttttaaaacttatgttttaggttgggttttgttttgttttgttttgttttgtttggaaacagggtctcactctgttgcccaggctgcagtagtgcagtggcatgatcatggctcactgcagccttaaactcctgggctcaaacaatcctcccacctcagcctccctagtagctggctaccacactggctaattattttactttttattttttgtagtgatggagtcttgttgtgttgcccagcctggcgtctaacccct

SEQ ID NO: 34 - DNA, 1125 bp, Homo sapiens
cttgaaagttttaaagccaatgtatcttctctttctgaagatttgaaacattttgtagacagaatggaaagcaatgaaaatctacaaaaatgttttgaatacccaaaagaaaaagcatcagatttgtttctggcaatacctgtggttgagatgaaggaatccatagcagaggtttcttcagagcctcaggcttgggatcagtttttgttgcactatcaggttgagtgtctgcgattacatgttcagaggatcaaccaaagtcagaatttctgaagttgaagtgaaactacagtatacttttttttttccagacagagtttcactcggttgcccaggctggagtgtaatggcatgatcatagcacattgctcaagcacatagcaacaggctcaagcaatcctcctgcctcagcctcccgagtagctgggactacaggtgcatgtcaccacgcccagctaattttgttcattttttgtacagatgaggtttcactatgttgcccaagctagtctcaaactcctgggctcaagggatcctcctgctttggcttctcaaagtgctgggactacaggcttgagccaccacacctggcccagactgtgttctttttttttttttttttgagacggagtctcgctctgtcgcccaggctggagtgcagtggtgcgatctcggctcactgtaaccgccttctgagttcacactattctcctgtctcagccttccaagtagctgagattgcagcatgtgccaccacacctggctaactttgtatttttagtagagatggggtttcaccatgttggtcaggctggtcttgaactcctgacctcaggtgatccgcctgccttggcctcccaaagtgctgagattacaggcgtgagccactgcacctgacccaggagaaggtctttgactgtgtggagctggtgatggatgagctacaaggagcagtccctgccatgggccttcgtggactgaggccgtcagagcctccagcaggtgtcagtgcagctcagggagagacacccactcagcacctcccaagagatgcagactcatgtccaggacctcgtggagtttctggaggctggaaagggaacggggatggaaggcgctccagca

SEQ ID NO: 35 - DNA, 1854 bp, Homo sapiens
ggggaggggggtccgacccagcgcggacctcgccggagacaccccgcccgccccggcccggtccgcgggggcatgcgaggcaggggagggggcgcgcccggggctcccaccgacctcgcccgggcgcaagggccggagcccccgggttcccgagcctcggagccgccgcggctgtgctgccgccctgtggccgccgcccgcactgcgcctcgggcccggccgcgctccagcgcgtgcaccccgcactccgccctgccccggacctccgcgggccccgagtcttcctgccagcccctcggccccagggaggcggggcgggcgccggggtagacggcggggccatgtgggctttgctagctcgggagcggggcggggtgggaggctgcggggagccgggccccaatgcccggaggtcaggggcgccctggggcagaggaagcggcaggtaccccttagcgactcgtggcttctgcagcccctagaaggacccccagacgagggtctggaaaagtgaccccttcatagtcctaaacaagcagttggcaatggtgtgccgttctccacgcggtccgatgggaaagggaggccctgagccgcaacgagtaagtagatagtcagcaggaccacgtggacgcgaccaaccacaggtcacacttcggacgggagcaggacccggcgcccatccctcaggaccgccgagagccgggccctctgggccgcaggtgccgctaccttagccatggagccgcagcagaggaggccggcgctggaattgcaggctcgtcctggctgccccgccgcactcctctcacggaagtggctgtgccggaggcgcgagaacagaactctgttcagacgctcgcgtgctcggagaatggagcctggagacctggttcacacccgctatgtgtttaaatggataaaacgctcctcaggtctgtgagcctgcaaacaaggtccccactgccatctgctggccccacagacaagaacccacacaggaatgaagcccaaaatatcccataaactttccaaagagaaatgacaaaactgaaatagtagtggtgtcaaaacacagtgtacttctcagcccaatgaagctgggatgggtggcccagggagccccagacttcatggataggcttttcgttcacatggctcaaaatggcaccccagatccagccatcacatctgcactccagccagcagaaaggaggcagggccctcttcttcaaggatgcctcccaaaagttgtgttgccacagctgctcacatcccattggctagaacgtagtcatacgacccacctcactgcaagggaggctgggaaatgtagtctttaatctgtgaaatgtgcccgcttaaaacggagccatggaggaagaaggactagcgatctggggggtaggggttgggtgggcgaaaggctgtgcctccctcggtggcgtcaacatcctggccatgttgtcacatgcacttgctggcaaaattcccaagccatgcgctcacagtttgtgcagtgatgagtgtggcaaacacagctcagttaaaaataaacatcattttatagattagctgaagaatacaatgtcccacgagactatgtggccatcaggaaattaacttttctgacctaatggcccaggaagcactgcgggcagcgtctcgccccgtgtaacgcagcacccgcagaagtgcccgggatcagcctttgcctcggcgggatcctggttcctggttcttccaagggcatggcgaggtccccgctcccttatcttgaggaaagtaataagtaacccagctctttcaactcccaaggttactttgtcaataaagtgcgccttctcaagtctt

SEQ ID NO: 36 - DNA, 60 bp, Homo sapiens
cttgaggctgaacttgaggagatccagcagcaactactgcactaccagaccaccaagcag

SEQ ID NO: 37 - DNA, 481 bp, Homo sapiens
ctatcagccatggtcaactccactgtattatctaacatcttgggtcatgccttttttgagctgtttgcagacagagttccaaagacagcagaaaactttcatgctctgagcactggagagaaaggatttgggtataagggttcctgtttttacagaattattccagggtttatgtgtcaaggtggtgacttcacatgccataatggcactggtggtaagtccatctacagggagaaatttgatgacaagaactacatcctgaagcatgcaggtcctgtgttgttcatggcaaatgctgaacccaacacaaacggtttccagtttttcatctgcactgccaaggctgagtagctggatggcaagcatgtggtctttggcaaggtgaaagaagtcatgagtattgtgaaggccatggagagctttgggtccaggaagggcaaaaccagcaagatcaccattgctgactgtgcacaactctaat

SEQ ID NO: 38 - DNA, 56632 bp, Homo sapiens
tggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggagattgattaaccaccagttgccagtgatttaaccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctgtatcctttataataaagcagtaaacataagtaaagtttctgagttctgtgagccattataagaaacgatcgaacctgggattttcctttcggaagccgctctctctcacaagggagagagctgttctcctttttcttttgcgtgttaaacctccgctcctaaacccactcttcgtgtgtatcgtgtccttaaccttgttggtgcgagacgacgaaccccgggtattgaccccagacaacaatgccacttcatattggggacttcgtctgggattccaaggtgcattcattgcaaaggtgagtaaaggggcggacctcaactctgtcctttgatttcgaggctcttggcctccattttagaatcaaaccaaaccaaatactgggcccccttctgcttctgtgaatgagaaaactctgccttcaccaattagccatttaaaaattatgagcgtggctgccagccttacaagttttgggggacaggcttgctggggagaacatggagaaccccccaatacccacgggctgctgggcatattggccatgtttgaaccagtttcctttcacggaggaccaagctgtcgtgtggggctggaagaggtcctggagcaactgaggatttctggctggggctacctcctggtgccatccgaaggcttctggactgaccccagcctccggccaccctaaggggtgtcggcaacaggacctccaactttcctatcataattccctcatttcctatccacgaccaccatgtctcctaacctctctctgtatgcagtactgagggagttttacagttcagggaagtaatcttgttaggcaagaacaaagactgctgtagtaaccagggatatagcacaggggcatgctgttgtgattttctaggaacagagggtctcctctcccaccacagtgagcgtcactctctgcccttgctctggaaagcacatggcatgtcaaggtcactctgccctttgtcatagtaagattagggtggggcgcccaaccttccccgcgtgctatgtaaacgtcacacctgttcaaaccaacctgtgggctctgcgcaaatcagacgccgcctcctcaggcctacctataaaatctggtgcagtccaccgcaggccggattttcctttcggaagcccctcacaagggagagatctgttctcgtttttctttcttttgcctattaaacctctgctcctaaactcccccaacccccaagaaagaaattatcgaacctgagggggttgcagatacccatgatttgtagtgaactcagacagaagtgtgggtaccctgaggtcctaatagttgtggctggcatctgaagtagggggcagtcttgggggctgagcccctaacccgtggggtctgcactaactctggttaattagcatcagaattgagtaaaattgtaagacactcagctgctgtctgtggagaattggagaattggttggtggaaaacccatatatttgatgtcagaaatgtgagtagagaaatggtttttccttgataggctctatgtaaattttagttcatgtttttggtaataaatacacaatattactgattcttaaaagtataaacccaggaaaattaagaaaacaagaatgtcaagtccaacagagtttaaaggtaaaaaaaaataaaatagaacagaaatgggaccagtagcacatagaatattttaacacattcttggaaagtagaaactatatggactagtagtcaggaaggaagcagctcaaggaaaccgcttcctgaatatggagtctcctatgagagactatctgccctatggagaagcttggagtaactgcggacacaggatgccagataggaaggagggctggagtgacatgaagggctgaaaattgagggactaattggaagcccgtgcacgggacagtcagctctctctacctcatgatcagaatatttgacacacaagtgtttaccctggggcaaaaaattacaggagtcttccctgcttcccccaaaattgaacacattgctttctcttagctgacctagagaaccagtgtgggcactggcaccccaaaactaagaatccttttaagaaatggtgattttatgtccaaggaacgttccaagtaagttttcggctgctagctttgtctttacaagtaacgggccaggcccagtggctcatgactgtaatcccagcattttgggggactgaggtgggcaaatggcttgaggtcaagagttcaagaccagcttgggcaacatggcgaaaccctgtctctactagaaatacaaaaattagccaggtgtggtggtgcatgcctgtagtcccagctattgtggggctgagatgagaggatcacttgagcctgggaggtagaggctgcagtgaaccgagattgtgccactgcactccagtctgggtgacaaagtgagaccccatctccaaaaacaaaacaaaacaaaaaaaaccccaagtaacttgaaatcattttctgaaatctttctctgacattctgacattagggtaattcttgttctccatagagggaaaggctcaggttcaagtcccactcctgtggctcctgattttttaatgattagtttgaccaatgtgtttttaaatgacttaatttttaaacatgagttgaaaacccaggatcactacacatttgaggaaagttgataatatgaaaagtaaacaccaaggtaagtggtaaaaacctttgaggaaacataattcaggaaacaggaacttaaacattagtatcgtacagcagattcaggaagatggcactggttaaaaaaattgacactatgaaaataaggcacagagaaaagaaagagctgtgggaaattataattgctgaaattttaaactagattggagaaccggaatataaaggagaggacagctgggtgcggtggctcacacctgtcatcccagcattttgggaggctgaggccggcagatcacttgagcccgggagtttgagaccagcctgggcaacaaggtgagacccccatctctacacaaaataaaatataaaatcagctgtgcatggtagcacacgtctgtagtcccaaaacttgggaggctaggtgggaggatcacttgagtccaggaggtggtggctgcagtgagctgtgattgtgccattgcactccagcctggatgacagagcgagacccttagaaagtaggaaaagaatatatgaaaaaaaaataagtgatcaattaattactcacctgaatagtgggaataccaaaagagtaaaaagagagtaacagacagtaggaagttatcaaataaataatagaaggtaatttcccaggcttgatgggagacccaagagctcagattgaaaatgcccattgaatacccagcccaatgaatgtagagaggtctacacttaggagaaaagatcctaaaagctaccagaaagatagaaactgttactataacagaaataagacactagcaccttaactattaaccaatcttaacaaactagaataaaggccggatgtggtggttcatgcctataatcctagcactttgggaggtcgagatgggaggatcgcttcagcctggaagcttgaggctgcagtgagctaggatcgtgccactgtactccagcctgggcgacagagtgagacactgtctcaaaaacaacagaaacaaaaaaactagaataaaatacttctggtgtgagactctgtaggtttcattactccttttgggtcctgattaaatcctgttgactcaagaccttagagcatttactggtaaagtctctgactgcgcgattttttttttgcattttagttccttaaatattttctcactgcttcctactaaaggacggacagagcatttgttcttcagccacatactttccttccactggccagcattctcctctattagactagaactgtggataaacctcaggtaagtaaattactatccctggcaaaggtgcttttcttccacacctaaacctatggtcccttctttgtcttgctattgtttctctctttggaggcaggatggtatggaggaaagaggacagacactggagtcacacagacttgggtttaaatcctagctccatggcacagttgcctcaatggcactcttagcactgtagtcaaagaatattagacctggaaagggccttggaaattacttctcctcccccagaaacagcctctagactggcatgattgaccaccaaacttcgttgtgtcagacaggatcaatgtctgctggtctgctgcaactctgtactcatttatctctggggaggcctgaagccttggtgctgttccttggccaaacctaaatgaaatgtactagccagtgattaatagagtcctgtgctggggtgggagacagaccagggagcagcctgtttcttgcttctttctttctttttggagatgaaatctcattggctttgaacttctgggctcaagtgatcctcccacttcagcctcccaagtagctgggattacaggtgcatgccactgccccagcttgactataccagcttgtttctggttttgagccctggtatgcaagctagtgttggctacctgatcagaggagtataaaagagcctcagatgaggttacagttctcttgagaccaaggtgtcttgcatgtatcatctagctggttcattgcttaaagatgaagcacatcttccacatcctctgtggctgcaaaaggaccctaggaactgggtgtggtgtttcacttgccttttggtttgttgggttttttttttttttgtatctatcctttacctttattaaagccttatgtgaggatactatgcggagtcttctaagtcttttcaatgatccaaacctgtgtaattgatgaagagggtactgtgaataggatcattactttttttttgtttttgagacagggtctctctcactctgtcacccaagttgagtgcagtatcttgatcacagctcactatagcctcaacctcctgggctcaagagatcctcccacctcagcctcccgagtagctgggtctataggcgcacaccatcacggctgcctaacttttaaaaaaattattttgtagagctggagtcttaccatgttgcccaggctggtctcgaactcctgggctcaagtgatttgcctgccttggcctcccaaagtggtgggattacaggtgtgagcaactgcgcctggccccaggtttttttttttctttttttttttcgagacagggtctcacactgttgcccaggctgtagtgcagtggcactgaagcctgaaacctctgcctcctgggttcaaacagttcttgtgcctcagccacccgagtagctgggattacaggcatgcaccaccacgcccggctaatttgtttgtatttttagtagagatggggtttcgccatgttggccaggctggtcttgaactcctgaactcaagtgatccgcccgtcccagcctcccgaagttctgggattacaggtgtgagccactgcgcctggccccccagttttttactttataatttaaatgatagctaaggctttgtttgggagaaagatgaaaagtggggaaagatttagagccactggtgccaggctagttgctggggaatccctgtttgaatttgctgaagtgctacaactctcaatgggaagaaagggatgacaatggaacttgaaggtggttgatgcagagcaagaggaaatcgctaaatagatttaaaaagaaatccagacacagaggaagtcagccaagaatacagttccctggctggttaggctgctttggcaaaaatgaaagtaactaaaaaagagcctgtgttgccaagtccaccaatttccttctgtaaagggaaggaacatgatgccaaagaggagttgggcagatatttcttctgatgggaatgtgaccctcatcgggtagataatcaccaacgaaactacagtgggagggcatcaagagacaactgaaacagggaactacacaagagtgaagttgcctgtggactgacagagcttcctgcagaaccactgctgggttggatatacatgaatgacaaaggagctcttttccttgtattaggtactgtcaaatgtaccttcaaatgaaagggtgtgtttggtcttaattagctgaattcgttgaagatcttcaattagctgcagcttttgccggaatgtgtttagctgggcaaattccaaatcggttgagctgcacaaaggtggcagtacataaaacatatcttgtaaaggggaactgcccaattccacccataattgttagaagaaatactccctagaggttactgaaatgttgagaatgcaaacaaacacatttggactggttctgtgatgaaactaaggtatcccttaattttatgtctttgacttaagtgatgattgttgctgtgataagagggcctctaccttcgtagactttttgtatgaccctactactgggggagcaggatgaagtgaaagcctgttgaagacttactagttcctttgctccaaattgtgctgaatgatgaacagattaatatcattcaaaagaaaggaggccgggtgtcctggcttacacctgtaatcccagcactttgagaggctgaggcaagaggattgcttaagcccaggaatctgaggctgcagtgagctagaatcatgccactgcacttgtactacagccttggcaacagagtgagcccttgtctcctataaaaaaaaaaaaaaaaaaaaggaaagggctgggcatggtggctcacacctgtaatcctagcacattgggaggccgaggcgggtggatcacctgaggtcaggagttcgaaaccagcctggccaacatggtgaaaccctgtctctactaaaaataaaaaaattagccgggcatggtggcacatgcctgtaatcccagctactcaggaggctgaggcaggagaattgcttgaacctgggaagcagaggttgcggtgagtcaaaattttgccactgcactccagcctgggtgaacagagcaagactccatctcactttgttgcccaggctggtttcaaattcctgggctcaagcaatcctcccaccttagcctcccaaagtgctgggattacaggtgtgagccactgtgcccagtcaagatttctaatgtatcctagtcttgatgaattaaacaaataaacctttaggatgatgcaaaagcagaatctacagtcactttaaagcagtgtgatgtaaagaaaagggtggcagagtctcttggtgctatgggacccaaggacatttacattggtgtggataaaatgcccggagtggtgaaaaactttattgtcattgttggaccatggtgcataatgtattgttatacctgctaataaaaaattaaacagcaattaacttagtttagtatgacaatacaactgtaagtttaagagtgaaaaatgggccaggtgtggtggctcaggcctgtaatcccagcactttaggaggctgaggtgggaggatcacttgagcccaggggtttgagaccaacttggcaacatagtgagaccccccccaccaacacccccaacacgcttgtctctataaaaaatggtggtgtgctcctgtcgtacgagctgcttgggaagctgaggtgggaggatcgcttcagcccttgaggttgaggctgcaatggatggtgatcaagccactgcactccagcctaggtgacagagcaagaccctgtctcaagaaaaaaaaaaagtgaaaaatgtccatataaaaacttgcacactaatgtgcacagcggtattatttataatagccaaaaagcgtaaacaatccacacatccatcaactgggttgaggaataaaatatggtatatgtgataataaagtgtggtatatccacataatgaaatattatttgacaatgaaaaggaatatgaagtactaaaacaatacaacatggatgaatttcgcttcctttttttgttgttctttttattttattttttaagcacctctaccaacatgaacattttgcaaagtgaaagcaaccagacacaaaggaccacgtactgtatgattcaatttaaatgaaatgtccccagtaggcaaatctatagagacagaaagtaacatagtagttgcctagggctaggagggtaatgggggacatggaaagcaactgctaatgggcacagcgtttctttctggggggatgaaaatgttctaaaattgattgtggtggtggttgtgcatgtttatgaatatgctgatatttattgaactgtacattttatttactttttttagagacagagcctcactctgttgtccaggctggagtatagtactgcaatcatagctccccgcagcttcatattcctgggctcaagagatccttccacctcagcctcccacgtagttaggactacaggcacatgccaccatgccccgctaagttttcgttttcttaaaaaaaaagtttttttagagacagggtctagctatgttgcccaggctgatctcaactcctggtctcaagcaatcctcccgccttggcctcaagagcattggggttataggtatgagtcaccgcaccctcagttgttcattttaaatgggtgaattttatgatgtgtgaattatatttctttctctttttttgagatggagtttcactcttgtcgcctaggctggagtgcagtggtgcgatctcggctcactgcaacctctgcctcgtgggttcaagcaattctcctgcctcagcctcccgagtagctgagattataggcatgcgccaccatgcccagctattttttttgtattattagtagagatggggtttcaccatgttggcaaggctagtcttgaactcctggcctcagccccccaaagtgctgggattataggtgtaagccaccacagccagccccaactagctgggactacaagcacgtgccaccacacctgactaatttctttttttttttttttttgtatttttagtagagatggggttttgccatgttggccaggctggtctcaaactcctgacctcaggtgatccacccacctcggcctcctaaagtgctgagattacaggcatgagccactgctcccgatggattatatttcaatataattcaattatgcaatataattgcataattgttatcatctctccctgatatattatcggaatggatgtgacatctgaatggggatgctgttgaggaaagagatttcatgaaatgtacagtgagtggcataattgtggctcactgtaaccttgaattcttgggctcaagtgatccttctgcctctgctccccgagtagctgggactacaggcatgtgccaacacatctggctaatttttaaaattttttgtagagacaaggatctcactaagttgcctaaactggcctcaaactcctagccacaaacaatcctcccaccttggcctcccaaaatgctgggattacaggtgtgagcctccacacttggccacttactttctttttgattcctatttcaggagaaaatcataatcaatttgcatttgtgtggaaaggccaccaatgcacatttaagctgctcccacaggacatttaaattatcttgcttattgctacaacctaatgaggaacaacttagatttgattgcactggaaaatactatatcttttttttgtttgtttgagatggagtctcactctgtcacccaggctggagtgcaatggcgagatcttggctcactgcaacctctgcctcccaggttcaactgattctcccgcctcagcctcctgagtagctgggattacaggcacccaccatcatgcccggctaattttttttatttttgtagagatggggtttcaccatgtgggccaggctggtcttgaactcctgacctcaggtgatctgcccgcctcagcctcccaaagtgctgggattacaggcatgagccactgcgcccagctaatactatgtcttattatattgatgataataatgttaatctctcaatccaaatatccagctaagactgaattggaagtgcttgttaatcatataaccaccagggagggatgattaactggctaaaatgcaaggcttagaataaatggtaaaattcttagaaattacttgggctaggctgggtgtggtggctcacgtctgtaatcccggtgtgggagctgagattgcgccactgcacttcagcctgggcgacaaggacaagagtgggaagccaaggcaggcggatcacttgaggtcaggagttggagaccaagctggccaacatggcaaaaccttgtgtctactaaaaatacagaaattagccgcaattggtggcacgtgcctgtaatcccagctactcaggaggctgaggcaggagaattgcttgaacccaggaggcggaggttgcagtgagccgaggccacgccactgcactccagcctgggtgacagagtgagactgtctaaaaaaaaaaaaaaaggaggaattacttgggctagagccactagaaacattcccaaacaaccaaaattaagttgctagctacaagacagaggaaaaaggcacgaaaattagttcaatttcttggttcctggagaaatcacataccatgtttgggaattttatcaacccttattctcgaagttaagagggaatggggagctaatttacatggggctttgaaaaatgaacaaatgggagactttttgggaacttcgaagagattactttggggccatagcacctcagtgttcaaatgatgttagcaatgtcagcaaccgactcacgctgatggagcttcttaccaaagcccgtgactgcccctcagggatggtcatggggatttgacactagaaagttacccgaggcttctggcaggtatatgtcctttgaaaaacagtcattggcctgttactgagcttcttttttttttttttttttttaagacggagtcttgctctgtcacccaggctggagtaccgtggcgcgatctcggctcgctgcaagctccacctcctgggttcacgccattctcctgcctcagcctcccgagtagctgggactacaggcgcccgccaccacgcccggctaattttttttgtagttttagtagagatggggtttcaccttgttagccaggatgttctccatctcctgacctcgtgatccacctgcctcggcctcccaaagtgctgggattacaggcgtgagccaccgcgcccggccagagcaccgagacttaaaacatgaacacaaaataatgattttttaaaactgagtaattcgatcaaattgttgctgccaggctatacaattttgtctatgtttttctttaatataaatgttcagtatatgctcatgttaccacattgtgtccataactgatatctggaaagcttcatgaatggaggcagatgggtgtctgtcttgttggttgctagatccccaatgtctagcactgtacctgatatatagtaggtgcttagtaaatatttgttgattaagtagatgaatactgatgtttcataattttccaacaatttatcttttgtgttgaaattccaggcattcctttaattcctggtttcttcggaaacagtgggaaatgctcttctaagaaaaatcttactataagggatcaacctgctttattttccttttcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaccttgaaattattctctgaagtgtttctctggcgttttaagtttaggttttatttttcaattgcttttgcaatattttgctaaactttcttcactggttaaatgtgttatattaggtataaggtctagtttattaaaattcaacatcaatatttttatttttgcttcattttctatttagtacagcctgtgttaatttgtcaaatatatataaaataagaaagttacgtctccttaaacttggaccttagaaaatactggctgtattcttaaggtcctgaaaagattaaataactcatgcggtcatcctgatcccagtctcctcacccaccctccttctactgctcttacatgatctttctttgattcttctcattgctgcagtattggagggttttgtttgtttgtcctagccccgccataggggttatgatatataaatcagagttctaacaataacaacgatcatttactgagtactgtacctactttatgctaggcatagagtgagtactaattcttatccaatgaatttacccctttctctcccatttcacagctgagttcatggaggctcagagactttaagaaacatgcctatgtttctaccgaaatgtcatggcaaggctaaaacgtaggttttctaattgcacgttacttcagctggtcctggtgttagtcggcttccctatcactttgaccctgagaactcaaagagcaacataccagctctggggggcagctggggcaggatattgagttacacagcttagggttctgtacctagagcacggctgtggtggaggggcccattttgggtggtgggattgaggatggagactcaggccaatgagatcgggagtgcacagccacgctggagcttgtcttgctcctgaacaaaacaatcaactctgtgtacataccccctggtgccactgccaggcaatctaaatattttccttcatatataggtaaacaggacacggtacagtgtttttcctgtggtggatgtttaggaaattgggaagaaggagatgatccttggaaggaacatgccaaatggttccccaagtaagtagataatttttgcttaaatgtttctttcttttttttttgagacagtcttgctctgccacccaggctggagtatagtggcatgacttcagctcggtgcaaattctccctccctggttcaggtgattctcctgcctcagccttctgagtagctgggattataggtgtgcaccaccaagatgggctaatgtttgtatttttagcagagatggggttttgccatgttgcccaggctggtcttgagctcctgagctcaggcagtccacccacctaggcctcccgaagtgctaggattacaggcgtgagccactgtgcctggctaaatttttcagttctttaaaagacaaaatgaaagacaaaagagccacctttctggagtagcaccttcagttttgatctttccctattcaaaattggaccactccaggatttattcaagcaggaaaggcctaattacattgtgaaaagtttgaattatagaattttaaacagtttttaagtatttcattatcccaaattctaagataggttttgcccagtagaagtttcatgatctgccttaattaataaataaggctggaagtggtggcccacacctgtaaccccagcactttgggaggccaaggcaggaggattgcttgaaatcaggagtttgagaccagcctggcatgtagagaccctgtttctacaaaaataaaaaaaattggccaggcgcggtggctcacacctgtaatcccagcactttgggaggctgaggccggtggatccgaggtcaggaaatcaagaccatcctggctaacacggtgaaaccatgtctctactaaaaatacaaaaaattagccgggaacggtggcgggtgcctgtagtcccagctacttgggaggctgaggcagaagaatggtgtgaacccgggaggcagagcttgcagtgagccgagatagcgccactgcactccggcctgggcgacagagtgagactccgtctcaaaaaaaaaaagttagccaggcatggtggcgtgtacctgcagtcctagctacttgcgaggctgaggcaggaagattgctagagcccaggtagtcaaggctgcattgagccgtgatcaagccactgtgctccagcctgggtgacagagtgagaccctgtctctaaaactaattaaataagtaataataatttccataggggtggtgtaaaatggtgtatgctggaaggtaaaaaatatttaaacattattacaaatggtttcatgtactgctaaatatataccaaatgaaaacactgtatttttaaacctcagaaagagtttttattactgcagtggtctttagttcctggcttagaaaaggaagtacattttaattatttttaatgctatatttactagtattttctacatgactttctttgtttctaccaagtacagattcattcctttaacaagtttttaaactttcactgtgtaaaatttcatacaaagatagaatagtgtaataaatacttgtcaacacatagccaaatcatatttcatccatctcctacccaccttttttcctggaaataataacaataactatatttttattttattttatttgagacagagtctcgccctgttgcccagtggtacgatcttggctcactgcaacctccacctctcaggtacaagtgattcttgtgcctcagcctccgagtaactgagattacaggcatgcaccaccacacctggctaatttttgtaattttagtagagatgcggtttcatcatgttgcccaggctggtctgaaattcctggcctcaagtgatccacccaccttggattcccaaagtgctaggattacaagcatgagccacctgtgcctgaccaagatttgttgttttctttctttcttttcttttttttttttttttgagagtgagttttgctctgttgcccagactggagcccagactggagtttagtggtgcaatctcagctcactgcaacctccacctctcagactcaagcaatcctcccacctcagcgtcctgagtagctgggaccacaggtgcctaccaccatgcccagctaattttcatatcttttatagcgacaaggtttcactttgttgcccaggctggtctggaactcctggttctacaaactcctgggctcaagtgatcctcccacctcagcctcccaaagtgctgggattacaggcatgagccactgtgctcagccccttaagatttttaattcgtagatttcctctttatccatctcttttttcttgtcacttatttgttaaagaagccatgtaatctgtcctgtaaaattccctctactctagatttggcagaatgtgttcctctggcatagtctaacatgttcctctaccttctgcatttccaggaacctgacacttggatctagcagtttggtcaggctcagattctattttctttctttctttcttttttttttttttttttgtgacagtctcactctgttgcccaggcttgagtgcagcggtgcaatcttggctcactgcaacctctgcctcctgggttcaagcgattctcctgcctcaccccacccaggtctgggattataggtgcgcactgccacacctgactagtttttgtatttttagtagagacggggtttctccatatttgcgaggctggtctcgaactcctgacttcaggcagtccacctgcctcggcctcccaaagtgctgggattataggcatgagccaccgtgcccagcctcagattctattttctttaacaaatatttgtcacacacctactacatgcaaagttgttggttggatactaaattaactacaaaactggacacagttatttacatttataagtcatcttgcacatggacagccatgcccacaaaagtgaatggaggcccggcatggtggctcatgcctgtaatcccagcactttgggaggctaaggtaggcggatcatttgatgtcagtagttcaagaccagcctggctaacatggtaaaaccctgtctctattaaaaatacaaaaattggccaggcgtggtggcaggcacctgtaaccccagctacttgggaggctgaggcaggagaattgcttgagcccgggaggcagaggttgcagtgagctgagatcgcaccactgcactccagcctggtcaacacagcgagactccatctcaaaaaaaaaaaaaaaaaaaaaaaaggctgggcacagtggctcacacctgtgatcccagcactttgggaggccaaggcgggcaaatcacttgaggccaggagttcattcaagtgatgaactctcctctcccctcttccctctctcctctctcctctcctatctcccctcttccctggccaacatggtgaaaccccatctctactaaaaatacaaaaatgagccgagcgtggtggtgcgtgcctatggttccagctactcgggaggctgaggcaagaaattgcttgaacctgggaggcggaggttgcagtgagccaagatcactccactgcacagcagcctgggcaacagagtgagactccatctcaaaagaaaaaaaaagtgaatggatatctttgatatgttttgatacgttgtgtgggaaagcaatatgcacaataagtgcagtgtgagactttgaaaatgtttaaaaccactcaaactatatatggagttgcttgaaaatatatagaaaaccttatgaaaatatgtaaaccaaactgtagatacttctggatctggatttgtcagggggtgaagtagtgatggattttcacatttattttgttcattgctgtcttgtttaaatttttggaaacaagtatatattactttcatagttgaaaagaaagtgaggagattaggagggaggaagtaaacaagggaggagaggagaaaggcaggaagaggagagagagaaagttagacaagtagatgagatagttatagggacgaatgaagctagaattgtgaaatcatttgacagtcactctggctccctgacgaatcaaaacagccacccaggcagtccttgtccatgctgacagtgcaccatatatgcatatgtaacagggaacagcagccccggctggagcacaagccgctgctcgtgggcacctgtctcagctctagcctcagctcaggcttcacttagcctcagggtcactgtgtttagtgtcgctgggttatacactggacaagtaccagtggcaccactcacacatgatcacattatcatgtgactagcacctactagagccgcacatcctgtctggaggggccttcatatgccttctctaacatagtcagagggtaaggtaataagcacagggaggggagacagcagtccagcaaccactcctagagaggaaggagttcaggccagcaaacaagggcagggggtagtgcagaggcttaggagatagagccaggcttgaatctgctgctacctgactaccagaccctaggcaggtgactgaccttgtctgaatctcatatgtaaaatgcagtgtcaacaacaacaaaaaaattagagacagatatccccaaatatgtcaaatttattcaggaataagaaaagagggttatgatttggaatgcactactgtaaaccacaggcacgtgcagtgagggaagagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagccagagttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataaaagtgatttcatcttggtatctgcgacttccacagcagataataatgtacagcttgtctggtggttgtaaggatgagaaacaaagtatatggatcaaatgctttgtaaaaattaccatgtataatgtgaggatgacagatgacccactgttttgcctttcatttgtttgtcgtcataagcacatggtcagtcaataaaatctaagagctggaattagagcaagaatccccaagtttcttgttgggttactctgtctttagctttctggacttcaatttgttgcttctttttatcaactgtcaacaaaatgagtatacccttacactttttaaaatgtggcactccataaatgtaagatgattttatggtaactttttaaggtactgagttcctcctcaatccatataaatcatgaggacagggaaccaccccgtgcattgtgtgccatgtaggttatgtgcagacttacggcaatccttggaaacatttatacacctgaaaactggggaccctggctgcctatcacatagaatcatggccctggggaaatatgcagatcatctgatggcatccatgttctcctgtgattataagagaacatggcaaggttggtcacatccccactggtggaagagcgggtactaatgctccagcctttgggttcccagcccattctttgctacagcaccatagaaagaaaacttaaatttgaattggagggatttttatttttatttttattttttttgagacagagtctctctctgttgcccaggctggagtgtagtggtacaatcatgactcactgcaaactctgcttcccaggttcaagtgatcctcccgcctcagcctcccaagcagctgggattacaggcgcccgccaccatgcctggctaatttttgtattttcagtagagatggggtttcaccatgttgaccaggctggtctcaaactccaggcctcaagtgatccacccgcctcagcctccaaaagtgctgggattacaggcatgatcccccatgcccagctgaattggaggaaattttaaaagttaattttaaaactgcttctcttttatgggaaaggaatatgtttttaaatggtattcagtgtgctcttttttaaaaaaatcaaaaattatccattaacatccgttactttttttgtttttggttttttttgagattgagtcttgctctgttgcccaggctagagtgcagtggcatgatttcagctcactgcaacctccacctcccaggttcaagcgattctcctgcctcagcctcccaagtagctgggattacaggcgcccgccaccacacccagctaatttttgtacttttagtagagacagggtttcaccatcttggccaggctggtctcgaactcctgacctcgtgatccacctgtctcggcctcccaaagtgctgggattccaggcgtgagccatcacgcctggcctaatagccattactttttaatgcatggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggtaaagttccttcagttcttgttcatagataggtatatacttcataagtcaaacaatcaggctgggcgcagtagctcatgcctgtaatcccagccctttgggaggccgagctgggcagatcacttgagatcaggtgttcgagaccagcctcaagacctccaacatgggccgggtgcagtggctcacgtctgtaatcccagcactttgggaggccgagacggacggatgatgaggtcaggagatagagaccatcctggctaacatggtgaaaccccatctctactaaaaatacaaaaaaaaaaaaaattagcccggcatggtggcaggcgcctgtggtcccagctactcgggaggctgaggcaggagaatggcgtgaacctgggaggcggagcttgtagtgagccaaggtcgtgccactgtgctccagcctggacgacagagcgagactctgtctcaaaaaaaaaaaaaaaaaaaaaaaaagacctccaacatcgtgtctgtctctactaaaaatacaaaaaaaaaaaaaaaattagccgggtgtggtggcacatgcctgtactgctcgggaggctgaggcaggagaatcacttgaacccaggaggcggaggttgcagtgagacgagaacctgccactgcacttcagcctgggcaacagagtgagactctgcctcaaaaaaaaaaaaaaaaaaaaaaaaaagtcagataatcaacaacttgaattttaatttccctcagggagaacattttgtgaattcctgggtccagagagaattacctatggcatcaggtaaaaactcaaacattttccaaaggctttgcttgtttatttcttcttttgattttttgtccctatctctttttgtcgtcccccccgccccgccccgtttattttgaagcaaactctagacatcattccatctgtaactgtgaagggacaacttgaacgctgatacttgcaatatcaaagcctactggtctctttaatttgtgcagcagcaataaagatatagaaaaaaaaaagactaaagcctgctggtctcaccttgtgctttttattcaagcttattgcaatgacagcatctttgcttacgaagaactacggctggactcttttaaggactggccccgggaatcagctgtgggagttgcagcactggccaaagcaggtcttttctacacaggtgagtcagtaggttgtgcccacttgcttgcttgacctttaattcccacatagactttatgctcctgggcttacgtttagctacactcagcaatgtccactagcttcagcgtttctttttcttttctttttttttcccccttggagacagagttgcccaggctggaatgcagatcttggctcactgcaacctccacctcccgggttcaagagattctccttcctcagcctctggagtagctggaaccacaggcgcctgccaccacgcccagctacttttttgtatttttagtagagacagggtttcaccatgctagtcagaatgctcttgatctcctgatctcgtgatctgcccgccttggcctcccaaatgctgggattacaggtgtgagccatcgcgccaggcctctcttcagcatttcttatagattcgttttcttttctttctattttttttgagacatggtcatccaggctggagggcagtggcgagatcatggctcactgcagcctcaacctcctgggctcaagtaatcctcctgccttggcctcccaaaatgctgggattacaggtgtgagccactgcacctggcatacatctcttttctttcctgcatcataaatcctctcccagttttctattcctcccttaggtggtaaaccttcaaatttgaaaccttaaggtctggactaacaatgaatacaaatattctatttgtgataattatcatgtcttttctttctacacattactctcctcacctcttgtcccctgacaaagtgctcctagaaactgtcacaggacacttctgcttatatttctttaatcagaacttagttggatgggccgggcatggtggctcacgcctgtaatcccagcactttgggaggccgaggtgggtggatcacctgaggtcaggagtttgagaccagcctggccaatatggtgaaactctgtctctactaaaaatacaaagaattagccaggcatggtggcgggtgcctgtaatcccagctacttgggaggctgaggcaggagaatcgcttgaacctgggacgtggaggttgcggggagtcaagatcatgctattgcactccagcctgggcaacaagagtgaaactctgtctcaaaaataataataataataataattattattattattattattattattagtcagatgaccatacctagctgtaagaggagctgggaaacctaatctttttcctgggtgacaatgtgcccagctaaatattgggatttctattagtatggaaggatttgagataataggaacatggatagcaatctttgccacattctgcctgcaggagaaaatcaggaaattaattttcatgattcctaaacatgtagagccttccaccagattgtggcattttctctttagctgctggtcattaggaagcacctctgcaatctataaatgatgggctggttcctgtcagctaaatctctgcctgaaatacaagatgatcagggaaaggttcctaggtaccttgctggtcttgctcaaaccgaacacatgcataagttacagtggaggttaatgcagatctttaactgagagatcaagtagttgtcacaaataccatagagcaacacagagaagcagaatatagttgtcactctacctaacagacatgtgccattggaaaaaaaaaatctgactgcctcacaatcttaagcctttggaaagagtgtttgccatttctccctactctactgtgtcttcctcttgtcagccttccgcaagacccctctgaccagtgtgctccccctcttcctttccaatcctccaccactccacacaaatcctaatcatctctgactgttttcagatcttgcaagctctaggatctcatatttctgggaggctttcctctgccccagctttcccagagtggaaggaagatgagaaatgctctgtttctagtttgatccttttgcagagctaaataccaatttctttccaaagaaatataatttcacaaagagacttaatcctatttctggtgtaataaacatggcaataatgtggtaagaggcaattaattcttcatgcattcacttacataagggctgctagatttgctggtattttttttccgtgagctctaaatatattctttctgattcattcattaaacgaatactaattgagtgccacatgagtgtcaagcacttttctaggttcatgtcattcattagtgagcaaaaacctctaccctcatagagcttatttttatttttattttttgagacagagtttcactcttgttgcccaggctggagtgcaatggcgttatcttggttcactgcaacctccgtctcctgggttcaagcgattcttgtgcctcagcctcctgagtagctggcattacaggcatgtgccaccatgcccagctaatttttgtatttttagtagagacagggtttcaccgtgttggccaggctggtctcagactcctgacctcaggagatccgctggccttggcctcccaaagtgctgggattacaggcatgagccactgcgcccagccccctcatggagcttcaattccagattctggttgccaatctgtttgttgatcaaaggagaatggggcagagggatggtgtgcatcaaagtgcatggtgtgtaggagcattcaatgactacttgccagttaccccattggtggacagagtcttatatagaaaattgcctcactggtaaccaacttctgactgtcacaaaacccaactggagactgaataggctttcactattacaggtctggtggttattatctgcatgttaatggacagatgcccatgccagtggcactgatcaagtttccttacttttaggtataaaggacatcgtccagtgcttttcctgtggagggtgtttagagaaatggcaggaaggtgatgacccattagacgatcacaccagatgttttcccaagtgagtggaatgaatgttaaccatctgcaactttggatgcacttcaacagtttttttctttttcctcatttcctgccttattttatctttagattgagtctttatccactcctcggattcaggctatgaaggatgagtcttcatgtctttcatccctttgctccatgacccccttcctgtactagccttcccctctttatagttatggcatagttttggctagattcatatattcacattacatgtttacattatcatgactatacaaatgctatgtggagctgaagcttgtggtaaatttttatttatttttcccttcctgtatatccttttatttttttaggaagtaataactgtcctgttggtatgttagcttatttttttttcctgaggtaaaattcaggtagtaaccattttatttatttatttattattttttgtgacaggttctctctcttgcccaggttggagtgcagtggtgcaatcatggctcactgcagccttgacctctctggctcaagcaatcttcctcgctcagcctcccaagtagctgggactacaggcacatgtcttcacacccagctaatttttttttttttttttttaagagacagggtctctctatgttgcccaggctgctctcagacttctaggctcaagcagtcttcccatcctggcttcccaaagtgctgggattataggcgtgagccaccatgcacagcaattaaaccattttagagtacacaattctgtggcatttattatagtacattcacaatgttgtgcaaccaccccctctatctagttccaaaacactttcatcgcccccaaagaaaactctgtatccatcaagcaggcccccctcctctctccaccccactccatgcccagcccctgggatacaccaacctaattggtgtctatggatttatttgttctgactatttcctctaaatggaagcataccgtttgaccttttgcatttggattctttcacttggcatattgttttgaagtttatccatgttgtagcttgcataagtacttccttccttttgagaccaagtaatattccatatggatacactgcattttatttatccattcatctatttgtagatatttgggttgtttctaccttttggctaccatgagtaataccgataggaacatttgggtacaggtatctgatggagcatgtaactgtattcaagtctctggggcatatacctaacaacgatattgctagctgtatagtaattctatgtttttacttttttttttttttctcacacagagtctcactctgtcactcaggctggagtgcagcggtgcgatctcagctcactgcaacctccgcctcccaggttcaagcaattttcctgcctcagtctcctgagtagctgggattacaggtgtctgccaccatgcccgcctaattttttgtatttttagggtttcaccatgttggctaggctggtctcaaactcctgacctcaagtgatccacctggcttggcctcccaaagtgctggaattacaagcgtgagccacagcgcctggcctgttttaactttttgaggaaatgctaaactgttttttccacagtgcttgcaccattttaaattcccaccaacaacaatgttgtgcaaccaccccctctatctagttccaaaacactttcatcgcccccaaagaaaactctgtatccactaagcaggccctccttctctctccaccccactccatgcccagcccctgggatacaccaacctaattggtgtctatggatttatttgttctgactatttcctctaaatggaagcatacagtttgaccaacaatgtatgaggtttcccatttctcatcaacacttttctatttttaaaaaaattatagccatctgcttaatttttttttttttttttttttgagatggagtctcactttgtcgcccaggctggagtgtaatggcgtgatctcactcactgcaacctccgcctcctgggttcatgccattctcctgcctcagcctcccgagtagctgggactacaggcacctgccatcacgcccggctaatttattttttatttatttttttagtagagacggggtttcaccgtgttagccaggatggtctccatctcctgacctcgtgatccacccgcctcagcctcccaaagtgctctgattacaggcgtgagccaccgcgcccggccagccatctgcttaatttttatgtacattgcttatttttgtttcttgagataaaattcatgtattaataattttatttatttaaatgaaataaatgaagacgaacaccagctcatcttcaacttatcccaaatgtttaaatctcctcttaagtcattcagacctaccagatatctcatcattttcatttcttgaaagagtcatcattttttttttctttttcttttttttttgagacggagtctggctctgtcacccaggctggagtgcagtggcatgatctcggctcactgcagactctgcctcccaggttcaagcaattcttcctgcctcagcatcccaagtagctgggactacaggcatgcaccactatgcctggctaatttttgtatttttaatagagatggagttttgccacgttggccaggctagtttcaaactcctgacctcaagtgatccgcctgcctcagcctcccaaagtgctggtattacaggcgtgagccactgcggctggtccattttcatcttgaaatgagtttccctggaagtcttctggcctgctggattatgaacaacttgtcctataatcatcctgggatccagggatctttcttcacaggcatcctggagattatctcctctgttgtatctcctggatctaatgtcatcctcttcttggttcactcgctcattttgttggaacacttcatcggagttccctgggaaagactgcataagaaatacacacttttagttgcatataatgcatatacagacatatagatctatctagatatatgtttttcctgtattctcacacttatttgatagtttagctaggtgtagaattataggttggaagtcattttaattctaaattgtagaggcactgctacatttctactggttcctaatgtgctgtcgagaagttccatgcctttctgcttgtcaatccttttactgcaaacaaaatttttttttttcctgtgctggaagctttcagaaaaatatctgttctaaaattttatgaagaaatatttcttttctatgaatctttaaacttaatttttttttacccatcaaactctttagaaatgtttaattgcaagaagaaatttgtgttttcactatgtaattagtaagagttttttttttagaaatgaatatgaacacatacagattttaaaatgaatgcttcctgctcatttgtatagtggtaaaaacaaaaataaaacaaaatgaatacttctatctaattttattgccttgaaggtattttgatagcagtagttacctcatttttctttcttatttgggcttagtgtataataaattattgagaacaatggggacattctacttaattcttggaaggataagctaggatgcagtctagtcttatttagaacttactctggaatcgatcaactcccttttatactattattattattattagttttagtgttttgttgttgttgtttttgagatggagtctcactctgtcacccaggctggagtgcagtggcgtgatctcggctcactgcaacctccgcctcccgggttcaagcgattctcctgcctcagcctcccaagtagctgggattacaggtacctccccaccatgcctggctaattttttgtacttttagtagagacggggtttcaccatgttggccaggctggtcttgaactcctgacctcaagtgatcctcctgcctcagcctcccaaagtgctgggaatacaggtgtgagccgccacacctggcctttagtgtttttttgttaagagactgggtctcggctctgtcacccaggctggagcaagtgcagtggtacaatcctagctgactgtagcctcaaattcctgggctcaagtgatcctcccacctcagcctcccaagtagctaggactacaagcatgtgtcaccatgcccgactaattttttaaagtttttttttgtagagatggggtcttgctttgttgcccaggctggtctcaaactcctggctccaaatgatccttctgcttcagcctcccaaagtacttggattacaggcatgagccactgctcccagccaactcctttttggatttttactcttcctttgcctcttaaaaaaactgcaaaccagtatgtctccaaatgattacctaaaatttttatgtatgctttaaagaatgaataaaaagcaacctatgaacctcctagtaaagtcaagaaattggacattatcaatgccttaaaagacccctgcggccgggtgcagtgactcacgcctgtaatctcagcactttgggaggccgatgtgggcagattgtctgagctcaagagttcgagaccagcctgggcaacatggtgaaaccccatctctgttaaaaaacagaaaaatttaaccgggcctggtgacacacgcctgtagtcccagctattagggaggctgaggcaggagaatggcttgaacctgggaggcggaagttgcagtgagccaagatggcgccattgcactcctgggcgacagagcgtgactctgtctcaaaaaaaaaaaatcaaaaaacaaaaaacaactctgcatgccaaccaccccctaattctgattatatccctgtccctccaatccagaggtaaatgtgatgctcagtttgggttaattattcccttgcttctctttgtggttttaccaactacatatacatccttaaacatatttagctttgtctattcttgaagttcaaataagaagcatactgcatgattcttcttgtaattggctggttttactccacgatgtttttgagattcatccatatttatatgtactacacagttgtagttcacttgttttcattggtaaatagtgtattattttatgaatatataataacttattttactgttgattaacctcgtgggtcgttttcagagtgttgcaaattcaaataatgccctatgaacattcttgtacatattttccagtgctcatgtgtgtttctctaggatacataacaaagtaaagaattgcagagtcatagaactttgcgggtgttcaactccactagataatgcaaagctttttcccaagtggttgcactgatttacattcccattggcctagatgcgtttctattgatttgcttcctcactaacttggtattgcccaaattttaatttttgtcagtgtaattactaataatgttaagcttattttcttcttctttttttctttctttttttttttttgagacggagtttcactcttgttgcccaggctggagtgcaatggcacgatctcggctcaccacaacctccgcctcccaggttcaagtgattctcctgcctcagcctcccgagtagctgggattacaggcatgtgccaccacgcccagctaattttgtatttttagtagagatggggtttctccatgttggtcaggctggtctcggactcccaacctcaggtgatccacccacctcagcctcccaaagtgctgggattacaggtgtgagccaccgcgcctggcagttgagcttattttcatattttcctgcagaatagtcttgttctttctcttcaagagtgtgtcttagctatttttttgccctttggtctttcatattccagagaatatattaaatatcccaagcaggcatggtggttcacacctataatcccagcactttgggaggctgaggtgggaggagtgcacaaggcgaggagtttgagactagcctttgcaacatagctagactccatttctacaaaaaatttttaaaacaaacagggtgtggtagcatgcatctgtagtcccagctacctgggaggcagaggcaggagaatcgcttgagctcaggagtataggttgcaatgagctatgattgtgccactgtactgtggcctgggtgacagagtaaaactttgtctctaaaaaacagaaatatccctctttatccttgatagtattttttaggcctttattagttttttcatgttacatcttttagattattttctttttaatctatctgtgactatatttaaagtcaattcttgttttttccttttcctttttgtgggtaacggggtctcactatgttgcccaggcagatctcaaactcctgggctcaagctgtcctcccacctctgccaccctaagtgttgagattacaggcatgagccactgcacccagccttaaagtgaattgttataggcaacaacacagtggggtcttttattttattttttatttgtttatgagacagactcgctctgttgcctacgctggagtgcagtggtgcagtcttgactcactgcagcctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcctggccaggtcttgctttttaagagtctgacaataactgctttctaattggaatgtttagaacgtttaaatttaatgcaattatgaatatggttggatttaaacctattttaccatttgctttctatttatttcatcacttctttgtttctttttcttttcctgacttcctagggtttagggtttttttttttttcttttttctacccctccttgagtatttttttttgtactccattttatttctgtcagcttattagctattaatccttattttacctttttactacttgctctagagtttaccatatgcctatttaacatatcatagtaatcttcaaaaatattataacagctgggtgcagtggctcatgcctgtaatcccggtaatttgggaggctgaggcaggcagatcacttgaggtcaagagttccagagcaacctgggcaacatggtgaaaccccgtctctactaaaaatacaaaaaaattagctgggtgtggtggcgcacacctgtaatcccagctgcttgggaggctgaggcacgagaattgcttgaacccaggaagcagacgctgcagaaagctgagatcgtgccactgcactccagcctgggtgacacagtgagactctgggtcaaaaaaatatataacacttgacataaaatgtatgaaccatacaatagtatatttccatttctcccctctcatcctttgtgctattgtcatacattttatttccatgtactttaataaatcttacaatataatgttatatctttgctttaaacaatttaagtacatttttacaacggcaaaagtctttcatatttgccctcttagttatcttatcattcctggtacttttcattcctttgagtagaaccaaatttccatctgctatcattttccttttaaatgatgtgcttcctttcactttttttttttttttttttttttttgagatggagtcttgctctgtctcctaggctggagttcagcgccacgatctcggctgactgcaacctctgcctcccgggttcaagtgattctcctgcctcaacctcctgagtagctaggattacaggtgcccaccaccatgccaggctaatttttgtatttttagtagagatagagtttcaccatgttggccaggctggtcttgaactcctgacctcatgatctgcctgcctcagcctcccaaagtgctgggattacaggggtgaaccactgtgcctggtccctttcacattttttgtagtgcagttatgctggcaactgactttatttggcatttgtttgtatgaataagtttatattttaccttccttcatagttcttttccttgatgggcctattaaaatattttttttcttttgtaagccacttcaccccttccctatgggtttgtttttatttacctctacatggctgactttggacagaaacgttaaaagttctacttgttgttttcctgaagctatgcttctatttctggactcatcgccaagtcacctgaaggcaatacaaatgaagtatctgggccacatgcagtggctcacgcctgtaatcccagcactttgggaaactgaggtgggaggataccttgagcccagaaaaaaaaaaaattagcctggcatggtggcacgtgcctgtagtcccagttacttgggaggctgaggtgggaggatcacttgagcctgggagttggaggctacattgatccttggtcgtgtcactaccctcaagcctggacaaaagagtgagaccttgtctcaaaaaaaaaaaaaaaaaaaaaaaaaagtgtccctttgctttactcctgctctccagtgattctacagcatggaataggccactgacttactcacatgtatagttctcatctgtccattttaataattgcaactagagctctttttgaactttctctcttgttcttcaagcatacatcaaacctgagtttagagggtatttgcgtcctagtttcacgagattggcaagtagtttttagagagtatgtttgtggccattcttttcttttgatactgacggagggtttcttttttaattttttgtttgtttaagacagggtcttactctgtcacccaggctggagtgcagtgatgcaatcacggctcactgtagccccaacctcctggcctcaagtgatcttcttgcctcagcacccccaagtagctgggactatacatgcatgccaccctgctagctaatttttagaggaggtctctctatgttgcacaggttggtctggtcttgaacttctggcctcaagtgaaactcctactttggcttcccaaagtgctgggattacaggcatgagccattgcacctggcaatggagtggtttgtggttggttagttttttgtttgtttgtttgtttgtttttgagacagagtttcactcctgttgcccaggctagagtgcaatggtgcgatctcggcttacttcaacttctgcctcttgggttcaagcaattctcctgcctcagcctcccaagtcgctgggattacaggcgtccgccacaacgcccggctaatttttgtatttttagtagaggtgaggtttcaccatgttggtcaggttggtctcaaactcctgacctcaagtgatccacccgcctcagcctcccgaactgctgggattacaggcgtgagccaccatgcctggccttgtttgttttttgttttgttttgagacagagtctcactccattgcccagactagagtgcagtggcacaatctcagctcactgcaacctccgcctcccaggttcaagcgattcttgtgccccagcctcctaagtagctaggactacaggtgtgcgccaccactgcctggttaattttggaattttctttttaatagagacagggttttgccatgttggccaggctggtctcaaacttctggcctcaagtgatctgcccgcctcggcctcccaaagtgctgggattttgggtgtgaaccaccgcactcacagagtttttttctttttttaataaatttttatttgaaattatttagatttgcagaaagtgcaaagtaatacaaagagttcctatatattgccatacccaatttaccctaatgctaacatcttacactagcatatttgtcaaaatcatcagtgtaccaattcatatactgtacattactatttactaaaatccagagtttatttggatttcaccagtttttccactatgttgttttttgttccagaattcataaatagagggttttttttttcctatttttgattctttaagttcatttttgttggttgcatggaggagtgtcatatacgcactcattccaccaaattcccttgatatcctttaccgttactttataaaccatttacatttctcttgcagagagccacaacctaagtgccttacctgatgacactgacagagagaatcactggaaatgatagttttatacttaattcttgtcactaaaactctaatagtgtttttaaaaacctaatacaaggccaggcctggcggctcacacctatcatcccagcactttgggatgcctagggaggagaattgctcaaggccagaagtttgaaaccagaacagcctgggcaacatagtgagaccctgtctctgaaaaaacaaaacaaacaacaacagcaacaacaacaacaaaaatacctaacacaaatacttaaatgcatacaactatttttataacttttaacttttacacttagttgtccatttctccaaaatatgaagtcctctgcggaagtgactccagaccttcagagccgtggtgaactttgtgaattactggtaatgaacaccgtcatcttgtctgttttaccagcacatgatcatataattgaaaactgttttgaacaggaatgtctcatcataaataagttaataaattctacaaacatctactaaacatctgttatgttctaggtacagattggggaaatcacaataaaccagtcgggcacaatacctagcttcatgaaatgtatagtcaatctcttctacttcaaggcccagactctcttagactttgttgattagcatccaggctaaatggatcctctctggatcttcatgtggagggcaataaggctggatttgctacttggcctttttaggggttgagaagatgttactttaacaaaagcaagtgcccaacaaaatcataaacccaggtaataggctgaccactttaagctgagaaatcctacctagttctctgggatataagccactactaatttaatgcacacatataccaccttattttgaggctgtgtgttaggtatgttatgtttgtcatccccccacccccaacacacacaaaaaccaacttgctattcacgtgattcattttctatatgaattgaaaaatggcactaaagaaaaaagtttggggatatagaaatagcttattttttaaggaagaaacataacctttctaagtactggatgtgtaatattaaaaatgtagttaaccaaggacagaggctgcacctaatgacttttggaggaaccttcttgctcaagacactatgattctcgttacctggatagtatcacccatggattgtatcatatatgaaccactgaggaacacacattcctgcagatgtttgcagattattaattgctttatatttggagcacccctcccttcaatcagcataaatatttgagggtgggctgtgtttagaagatgtttagtctccaatgattacaacatgatgcaccactctcctatacaaattttgatttaagaaaagattttatttttcaaaggaaaccacaagtgaaagcaatcttgaagattcaatagcagttggtcctatagtgccaggtaagaactttgaagtagcacgtgggattatatgtatttgtaaatatatttgtatacagggcagttgcaaaaaaaagagtatttataattgtccaaagagcttccaaagaggagcagcattgcaacagtgtcgtgtatgagcaaaagtcaagattcttgtggcttctccagagtgcaggcaggaccaaactgatagtaggcaacgtgtctcaggtacaagcaaaccagtccttagaagcaccaatcagtaaacttctttcctgagatttttatttttattcattttattttattttattttatttgagacagggtcttactttgtcacccaggctggaatgcaatggcaagatcatggctcactgcagcgtcgacctcccaggctcaagtgatcctcccatctcagcctccccagtagctgggaccacaagcatgtgccaccacacctggctaatttttgtattttttgtagagacagggttttgccatgttggccaggctggtcttgaactcctaggctcaagcaattcgcctgcctcggtctcccacagtgctgggattacaggcatgagtcactttgcctggcctctttcctgagatgcatggtgcttatgataagcacacattatgtctaggtccctgcttcaagtgtggcactttggacacatgctttccacattccgattttgtgccaaaacctatgagatgattgcaatgtgggaatcatggatggctgtggaaaatcctaacacattcgtagtagacaggcagaatcatggaatgaaaaggcatggcgttcagactgagggagatgtgactatgaatccctgttgtgcccccctttctttctctccacagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaaggtatacctgtatatattttggatgactattctgatgtataatttctttttcttactttaagtggttgaaaacttctgaggccatgaaagcatgcatgctcattgatagaacagatataaaataaaccttcactaattttttttgacagtagcatgaattagtgaaaagtccttgaataatagaatggttttcaaataactcagacaaaatgaataaaatatttatattaaattattgaaggttcttaataaagacatgaattatctgttattagtaaaagaattagctatatgtaagatgatgcttagaaattaccttcaccctagctgcctaaaggaagaaaggcctgtagtccctgggaaataaataaattaatgggaaataatatcttcatctatttgtgtcttaactcctctaagcactatttgatagttttcagtgtagacttaacccatctttcattaaatttattcctagatactcatatcttttgaaagtattgtaaatgtcattaaaaatattttttcattttctaattgttgctagtattgctttggtcttaagcagtttgactgttatatgcctaggtgtgctttgctttgtatgtatcttgcttgaggtgcactgaacttttttggaatgtgtgggttgacatttaccaaatttagaaaatttttcatcttttttcaagtactgttttattatggtaaaatacatgtaacaaagcttacattttaatcattttaagtgtacaactcagtggcattaagcattcactatgttgtacaaccatcaccactatccatctccagaaccttttcatcatcccaattaaacaataaattgggccgggcgcgggggctcacgcctgtaatcccagcactttgggaggccgaagagggtggatcgccagagctcaggagtttgagaccaccctgggcaacatggtgaaaccacatctctactaaaatacaaaaaattagctgggcgtggtggcatgcgcctgtagtcccagctattcgggaggctgaggcatgagaatcacttaagcctgggaggcagaggttgcagtgagcccagatcatgccactgcactccagcttgggctaccgagtgagactccgtctcaaaaaaaaaaaaaaaaaaaaaaaatcttccctcccaccagcccctgataacttctcttctattttctgtctctatgaatttgcctcttctagatattgtttataagcattatcacttgtctggcttatttcactttgcatactgttcaaggtacatcatgttgtagcctatattggaatttcattccttcacatgtactccataaatatgtacaattattatgtatcaactttgaaaaggaacttcatcctttttatagctaatattccatggtatgtatatagtacattttgtttatccattctgctgctgagagacacttgggttgtttctaccttctggctatcataaataatgctgcaatgaacactggcattataagtatcggtttaagttcttgcttttaatcattttgggtatatacctagaagcagaattgctgattcatatggtagttctatgtttaactttttgaggaacttgcacagtagctgcaccatcttacattcccactatccatgtacaaaggttccaattactccacatcctcttcagcacttgttaatttttgtttttgtggagacagagtctaattctgtcacccaggctggagtgcagtggcgagatcttggctcactgcaacctccacctctcgggttcaagcaattctcctgtctcagcctcctgagtagctgggactacaggtgtgcaccaccatacctggctaacttttgtatttttagtagagatggggtttcgccatgttgcccaagccggtctcgaactcctgagctcaggcagtccagccaccttggcctcccgaagtgctaggattacaggcatgagccacagtgcccgacctgtttttgttttcattgttgtttttcagacagtgtcttgctctattgcccaagctggagtgctgtggtgcaatcatggctcactgcagcctcaacctcttgagctcaggtgatcctcctgcctcagcctcctgagtagctgagactaccagcatgcaccaccgtgcctggataattttttattttttgtagagacagattcttgctatgttgcctagtctggtcttttttctttttctttcttttttttttttgagatggagcctcgctctgtcccccaggctggagtgcagtggcgcaatctcggctcactgcaagctctgcctcctgggttcacgccattctcttgcctcagcctcccaagtagctgggattacaagctcccgccaccacacccagctaatttttgtatttttagtagagatggggtttcaccatgttggccaggctggtcttgaactcctgacctcaggtgatccacccacctcggcctcccaaagtgctgggattacaggcatgagccaccgtgcctggcccctagtctggtcttgaactcctgggctcaaatgatccacccaccttggccttccaaagtgctgggattacaggtatgagccacctcacccagcccattttgttttgtgattatcataaagccattctagtagttgtgaagtggtatctcattgtggttttgatttgcatttctctaatgcaaatcatgaaaatgatgttaagtatcttttcactttttgaaaaaatatgtttgctcatttaaaaattgttgttgtttttgttgcattgtaagagttatttgtatattctggatttcaacctgttatcagatacacagtttgaaaatatttttcccattccataggttgtcattttactttatttataatgtcctttgtgcacgaaagttttaaattttgacgaagtccaatttatctgtttttttcttttattgctggtccttttggtgtcctatctaagaatccattgccaaatccaaggtcatgaagattaactcctatgttttttctaagagttgtgtgatttcagcttttatatttaggtcgttgatccattttgagttgattttttttacatggtgagggataggaatccaacttcattctttcgcatgtgcaaatccagttgtccccaaccgtttgttgaagagatgctatatttcttttctcttcttttttttttttttttttttttttgagacggagtctcacactgtagcctgggctggagtgcaatggcgcgatcttggctcactgcaacctccgtctcccaggtttatgtgattctcctgcctcagcctcctgagtagctgggattacagatgcacaccaccatacccagctaattttttttttgtatttttagtagagacggggtttcactatgttggccagactggtctcaaactcctgacctcgtgatccgcccgcctcagcctcccaaagtgctgggattacaggcatgagccactgcgcctagccgagatgctgtatttctttttgtgagtctgaagagtagcacagggcttcccatacagtgcataagctgcaaaaagcaatatcttcatatatgtattctttaaaaaaaaaaaagaatgttttatggtatgtggaaggtttgcatgtgaaaatagctggatgaatcaaaatgacagttttaaaatgtccattcagaactctttagattaataatgggaaactgtgctgctttccagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactaggtaaggatggcactttaatatacttgtttttacgtaagttggaaaagctacttggccaataatttatttaagagttaaagtgcctgtggttctaagggtgtagcctgtatccatggtaaattgtgaggaatagcactctttctcattaagaaagcagagtgctgtttgtaattattgagcctttactacacactaggaagtatcctaagcacttcacaaatatgaactcagtcttcatacccactctatgaagtactattattattattattattattattattttttttttttttgagacagtctcccgctgtcgcccaggctggagtgcagtggcacgatctcggctcactgcaagctcctcctctcaggttcaccattctcctgcctcagcctcccaagtagctgggactacaggtgcctgccaccacgcccagctaattttttgtatttttagtagagacggcgtttcaccgtgttagccaggatggtctcgatctcctgacctcatgatcttcccgcctcggcctcccaaagtgctgggattacaggcatgagccaccgtgcctggccaaagtaaagtactattattaatgctattttgtagctgggaaaactgagacataaagagataaagtaattcgtaatatccagctaaggaaatgtatatctgtgactcaaatacaggaattttgactccaaaatctgagttcttaatccctaatataggccgggcctggtgactcacacctgtaatcccagcactttgggaggccgagaagggcagatcacctgaggtcaggagttcgagaccagcctgaccaacatggtgaaaccctgcctctactaaaaatgcaaaaatttgctggcatggtggcatatgcctgtaatcccagctacttgagaggctgaagcaggagaattacctgaacctgggaggcagagattgcaatgtgagccgagatcgcgccattgtactccagcctggggaacaagagtaaaactccatggggaacaagagcaaaactccatggggaacgagagcaaaactccatctcagaaaaaaaaaaaaaaaaagaaagaaatccctaatataatgttgccactccaaaataatttgtagggttattttattttgtttttggttaggctggtcttacattgcaacttacagatctggcagctcagcaggaaggaaatctgctaatctgtagtcattggaagtatttccctgtttctcaccagcctatcctaatagttcatggaaaatggtgcagccatctttcttaaatacatcatttagctaaatgacttaggcaccatcattccttaacttagtaaacactgaacactaaagattgaagaaatatacaactctatggaattgacataaagacttgcatgcaaaagcttcattgttggccaggcacagtgactcacacctgtaatcttagcactttgggtggccgaggcgggaggatcgcctgagagcaggagttcagcaccaggctgggcaatatagcaagacatcgtctctactaaaaaaataaaaaattagccaagtatgatggtgtgcacctatagtccccagctactcaggaggctggtaggatcacttgagtccagaagttcaagcttgcaataagctatgatcatgccactgcactccagcctaggtgatagagcaagaccctgtctcaaaaaaaaaaaaaaaaaaaatatatatatatatatatatgtgtgtgtgtgtgtgtgtgtgcatacatatatacaccgaagctggaggtggtagttatatttgtcagcaaattttgcaacaaatttaggttttgcttcagagttgtcattccttttatgtttcttttttttttttgagacagagtctcaatctgtcacccaggctggagtgcagtggcaccgttgtcagctcactgcaacctccgtctcctgggttcaagcaattctcctgcctcagcctcccaagtagctgggattacaggcacccatcaccatgcccggctaattttttaatatttttagtagagacggggtttcaccatgttggccaggccagtctcaaactcctgacctcaggtgatccgcccacctcagcctcccaaagtactaggattacaggcgtgagccactatgcccagctgtttctttgtatagtattcttttttttttttttttttttttttttggagatgcagtcttgctctgttgcccaggctggagtttggtggcgcaatatccactcactgcaacctctgcctcctgggttcaagcgattctcctgcctcggcctcccgagtagctgggattacagctgcctgccacccacgcctggcaaatgtttgtatttttagtagagacagggtttcaccatgttggccaggctggtctcgagctcctgagctcagatgatccacctgcctcggcctcccaaagtgctgggattacaggcatgagccacagcacctggcctctttgtattcttattgtgtaaatgtcatgtacaaacttagagttattaggtgttaaagctgaaggtgatgctactgagtcaatgcttgtattttatagaagagaaaactgttacccagagagggtcaataatgtgtcaaaattcacattacttgctagttgcagaacctgaacccaagcccagtgacctgattcttagatcatgagatcgtggtacctggttttaattaagtattattgaaacaaaataataaactacttggctaattttgatagaaatttgcagtattttctaatttctgaaaatccttgatcttttacagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttggtaagagttataatattacaatggtggtttaaaatgtttctatggacacagagtcatattaagcactctttaaaaagggccatattttgaggctgggtgtggtggctcatgcctgtaatcccagcactttgggaagctgaggcaggaggcttgcttgaggtcaggggtttgagaccagtctgggcaacataacaagccctccacctctaaaaagctttaaaaaaatcagtcgggcacagtggtacctatagtcccagctactagggaagctaaggcaggaagattacttgagcccagaaggttgaagctgcagcgagctgtgatggtatcactgcactccagcctgggtgacacagaccttgtctctttaaaaaaagaaagaaagaaaagaaaaattgtttctcaaataataaagtataggtgtttccagaattttcttttttacctttacgctcagttggatttgaaatttctagaattttaacaacatttctagttatcagaattattttctgagcaaaaatttgttttatctacttagtcatatgaattcaatctgaattattacattaatttctaatttcttcattttaaagatgttacactttgctgtgagagatgtagctgacataactaaatttttattttccctttcatagttgccagtttgccaaattttatttctctgaagatattaaatcttgaaggccagcaatttcctgatgaggaaacatcagaaaaatttggtatgtttacaaaatagtgctttttacgtattcttattctctttctgcccagaatcctttttctcctattctgaattagccacaaggaagcaagatatgcattagctacccttgcttaccagaacgaagtgatagtcatgctcaacttctacccaccaaatgccttcactacagttttacctgcagacttgatctcattcaaagcagaatgacttcttagagtacatatttggtcattatagcactatgcaatataattgtcaggtatctgttccaaatataagacctcatagtttcaaaggttactagaatataggtaaaaatctatcttttaaggttaggaaaactcaatacgtgaaaacgtgtatttcataaaatgatagctatagaatttaaatactttttgatttttaaaaaacgattatgaaagtaatgtatgctcatggaaaacattctaacaggaaaaaaaaaaaataaagggaggcagtggagatagggactgtagagctgtgctattcaaagtgcttctcaaacataagcgtacataaagattgccaggatcctcctcttcccttccttggaggcagctaggtgggtgggggctgaggtggcagaggtaggatcagggccaaggggatggctggcatacatcataggttgattaagcaaataatacagtgagtatagccagatgcagtggctcacacctgtaatcccagcactttgggaggccgaggtgggtggatcacctgaggtcaggagttcaagaccagcctggccaacatggtgaaaccccatctctactaaaaaatacaaaaatttgctgggcgtggtggcacatgcctgtagtcccagctacttgggaggctgaggcaggagaatctctcgaacctcggaggcagagattgcagtgagccaagatcaggtcactgtactccagcctgggtggcagagcaagactctgtctcaaaaacaaacaaacgaacaaaacagtgagtataatgagagccacgtttcctcacagttggaaaaggaacttacaaatattgaaaggtgaggctagaaagagctttgaggtgttggattagaattggaaatattggtctggcctcatggttttttctaacctatgaacatacatagagatctccatatatatacattgatctccacatgtctatagatacacacatacatatttctcagctcaatggagagactagaaggcactgcagtaataatgaacacaccaagtgcctagatactgatttctaaatcctgtccttccgtaaaggaaccagggtccttgcaaaattggctgattcaagaactgagacagggaaagaaaatgataagcctgggacattgatttatgctagaaattattcaatatatttccatgtgtgaggcctcagaagttacctttctaatgatcaaatgatctatcgtgtgccatgctaggaaggagtcgaagtgaaaaggaaggttctaagagtggtggactgtgaggctttagggccaggaggccggtgcagaatcactgagcatgacagcgggaggtggaatgggaaaggaggtggctgaaggcattgcagagctgggaaaggaacctgcaggtcaggaaaagcttcattctaaacgaggaatggagatttaattggcagcctggactttagtgcaggagagattggttggtagggtgtggtggaggaattgtctggaggagcgaggaagacggaagcatgtgctggcccttctcttgcttcctggactgtgcatgatgtttagaccatacatgattttcagattactgttgcataggaacaaaaagtacaaagagaatagctttttggtcttttctgacagcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattggtgagctagtgtttcagcttgcatggaagccagtggtatagccaagctttctgctgcaacatgtctatgtaaacatttgcccctctagaaattttcaacccgcttcctcattttcactatcatactgttccttctagtgtccttctgtggatttaggcgcattctggtcagatttggaagtacaaaaaggtctcccatttgtggatatacaagccctcaaatctgcgttcttgccacctggtgttttagacacctggccacatactctcctaagtactcctttttaaaactgaagatgaatatacacacagaaaagtacaaaaatcatgtgtactgctcactgaattttattttcttattttcttcttttttttttttttgagacagagtttcgctcgtgttgcccaggctggagtacaatggcacgatctcgggtcactgcaaactctgcctcctgggttcaagcgattctcctgcctcagcctcccaagtagctaggattacaggtgaacgccaccacacctggctaattttgtatttttagtaaacacagggtttcaccatgttggccaggctagtctcgaactcctgacctcaagtgagccacagtgcctggcctgaggaactgagatttctgtcgagacctgaagggagaatggcccaggcatagttggtagaggaggaattgagacatcatttcaaacagaggtaatcacttgtgtcatagcctggagttaaagagaaccagatatatttgaagaacttgggggaaaaaaaggaatgtctggagcaagaggcaggagtgagttgtgagaagaagactggagaggaaagtaaaagcccaattggagaggctttgtcgggtgtgttacaagggctggatctcattttcttactgctcagcactgttattttacgttatttaaaacagctgggagcggtggctcaagcttgtaatcccagcactttgggaggccgaggcggatggatcacgaggtcaggagatcgagaccatcctggctaacatggtgaaaccccgtctctactaaaaatacaaaaaattagccaggcgtgatggcgggcacctgtagtcccagctactcgggaggctgaggcaggagaatggtgtgaacccgggaggtggagcttgaagtgagccaagatcatgccactgcactccagcctgggcaacagaacgagactccgtctcaaaaaaaaaaaacaaaaaacaaaaaacaatgacaacttacaacctttttcttaaaggccttgtttcttcctccttatgaggaagaatttaataacattaaattttgtggtctctctcatcctcatttactataaattatttgtgttttattcttctcactacattaggtcaaagccttccttagaacttcaatctcacacacagatttgagccagtaacccctgtcgctctccctcctgagagcaggtgttttctcttcccggcgcccagcagagtatgcctggcctatagtgggaactcagtaaatatttgttgactgaataaagaaaacttacttttctgtagcttcttctgatggacagctgagaggccattgtttgcctatagtcagtaatgcttaaactttacctgtaggagacagcattcagacacatcacagaaccggctaatcacacaatatgaagtgggagttatgctgaaacaggggaaagaagggaatggatgtgaaagacctgagtctttcttcaagtccctccagaagtgtctttcatgtgggggaatgagaaatatctcttgaatgttactgaagatacctattcaggacatagctgaagacattttctcagtacctctgttgtttaacctcagtcaagctacagccatggattctagattgaaaccaaacttaacctttgcccaagttagaaaaaaaaagaggtttagcaattaaaaacaaggctgggcatggtggctcatgcctgtaatcccaacacgttgggaggccaagatagaaggactgcttgaggccaggagtttgagacaagattgggcaacatagcaagaccttgtctccataaaaaattgaaaaattagccaagcacggtggctagtcctgagtagctaggactcaggaggctgaggcgggaggattgcttgagcccagaaattctaggctgcagtgagttataactgaaccattgcactccagcctaggcaaccaagtgacaccctgtctcaaaaaaaaaaaattttttttttttaaaaacccctaaaccaaacaacaagaactctgcttggtacccattccaaagtctagtcagcctgtgttcattgagaacacagggtgtgcccggcttccatttccttcagagcccttagtctcaaaaacaggagggtcccttctgggcaacagaaatagggcatagcagtggacagtcggatgacatggctttaggaatgtcacacccccttctctataaaaggggaagacataattgctacactctttgaagtcccttgtaatttagtctggattttttttttttgttttctctttttgttttttagacggagtcttgctctgtcacccaggctggagtgcagtggtgggattttggctcactgcaacctctacctcccaggttcaagctgattctcctgcctcagcctcccgagtagctgggattacaggcatgtaccaccatatccggctgattcttgtatttttagtagagatggggtttcaccatgttggccagcctggtctcgaactcctgacttcaagtgatctacccacctcggcctcccaaaatgctgggattacaagcgtgagccactgtgacttgccaatttagtctggtttgtaggcatgatgtgccttggcatgtgacctcctgtgagaccaaaagagaagctcatatttgtccaggatggtgaaactctcagcacaatggcgtcagtgctttaggcttggctgtacttctttggtttctgcttctcccttagatttttgccaggtggttctttattaacccatcagctctttggggtttttaaggagatattttcaaaatattatattaagctgggcacagtgacacgtgcttgtaatcccacctacttgggaagctgaggcaggaggatcacttgagtccaggagtttgagaccagcctgtgatggccaggcgcggtggctcacgcctgtaatcccagcactttgggaggccaaggcgggtggatcacaaggtcaggagatcgagaccatcctggctaacacagtgaaaccccgtctctactaaaaatacaaaaaattagctgggcatggtggcgggcgcctgtagtcccagctactcgggaggctgaggcaggagaatggcatgaacctgggaggcggaggttgcagtgagctgagatcatgccactgcactgcagcctgggtaacagagcgagactccatctcaaaaaaaaaaaaaaaaaaaaaaaaagaaagaaagaaaaagagaccagcctgtgttaacatagcaagaccccatttcaaaaaacaaaattatattgagtacttcctactagcagtagtggtgggagaggaggctggttcaaataaccttgtctaccattattgaaatggaagtccttatgattctattttcatgaatgttttgttcttgtagccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 39 - DNA, 1162 bp, Homo sapiens
tgaaaagccatctttgcattgttcctccttgctcgccgcagccgcctccgccgcgcgcctcctccgccgccgcggactgcggcagctttatcgccagagtccctgaactctcgctttctttttaatcccctgcatcggatcaccggcgtgccccaccatgtcagacgcagccgtagacgccagctccgaaatcaccatcaaggacttaaaggagaagaaggaagttgtggaagaggcagaaaatggaagagacgcccctgctaacgggaatgctaatgaggaaaatggggagcaggaagctgacagtgaagtagatgaagaagaggaagaaggtggggaggaagaggaggaggaagaagaaggtgatggtgaggaagaggatggagatgaagatgaggaagctgagtcacctacgggcaagcgggcagctgaagatgatgaggatgacgatgtcgataccaagaagcagaagaccgacgaggatgactagacagcaaaaaaggaaaagttaaactaaaaaaaaaggccgccgtgacctattcaccctccacttcccgtctcagaatctaaacgtggtcaccttcaagtagagaggcccgcctgcccaccgtgggcagtgccacccacagatgatacgcgctctccaccacccaacccaaaccatgagaatttgcaacaggggaggaaaaaagaaccaaaacttccaaggccatgctttttttcttaaaagtactttaaaaaggaaatttgtttgtattttttatttacattttatatttttatacatattgttagggtcagccatttttaatgatctcggatgaccaaaccagccttgggagcgttctgtcctacttctgactttacttgtggtgtgaccatgttcattataatctcaaaggagaaaaaaaccttgtaaaaaaagcaaaaatgacaacagaaaaacaatcttattctgagcattccagtaacttttttgtgtatgtacttagctgtactataaggagttggtttgtatgagatggttaaaaaggccaaagataaaaggtttattttttttccttttttgtctatgaagttgctgtttattttttttggcctgtttgatgtatgtgtgaaacaatgttgtccaacaataaacaggaattttattttgctgagt

SEQ ID NO: 40 - DNA, 1426 bp, Homo sapiens
atggctaaaggtgaccccaagaaaccacagggcaagatgtctgcttatgccttctctgtgcagacatgctgcagtgggataattaaggaatcagaaagactgaggggttgaggaggaattatttaattatttaggtgcaccgacccagtcggattaacatccaaaggactgagccatgaacaaagagtcaagctaccttttaagcattttgtggggcggtgggagatctgtgcagggggaagcatattacagaagcaagaaacaaagacagttatttaattaagacatgcattacatcatttcttactttccaaggaacaacatgttttacgacttgagattatctgcctagtgaccttgcagctacacagctagagaaacagagtcttcacaatgcctgggaaagggagagataaggctcactagccacagaaaaacaggcagtcaatttttaaaggacttcagctttttttctttctcagggagaattgggttttcttacatacaactgagtttttgcttacacattctttaatttcttttttttttcttttgagacggagtttcgctcttgttgcccaggctagagtgcaaaggtgcgatctcggctcacagcaacctccgcctcccaggttcaagccattctcctgcctcagcctctggagtagctgggattacaggcatgcaccaccacacctggctaattttttgtatttttagtagagacagggtttctctatgttggtcaggctggtcttgaactctggacctcaggtgatccgcctgccttggcctcccaaattactgggattacaggcgtgagccactgcgcccggcctctttaatttcttttaattcctgttccaatgcagagaagaacataagaagaaaaacccagaagtccctgtcaattttgcagaattttccaagaaatgctctgggaggtggaagacaatgtccagtaaagagaaatttaaatttggtgaaatggcaaaggcggatgaagtgtgctatgatcgggaaatgaaggattatggaccagctaagggaggcaagaagaaggatcctaatgcccccaaaaggccaccatctggattcttcctgttctgttcagaattccgccccaagatcaaatccacaaaccccggcatctctattggagacgtggcaaaaaagttgggtgagatgtggaataacttaaatgacagtgaaaagcagccttacgtcactaaggcggcaaagctgaaggagaagtatgagaaggatgttgttgactgtaagttgaaaggaaagttttatggcgcaaagcgtcctgctaaagttgcccggaaaaaggtggaagaggaagatgaagaagacgaggaggaagaagagaaggagaaggacgaggaggatgaacaaagaaactgtttatctgtctccttgt

SEQ ID NO: 41 - DNA, 10632 bp, Homo sapiens
agggcagggctgcctcccacggcaggggcaggcagaggcctctgcgccaggtacagcctaggtaccgcctacccccatggctgaccctgggccccaaatccagcgggaggcctgggagcatcttctccgcctgagtcaccgggctgggcccaggaccccagccaagggctttgcctctgggaagaaaagagctttggagtccagcaaaacctgggaagcagggggaagcttccctagcaggtgctatttgagcagaggcctggaggaggtgaggaagtgagcagcgggccgtgtggggtaatgggtgctccaggaaaccagaacggcagatgcgaggttctgaggtggagcctggagtgtcggagcaacaacaaggagactgtcgtagggatgaggccttggggaggaggaacagagagcagagaggacctggggcatgtcccacagtggatgagccacgggaaggactttggcttttcctctaagcaaggtgagagctgtgggaagtttccaggcagagaagggacgagatctgacttagattctcacgggatctctctggctgcatgtggggaatggattggaggtggaggattcaggacagaagccaggaaaccagggaggaggagaccacaatagtccaggtaagccatgcagggtctggaccagggtggggaccgtggaggtgagagaagaggtggaattctgggagttcctctgcacgtcagccaacccgcccttcttgggtgcctactgtgtgtgagttctgtacagcaacatgatacagagatcacaaaggctgagcccttgcccacagtgtaggagacaggaggaaaaggaatgcaactgtgatgtgatcagtgtcagactgaagtgtgaatgaagggcagctacatctccccaggttctgtcctaaaactttctatgtaggagctcaacctagtgagataagagctatcataagcccccattttccagataaggaaactgaggccctcttagtcaaacaatatgtctaagttaagagactcctcccactagtaagtggcaagactgggattcacaaccgggtctgaagggctgcaggactgaccccgcctgaccacctgtgtaatcaggaagggcttcccgtagaggtgaggcttgagctgggttcccagggatgcataggattccgtcagtgagcagagggccttccaggcctgagcaaggtataagccaatgtgtgttcaagacacacaagccccacgtggagtttctccctccccttggcatcacagggaggacgaaagggagctggaaagcctcacctacagtgttaactgatggaatttcacgccgggtccctgtaccttgcagctacctctggccccatccatggtcccaggctcacgatgggtgagaatcatccccttagccactgtctcccacacgtcacttaaaagccatctttaaagccattcataccttttcttaagtaaattgattttttggtttactccactggttttttaaaaaaataacttactgagacgaagttcacatagcatcatattaagcattttaaagtgaacatttcggtggcatttttgcattgtgttctgcaaccatcacctctagctaatcacaaaacattttcatcaccccaaaaggagaccctgtgaccataaagcagccgctccccattcccctaacaaccaccattcttcactggtctcaatggatgtacctattttggagatttcctggaaagggaatcatacaatatgtgaccttctggccaggcatggtggcccacgcctgtagtcccagcactttgggagactgaggcggaaggatttcttcagcccaggagtttgagaccagcctgtgcaaaatagggagaccctgcctctacaaaaaatacaaaaattagccaggtgtggtggcacgcacctgtagtaccagctactggggaggctgaggtgagagaatcattgagcctgggaggcagatgttgcaatgagccgagatcacaccactgcactccagcctgggcaacagagcaagaacctgtctcaaaaaaaaaaaaaaaaaaaaaaaaagacctctgtgtctggcttttttcacttagcatcatgttttggaggttcattctcattgtaatatggattagaaaaaattattttaaaaggaaaatttgtgttactatcagaaggaggaaacaacttttcatttctgtaaagagaaagtaaccttaaaacaacaatcacaaaagaacgttaccaaattcttgctccattctcctgcctgctgaaggccctgagcttaaggccagctctgcctcataaagggagacgagcaaacgtgggagaggtattcaagtccagccgcgcccgcctgagactttctccttgggttaatcagaagaatcaaagagaagtgcaaaaggaggaatggtgacaactgtggtctaacccatcttgcgtgggaggctctgatatttccagagcagagcgggggtgagtgcagctcatgacagtgagtgtccctggtgccatggctggtaggttagaggggagggctgcagatggggagcctgttggaagcttcttcaccagcccagacataacataatccagagaatcccatgcctgccaatctcttcccttttctaaatcctttcacatctatgagtggaggtaggccaggtgatagccgggttaattcctggatgctattctgttcccgtgatgtatttgtccacttagatgccaataccaaactgttttatttctatgcctttgtcatatattctaatgtctggacggacaagtcctctctcttagttcttctttcagcattgctttgactatttttgcacatttactcttttatgtgacttgagaacatccccttttaacagacaggcccagagatgttaagggacaaaccccaagtcacacagggcttctgcctccaagcctcatggcccatttccaggactcccaggggtcctgggcagtgttaggagtgagcatgagcctggcatgctgggaggaaagggagagtgttttcaccgccccaaacacgccattcttgtgggtcgtgaagaacactgtttgcctattaaaggctttggacgccttgaaaaatagcagcatttgccatgttcacatttcacctgcaggtattacctactctttccatcaattcgctttttaaatgtttgcgaaaacttaattttaaatgaactcattttatcctggctttaaatgaggaaccagtgttgactgtgaggcctttgttgtctgtgccctgcccatacctcctctcccttttctccggtgaacacagacaggattccacctgcagcacctgtccccttcacctgtgagctttgctcatggggcaggctggatgtgctgggaactaacactccaagcggcagctgtcaagcaatgataggcaggagctgacatgtcccttccccagctccctgaccacccgatctccgcccctggggggctaactccgttactacatgggctcccagcgtgccacagcaggaccgagccccagctgcctaagtggttactggcttggtagcgctcttgagattggcagcccttcctccctgatctcacttccctaccagtgctttctggaggcatctcccaaataggctacttgccttcagtttattctgttaaggtctgcttgcaggcacccaatctaaggcacttgctgcaaatggaagacaattggtgaaatatacaaaaaagtgaaacaaagccagctactattgccgatgacggcttgtacttgggatctgctctgtttcttccgaagaaaaagcaggtggtaggaaggtgctcaagacacacaagccccacgtggagtttctccctccccttggcatcacagggaggacgaaagggagctggaaagcctcacttacagtgttaactgatggaatttcacgccgggtccctataccttgcagttacctttagccccatccatggccccaggctcacgaggtcctgagaacaactttccacaggccaactccaaggacaatggaaagtcccttagcctgggcagctgacaagacacaggcctggctggacccagtgggcatccctcagtacccacccaggaggggcccacaggacaactagcctgacgcatgggcagatagatgggttcaactttgccgtgagtgcatctggagaagggagagctcatgagctcattcattcattcactcatagattcaacaaattctgattgagtaccgactgtgtgctgaacactgtgctaggcactggggagatagagagaaggacagacccaaatccctcatggaactgccactccaacaggggacacggcgagaaacaaacaaacacacaaataaactcggaaatgagagcattccatgctacaaaggacagaaacagaatgaagggatcaaaaatacatggggtgtctgagcacagtggctcacgcctgtaatcctagcacttggagggccgaggtgggaggattgtttgagctcaggagtttgagaccagcctgagctacatactgagctcagtgagtgagtatatccctactttaaaaatatatgtatatagctgggcatgatggcacacacctgtagtctcagctattcaggaggctgaggcaggaggatcacttgagcctgggagatggaggctgcagtgagctatgattataccactgcactccagcctaggtgacagagtaagaccctgtctcaaaaaaaaaaaaaaaaaaaaaaaaaaaaagaggagagagggctttggtagcatagcctagagagcctctgaggagggtcagtgaagttcagaactgaatgtggagagctagagaaggcaaagaactagggaagagctagtgcaaaggcccaggggtgggaatgagctgggcatgttggaggggcaaacactggctggtgtgctggagtggaggaacaggggaatggtggtaagaggccaaggtgaaagtggtggtcctggggcaggtcagaacaaagatgcctggtaagtgtctgtgtgaatactgtgtcttgcaggaaaggcatccatgggcactggatgggaagcaaatagcagaggctgaaggcagtgggtttgggaggctttttctcttggtatctttatgtgggaggggaggccaaggggagagactttggtttgcttggggtcagccagactgcagcagggaaggtcctcaggccccttcatcaggcctggctagtttcaaccaattgaatcagcaactggtcttcagcacctcatcatagcttgtactatgtgagaggctatttattgagatatctatgcaccaagctctctacaaccctaccagaggctgcccgacatgccccttgcctgggagatacagaaatagaaatttgcagtagagtgtgacaaacattccagggaaggtctggatgaaggaagggtcattcaaattggcttttgaaagatgaagagagactcactggagaaaaaccagcattaaaagagcaaacaactatctcgcttggtgctgtgtccccagcacctggctcagagcctggtggacagtgggggctccatcagtatttgttgacgaacgaatcggagctgcccacactttggttatgcaaattggaaactgccttcacgatttttatgctgtctactgtccacttctactattccttatttaatgtgtttcttcaaatttactgacgtttttacttaaataaattcattttaaaagaaaacatttggtgttatcactaaaattgaaaaaccaaagaatacatgccacaaatcaaagataaccagaaaaatacttaaaaagaaaacaaaacgatgttattaaagtctacctattgaaagaataaaaagacaagccacagaacaggagaaaatatttgcaaatcacatatttcacaaaggcttgactagtatccagaatatatataaagaactctccaaatctattaagaagaaaacaattgggtctttttttttaactgacataaagtttgaacagatactacaccaaagaaaatatacggatggcaaagaaacacatacaaagatgttcaacatcattagtcattagggaaatgcaaactaacaccacaatgagatactattatcacctatttgaatgactaaaagtaaaacacatgtacacacacaaaaaactaacaccaccaagtgctggtgagaatacgaagcaactgacactttcatacattgctggtagggatgaaaaatggtacagacaccttggaaaacagctcagcggtttctgataaagtgaaacatacacttggccacctggcccagcaattccactcctagaaatttacccaagataaacaaaaatttatgttcacataaaaacctgtttgcaaatgtttctagtggctttatttataatggctgaaaactggaaacagtccaaatatccctcagctggtgaatggatgaacaagctttggtacatccataccctggaacattattctgcaataaaaaagaaccatctacagatacacaaaaccgcatatatgcatctcaaaaacatcatgctgagcaggaaaaaaaaaacagactcaaattgagataacacattgtagaatcccacttatatggaattcaaaaaaggcaaacttgtataggaacagaaaacagataagatgtaaaattcaaaaacatgtgaaactcatctgtggtgatacaagtcgggatcgtggtggccctagagggaacatgagtggaggggagaaagggcagctgtgggggtggggatgtccagtctgctcactggggtgccgattacaggtttgggaccagctggacacctcattcatatgtgctgcagctctataggacattttgaaaagtctagctagatacaattgtgtgcctgagacatgaatgagcctgacacctgctctccttttcacaaagggagactagcaattatttggtcttcgaggcaagttagcaccacacagagactcttctggatataaaggaaagactgtaaagaatttgcagagagaataactctcgctatgtgacccgaggtgattttatgctttgcctgtgcagcctataaaataatcttgtgtggtccccatgatgcacatcaaccaggagatgctggagagtctgagacagcgtgctggcagcactctgccgggggaaggacacggaggtgtccaggctcggctccaaaagcagacaagcctgcactgcgctggagcaggtgagaagtagctgggttccaccgtgcccttttcgtctgtgtcccttgccacccaacacgagctcagcacacagttgatcttcactaactagtcacccctccaagcttttgcaatggttgttccctctgctaaagatacccccttctcccaccttgaccacccgactaactcttaagctcagctcccaggtgcctcctcctccttcttcttggtacatgagtgccccgcttggcattcgcttaggggtgtctatacacactatttcctctgcctggagtatcttcttccatggggcaggggtcagtcagcaccttctgtatgcaagggacagaaagccagtcccaactgttttcagccaaaaatgggaaagacagtggctcacataactagaaagttgaaggtgcctaatttcaggtacagtgggatccaggagttcaaagcctgtccagctctgtgctgcttcctgtcaggcaggcttttcccttgttttgtcctcttcttctctaagcgttcacttgctcactgtccatccaatggaaaatggcatctccttcacaaatcatggccaaccctgaagtcccaagatcaagtttcattgggcaggctcagtcatgtgcccatccctggaccaatcactagagcaagacccggtcacatgtccacccctggagacagaggcctctgggcacccccagcctcatggactgagaaaagggaagagggggttcttcagtaggaagtcgaggtgctgttacctgaaaatgggagatagatgctgacttgtccacacacccgcaccttctcccagcaaactctagctcgtctctgcacattgtatgacctcaggccaaccccttcccctctctgggtcttatgttcctcctccggaaaatgggcaggaggccgtttgaattccaacattccagaattctgggacagcttccaggactggagtcagctccctagatcccaggaacgttccagcacttctggggacggaagtggagcatcagccagagccctccccggcccccggcctgggaacatgtttagaagatgacaactgggctccctttggccgaaattccactcccgtgggggccttgccaaggaaaataagcccaagaaccaggcattaaaggtgagcatacttgagcattttaagatgacaaattatttacacaggtgtgggaaccagcccctcgcaccctgctttctttttctccctcccctttccaaattctttcccccaagggtgctgacagacatgccaagggagggggtggttggtcgtggagatctgcccagagtaagtccacaaacccagggcaaagtaggaggacagagaagccggaaagagggtgtctgcgtggcggaggctggtccttgctcacctgccttcttgctctctaccccattgcctggggaggtactgaggctagggtcccagggatttcactgctacccgagtccttgaagaaactcatgcccaggccatcctttgtccacaagggagaataagggaccagagaggtgaaaagcaatccccagggtcacacagccagttagctgaacttggggctagcaggggaagaggtagaggaagcaattgtttcttactcacctagtgtgtgcctgacactgtgctgagctctgggaacacattgtgaatgaaacagacaaaatcccctgccctcatggagctgaaaaagatataaacaagataaatagcaagatacctccagaagtgcttgaagaagagtaagacggggtgaagaggtggcagcggtgctgtctaggttggggaggtaacatttgagccaagaaagatgagaatgagccggccatggggagattggaaggaaggacattccaggcatctggcactgcacatgcaaaggccctgaggtgggaaagggcttgttgtgttcaaggaactgtcaaggggccagtgtggctgcagcaagaaggaaaggcaatgactgaggggtagattcaggtcaacaaacccaaggggtaggtataatcattctgtgttaccaaggaggaaactgaagcccagagaggggcagtgacttgtccagggtcacagagcagagccagattccagtacttttcattggctccaaacccacattcctgcgctttcgtgaggtgagaggatgggagcaggcgctgcgagggccttccaggtctccagcctgcagctcaactccaaagatgagaagcatctgggctaactggtgcttcctgtgggaagaaagcagagattgattgagctgctgagtcacaggggaacaacaggctaggctcccaggctgcaatgggttctgcctcagtttacctacctgtaataaacgtgtttcatcacacgtctgcctccagtgctgacttcagaagggtgctgtgagggttaattactgcctggcagctccaggagccttgatgaaaggtggcgggaagtgggcgctattaacctgggcaggtaattacccacggcctgagggagggtgcagaggggtcctagcctgagtcacttctggttctcattcaaccccaggccagcctctttccaggtgggtagggcccagtgtgcccaaacatctggccatcgttctggccccaaacccctcagcaccgggcagggctgaagctaggagtggtcacaagccacacagtcccagggttgaaatcccatctctgccgctcctctggccagaagacctggacaacactcctcacctcttgggcctgtttcttcatctacatagtagtgtcttagtctgttttgtgttgctataacagagtactacagcctgggtaatttacaaagaacagagatgtatttctaacagtcctggaggccggagagccgaagatggaggggctcactcaagcaagggccttcttgctgtcatcccatggcgagggcatcccatggcaagaggtggcacgtgagacagcaaggaatggccgaactcactttcatgacaaatccactctctccatcatgaagccactcctgcaataatgatactaatccattcataagggcagagctctcaggacccaaccacctcttaaaggcccacatgacctttgggagacacgctgagaccctggcggtgcggggtgaggacgtggcccctccccagggcactgtggttgtttctcacacatatgccagatactgcgcctcgcagccacttcgtccccattgcctcagtttgaggccaaaagtgacacatcaggccacagccacctaccccgtcagccatctcagcctccgtgacctgaagggaaatgatgaaagacttttctagaaataaatgatttttaaaaca

SEQ ID NO: 42 - DNA, 22203 bp, Homo sapiens
attaatgacccggagccacatgacggagcatgacacagcacttttgggcacaaggcagggcccagaggggtgcgtgggggccgcagcccagcccccaagccccgccagcgggtgagtcacctgggccccctgcagcttcctgatcccggccactcagctgtcctccccacccccaggatatccccagttgtcagggctgccctgggacccctcgacctttgcactagggacttagcagccgtcttgggtgatcagggctgccttctgggattacagatggggacagtgaggcctgcaggactggagtgaatgaacagtgagctctgagtaaacgtccactgtgcgggaggcactgtgcaaatacgtcacgttagtctcgcagcgatgcaacacagtggcgtagtttaatccccatatgatagatggggaaactgaggctcagagcgggaatgaattctcccaagggcatgcaacaagagcactctgtttgactggaaataatttcctttcgtctcctcagcagccgacaagggaggtgccatgtggactgtttcacagctggagaaactgaggcacagaggggctgagtcacctgcctaacgcactgagcagtctggctccaggacctgtgctctgaaccagcacctggcacatagctggcaccgacatggtctccgtgcactgccatggatgagagcaatgctggctgcggtgtcgggcggagctgggttccaatgctgacttcacctttctcaggctgcacagcctggagcacgtggctgcaccctaccgtgcgtcagtttcctcacctgtgaagggtgatcgtggtggtcctgatcttgcagaactgcagtgagggctgtgagtgtggggtgtctcaactgcacctggacacgcagaaggcactctgtgaacactgactttcattggcccaggcctctgaatccatgacagttcaatctctgaaccccacagcttcctccttcaccctttgccgccccagggcaaggtgagggcggtggtttttatgggcctgggaaccagacaggctcgggctcagagggggcgcctgctgctggcgggagtggggcctcctggttcccactccctgattttgggctgggggccggtggtgggcaggggtggggcagcactttgatgttcttcccttcattccaccaccactgcttgagcacctactgtatgccaggctccaggggacccagcagtgaacaaggtctctgccctcactatggtggaggagaggatggaggagataaacatcggtgagcaaatgcttgaagaggcgagaggatttcaccagagagaagggccgtgatgggaatcagcaggggtgtttgggagctgagtgggtcagagagggcttttctgaggcggtgatgtggagcagatgcctgaaggagaagaaggaccagacctggggaagagatttccagcagagggaaactcaccacagcacgtgcaaaggccctgagggtgggaatgggtttgggaagttccaggaaaggcaaggaggctgaaggggtgtgaggaggggacagcagcaggacatggtgctggagggccagcaggggttggaccatgcagggcttggtgggctgagtgagcagccgcggctgggacttgggcaggagcctatgtgagagatggcaagactgcctgagatcgcattcagaacttctacccatctcacagatgagctcagtgaggcccgagccagcttcccctagaaggtcagtggctggacaggcatgagaatcgagggagttcaactcccccggagaagccagaagccagaacacaggccgtggaggagagggtcccacattcatccctgcagccccgagagctgtgggctgtggggctgcctggatggcttcctggcggaggaggtgacctccaagctgtggctggggcagaagggctgggagagcgttcccagtaggggaagcagcacacagacaggcccagaggtggcggtgaggtgcaggcgttgtctgggaaattcatcactgcttgggagtcaggaaagtgaccgggtgaggaagtgttattgtcagggtctccctttcagaaggccttggggccaaggggaggagctggaattgccttccaccgcgtgcagaccccaggctggatcccaggactgcccagggacaggcacacgtctgccctcatgtggcccacagtccaggggcagggactgtctggagagattagggccatggggggcaggagggcggaggggcagacctcccatcctagttccaatctcagtgctgtgacacactccctgtgtgacttggggcaagtcactttacctctctgagcctctgtgtcctcatccataaataccacctggaaagatattctcagaactcagtgagatcattcgctcattcgtccactcatttattccttggattttttttagcgcttcctatatgccaggtcctgggctgggtgctggggacacagcagtgacaaaaatccctgcccttgtagggctgatggaagaggtagtgtaaagcagtgagtggttaagaacacagacattggagccaggggccttgggttaactcctggcccactgcttatttgctgtgtggttttgggtgagacactttacctctttgcatcctacctgtaagatgccacgtcataggattgctgaaaggacaaatgagttaatatatgtaatgtgtttagcacacagcctggtacatagtaggtgctcaattgtgcttgaatgagctgagatgtgcaataagcaaacagaagaggggtgagtggatgagacagtgtctgacagtgggaagtaaaagtgaccagctcttagcaacaagtaggcatacagtaggtgctcaataagtgtttctcctcctttgtctccttccgagtccatcttggaccttagcccataggggacttaagggcctgaggtttggaatctgcgtggaaggcgggaagtcgtctttgctgatccagaaacccagagctgagctttggggttggcaagagcagagacgcccccagcacccctgcccctcacgctccctgcaccctgtccccagcatcatgtgcagcctgggtggctgcggcgagctggggcctgcccaacgggtccccagtaatgacactcattacacaggtgtctggcagcggggggaagcgaaggccccaggggccgcattcacatggcacccagccagcccaccccaggcccttcctcgtcctttataagtctggtgcccagggcaggcgggcaggctggggagaggagctggcgaagggccagctggcgcccagtgaaaggagggaaagttgagaggtctgggtgccaagcactggtgtggaggccaggggaggtgggcacggggggcgcgtgtgtgtgcacacgtgtgtgtcagggtgttttggagggggcgggatgcagtgaatctgtgtccaggtctatgcatccccctggcctgtgtgtggagatgagagggtctgtgtagatgaagcattgatggtcccccaggtgggtgcaaaatctcccatgcccgtttcatttgttctttaacctacactgtgaggtgggtaccaggctgggtccagcctggacctggtgatgtcagagccagtcccagggcagccctagactctgccgtctaagagctccaaatccagggacagacagacgccaggcagaggatcaggacatcccagtgaagactttgatggagaaaaacaaggcagggggctgacagggatcaataggatggggtcagaggcctcactggaaggtgagcttggctggaggcctggaggacgagccgccatggcaagatctgcaggaagagagttctgggcaggaggaatggcaagtgcaaaggcctcgatgcagggctcagcttggcctgtgtgaaggggcgagtgaggaggggactgggggccggggcaggtccagagctcatggccaaagtcaggagtgtgcatcttctgagcgcagtgggaaggttggcacatggtaggtacacagatgggggctccactggggtgaatgggtttgatgagagccgggaccgggccctctgggtgtgggaacgattggctttcagagctacagacaggaacgtgggctgctcaattgtatttgaacctattctcctgggttcaaacccctcctggatcctggaacctgttattaagccggctgcaccccagggcaccggcctttatatccagacagggccctggcccccaagacgggggtggacgggtgatactggtgaaccccatgcctgccccaccccctgccaggcccctcggcagggccaagtctgcttctgagagcaatgagcatctctccttttacagatggggaaactgaagcccagagaaggaatgggtatgtcctgggttcttgtggcagagtgctgggggcagcacccagaaagcctccgtcacagctcatatctcttcctacttcatccccgcccacagcgggctcctcctaataggactctggcagggtagcagctggtgtccaggcagagctagagggaagagctgggtccaatttgagaagcctctgttaattgggtcctataggaagaactgttaacactgtgagtttcccatcaccagaggtgtgcaaatagacctggataacagcccttcacctgcttagagattacagagaggttcaggcggatgggagaccacttgccttctagctgtgtgattccacaggacctcggaacaatccttagctcaagcctcagttttcccgactgtaaaattgttttttgtaataatcagagtgacctcattaaaaggacaactttgttgataaaattctcctgcatttatccaggcctcgcttggttccccagtgctaagagacagctctagccctcaccatggcccgcacatcctgtagccctggtccctggggccttccctcccaccccctgattctccccttcctctctctgctgcaaccacagacttcctccctgttgttcctctcctacctcagggcgtttgcagatgctgtgagcattggatgtcgggcggagggctttccctaatttcaatctcccaccagtcctatcaggtaaataggagatccattttacagatgaggaaactgagtctcagagagctgaagttaaagacacacagctttttgtgaatccactgagtcaggatttgagctcaggccatctggaatctaacaccactctcttttcttcattccttatgtgacttgttttcattttcaaaactttgctcaacagttgccttctccaggaagccttccctgactaccctctccatccaccctcccatgaccttcctgagtttcacctttgctgcactgctcacactgtctctcaattatctccctttttttcttctcaacagctttactggggtgtaacaaacacacgataaactgcgcatattccagtgttcatgtggatgagtttggacatatgcacacacttccgaaaccaccagcacaatcaagacagcagacatatccatcgcccccaagggtgtccttgtgtctttttgtcattcatccctcccggccgccccatccacactcccatcgcctgccgactgtggctgatctgctttctgcggctgtggattagtttgcgttctctacaattttctgtaagtggaatcatgtggtgtattctttactgggcttcttttcctcaacattatgattttgagagttacccacgttcctgtgaccattctctttttttatgtatctgccctgtccccctcagactgtgagttccatggggcgaggactttgtcatatttacctctgcgtccccagcactcagcacagggctgggcacacaggaagtgcctaataagtgttgactgacgggaaggaggatgaggacatgcccaaatgggggaacagcgggcacatttgcatggcagtgaggagcccaaagccggattaagaaaaaacagcccctggaatcatctggaggcctcgtggccccatcagataagcatatctgctcatccccatggctgtctctgaggagcaaagatctggattgcacaagggctgggcctgggctgaggaggcgctagtggtccctttatcttgcgtgggcattcggcgctgtgttctagaactgcacagcccacgcaccccggcaggcagaggcctgggctccggcagcgggtgggcaggtgggaggcaggaagaagtggccacccagccctccccaaaccagttggactcctttgcagagattactgcaggcgctttgggagctggctaagggagagtgggaggcaggaggaaaaagcaggaggaggggaggaatcatttaatgagcaaatattatagggaatttccagttcatgccccatcaggctgggcaggaacacagtgggattactcaggcggtttccaggtaccagcctcaacctcgaaggttcagtgtggctcagatgcctctaggtcttcatcgctggctagaaacccaactagccagggtgagaaagtggcggtgagttacatcctgagacaaagcctgcaaccaaagtcgagtctaagcatgcgcttcctgcatcaatctttgctgagatgaccttattgcccatttcccagacagaaaaactgaggctgggagttgtggcattggctaaggccacacaggggtcactgcgcagtagggacagcttaaaagccaaggccattttggagtgactccttcaacaagggccacattcttttgataaatacttattgggcacctactgtgtgccacacactatgctcagctctgcaggttaaaaaaaaaaatggaggccggtcacggtggctgacgccggtaatcccagcactttgggaggccgaggagggcagatcacgaggtcaggagatcgagaccatcctggccaacatggtgaaaccccgtctctactaaaatacaaaaaattaactgggcatagtggcacgcacctgtagttccagatacttgggaggctgaggcaggagaatctcttgaccccgggaggcggaggttgcagtgagccgagatcgcaccactgcactccagcctgctgacagagcaagactccgtctgaagaaaaaaaacgtggagtctttgggcatatattgtgcattgcatcttatctacagatgaacacaatttttgaggtcagagatgttttgtggaactttgttttcttctttgtggaaacaagaagtttggaccagactagcatttcccaaatctattttatcatttatccattttgaggacacagatctgagggacacagagtctctgggggtactaataggagtgacaagggggaaagtgttccattagccattgggtttgggaattcctgggtgaacatttgccacaggtgttctcagtcttggatgctccaaagagctcaatgagcatctaggtggttaggtcctgtgagttaccctctgggatatctaagggagtttgttcactgtttttctgacttcatgagtcctgtttggatgctgcttcctccaaggagccttctctgaatccctagaaggacctgagtccccttctgtgaaggcacctgcctggagctccctttgacttctgaatattttccatcttgggttgtagctgtctgtttccatcacttgattgtgagcttctcaagggcagggccagccgtgattcacttcttggttctggtatagagaacagaatgggtggatggagcatttaatgggtgaaaagatgagtgatgacttgatggatgggtggatagtcaaatggataatttaatggctgggtacatgtgtggagataagggaactgtttatgaatggataaaatggatgaagaaatagatcaatgaaagaatagatgaatcaatgaatgagataattaacaattgaattaatggatgagtgaacacatgaatgaagaaattagtggataaatggagagatggatgatggatggttgaataaataaacaagtgctggattttaaattgtgtgatggatggagcgggtgatttcattgttgaatactgtgaattactgatggatgaatgaatagataaatatataattaaatgaatgaattaatacataaagtgatggatgacttaatagatggctagatgaataaacagataaagggataaatgggtagatggattggtgattccatgagtgaatgggtgggtgtatggatgggcaaatggttggatggatagatgaaagagtgggtggatggatgagtgagtggacagaagaatgggtaaatggatagatgaatggatgggtgggtgggtggataggagaatggataggtagataaatgaatggattggtgggtaggagggtggataatagaatagatggatgggtaggatggatggatggatggatggataggagaatggataggtagaaaaatgaatggattggtgggtgggagggtggataatagaatagatggatgggtaggtggatagatggatgggtaggtggatagatggatggatgagtgggtggacggataggcgaatggatgggtagataaatgaatagattggtgggtaggagggtggataagagaatagatggatggataggtggatggatggatggaaagatggatggatggttagattgattggtggatgaatagatgaatgggtggatgagtggatggggaaataggatggaggagtacatggatggtggatgagagaatgaatggatggataggtaagttggatggatatacaggtgaatgcatgctatgtcataagatcggaactgaggtcaggaggcaggaaaattcctgtgttcctccctgatgcagcagtatcaagtttttgaagtttgaaagcttagtgaaaactttgagtcaaatctccagaaaattgcatatagacacaaaatgttagcaactttatgggagtggtggtcatggagcctaagagccacctacagacccaaggtgaggaatcccagtgcagtcttatgtattatttttactctctgagccctgatcttggagaggaacccaggcccagtggagggaaggcagctgagatggggacaggtagtttcctaaaggagaagacacttatgtattcattcattcattgcacaacattgctgtgacctttctggatgcctgggagaagataaaggtgcctctcataagtggcaagtgtttggagcttgaagtcagacagattgcatttttaatctcatctctgatatgtactggctgggtgaccttgggaaacttacttcacctctatagaccttctcttcttcatgtataaatagggacagcaataatgcctaccctattgggttgtgaatatgtcaacaggtatgtaaaacatgtagcccagtgctcagtgcatagtaaatgctcaataaatgtcagttcttctttttcttcttgcatgactactgttgtcttgcactgggcctatgcaagatgctgctgagcccgagatatccaaggcatcatcctggccttttgaagtgtccgcagtccatcagggaacacagacaagtaagcagaggtttccattcgcacagggtgttggggctgagatagggaatcctaagacctcatgttcagggtcatctgatcctcagcatccattcctattaatatctctttctagcaagaggctgcagagactggaaggctacacgccgcattccccagccttctttgcagcaggggctctgaacgctctgcaggtcccgccaggcagatgccttcctgtgagagtcaggaagtgggggccgccttgttttttcctgggctctctttctgctggtgagcatggtcatgggatggattttcttgcagcaaccttggcgtccggttaccactcttggggagtctagaggtaggggtggtggtggtggcttcctcatctccagatggctggatggtgctgtgatacgttctcaaagtctacagctcctctgtggcctcctgattccccaccatcctgagtggctggcagctctcctgaaggtccagttctgctgtgtggtgctggtgcctctccagcccttctagcaatgttgtgagtgttcaattccctgtgttggatcctttctgcttaaaatgcctggaaggaatgctgtctctaaaatccaaaacaaacacaaaatttggaagggtttctggttgccataactgtagtttgactcacacatggtgggaggcggggagcactgtaggacctcagcaggtacctaaaccagacttagggggtcagagaaggtttacgaagctcatgacatgtaaactgaatcctgaagggcatatatggagtagtcagacaaagagttgagtgggaagaacacaccaggcagaaggaatagcccgtgcacggctgggcacagtggctcacacctgtaatcccagcactttgggaggccgaggcgggcagatcacctgaggtcacgagtttgagatcagcctggccaacatggtgaaaccccatctctactaaaaataaaaaaattagctgggctgtggtggtgcatgcctgtactcccagctattcgagaggttgaggcaggagaatctcttgaacccgggaggtggaggttgcagttagccaagatcgtgccattgcactccagcctgggcaacagagtgagacccaatctcaaaaaaaaaaaaaaaaaaaaaaggaacagcctatgcaaaggttcagagatcagaaaagacatcgtggagaagtgggtagttcgggctggctggaacatacaaattgtaagggagaggtcagaggctttaaggctggccaaggtgctacacttcctttgaaaataatggggagcttctgatagtaaacagcagaaaatagtaggtgtctttcaggctcctgcaggaggctgaatttgagggagaggaagtatcgttgcagggaaagtagcgaggtggcaaggaattgcagccacctgagtgagaggtgatgagattgacctggcatggcagcctcagaggaggggagggtggatggatttgagggaggttgaggacgagactcccaggctttggtgaccaattgggttggaggcatggcggcgggaggctttatggatgatgctcatgtttctggctttggacgctgaacagttgtgcagccttccaaaagaagggagacaggcagagggacagtttgggggaagttgctgaacttgctttgggcatactgatttggaggatgcctgggggccatccaggaggaggcatcggggaagtgtacagacatgtggtcagaggctgagacaacagattggatatggacaaccacccacgactttggagaaaatgagtgaaatattcattcaacaaatagcacaggggagcctgagacacactatctgttcatgtctgaatacctggcagtgggccaagggcctggctgcttgttcaataagccaggaggaagcgctggagcaagacttggagggtgggctgggttctaccaggaagagacaggatgagggcccagtggtcaagtgcgtgaggcctgggtttaagtccagctcctctgtgtgttgattgcaggggcctgggccagatgttttccctccctgagcctgtttcatctgaaaattggttataagggacatggtgaagcttcaaagttgtgcttgtggaagcaggtagcttggagcatggagcggacttttgggggacaacttgggacacagagagtcacccacttcctggtgtggcagagccacgggggatggggagagagaaattaggatccgcctgaaaaacatccacagctgtgtcccatgtgagaaaggagacctcggctcccgcccaggctccctttcaccccccagcctgctggagctggcgggcgggggaatcatctccatggagtggaggaggggaccagatgacagaaaacttctccacgtcccttggagctgctggagctgggtcctggccaccgtcccaacccatagctcctgactcggggtcaggctgagatttgctccttctctgcctgctccattcagctgcagcgaacagaggctgcaaactggaggcctcaggggcccaatctggcgcccaagcctgtggggctttcctcagcccacatagaatttttaaatgaatgaagccaatatttaagaatctgtgggtactacataaaaacctgtgttttgattccctctggaaaatcagggcacggagcatccgatcatattgggccctgttctctagggaccaccatcaaccggagctgagaggtgactgtcttcagacaaggcatgtgccccagtccccaccactccctcttgtctctctgatgctgaggccaaggaatagtagctatttatcatcttaccccagcccactctgctcattttaaattcctgcctggtccctggtgacacagttttcaaccccagagccagtctctttttcctctaaaaccacccagactttggccctggttctaggcctgaattggcttcccaagaaccccagtctctgagctcctcagggtcatggtttacctttccttctgccccacaaggcccagcaccacccccgggggacgatgacgggctgagacttggctggtgttggggggccggctgggcctgtgggaggcagacccacatgtgctctgagatgtgtcagctgggcctggtcacactctctgcggctcatccctgaggcatgtggaaccaggcgctgtgctcgtggcccagccagggtggtaggcggggccaggcccgggacatggtgtatgtcaaggccacgcacaacaggcctgatgttccagccgcaaacacattggttggaaagaggaaaggaggagggagaggcagagccgctttaaagacagtacccaaaatacagaggcagaaagagccgaactcacactgtaagttgctgtgtgaccttgggcacgtcacctcacctctctgagcctctagcttaagatagaactaaggacagaccccagcttgcagcctcgtgggcatatgcagtggtacagtggctgatgtggggcctaatgcctagaagggcagcctggaatggaggcaaaaatcacagactttggggccagatgaggttgccacttgtgagctgggtgaccctgggcaggtcgcttctccatctgcatccccagggaaggtcctcaccaagttattctgccaaaaaaagaatccattcaccgaacaaatatttattgggcaattcctgtgggtcaggcgctggggacatggcaggacataggacggtcaaaggtctctgcccccgtggagttcacacttgtggagagagcaggcaatacacaagataaataagttgcatattgcatttgagaagatccatgctagggagagaaatgaagcaggaaaaggagatgggatttcaatgggcggggcaggaacagcctggtgagcaggtgacagctgacaacgatctgtaggaggtgagggagggagccgcggggaggggagagtgttccaggcagtgggaacggtgcacaggccctgagtgggggctgtggctgttgtgtttggggtgtagcaaagaggccagtgtgtggaacagggtgagcgagggagagagactaggaggacgtgagggccaagaggccgtggggggcggatcctgcagggccacgtgggctgttaaaggactttggctttttctctgcaggacatgggagtcatggagggttctgagcatagaagggacgtggtctgacttcagttttcatggatccctctggctgcagtggagaatgggctggaggggccagggccaggacagaggcaggggggatagtggggaggtgatggcaatagtccaccctctgtttagtgatcctggtccttccccgctctaaagccttcctgacttcccatcgcctctggacaaagctcaaactccttagcgtgacattcaaggcccgcttacctgactctagctgctccctgccccggctcctcactctccacagcatcccaaccagatatccttccttccctgctccacatgcggtccacctttgcccgtgctgtttcctctgccaggaatgcccttcctgtccccctttgtgacccagttcatgtaaggctgagtcccacaagctaggagatagaaaaggaaggaatagaggaaaggctgttcctggggagggtcagggagggccaggtttcggctcccctcttcttcctggaattcatcctccatggcctccgcagctgagggcaggctcaggagctgggagtggggctgtagcccacacgaccatgctgtgtgaccttgggcaagtcacccaccctctctgggccttggcttttctgctctgtaaaatggggaggatcctggagctcctcatggtggttctgtgcacccaagggctgtggcaactgtgggaataatggcatcctggggaagacataactgcacttccttgcccagccacgacaggccagctcagggtggccctgagctgatgctaggggtagcttgcaggaggggtgccctctgaagccctgagcatctccagttcagtcacccctgagtgacctgagcacctacagtgtgtccagccccagcactgtgcttgagcacggacagaggccagacagcctggtttcaaatcccagctctgtcacttcctagctgtgtgatctgggcaagtaatgtaacccagctgggccttggtttctcacctgtgacatggggacagtaagagtgctctcctcctgggaagctcaaagaagccagtgtgctcctataaataccatgctcagtgcgtggaggaagcagcttatcaaggccaactagcattttttttattattattattattattattattatcaccactgtcatttcctggctttgtggcctcaggcatcacttgcttcactgtgcctcagttttctcctctgtgagatggggtaatagtcccaccttcgaagagttgccatgaggactgagcctgacgcatgtaaatgagcctggagcagagtaggtactctgtgatttttgtttgtttgtttgtttgagatagggtctcgctctgttgcccaggctggagtgtggtggcaagatcttggctcactgcaacctctgcctcccaggttcaagcgattctcccacctcagcctcccaggtagctgggactacaggcgtgcgccaccatgggcggctaatttttgtatttgtagtggagacggggtttcaccatgttggccaggctggtcttaaaactcctgacctcaagtgatctgcccgcctcggcctcccaaagtgctgggattacaggcgtgagccaccgcgcctggcctcagtctgtaatttcttaagaaaaacatttcaaatgcagaatttattttattcactaccataagtcatcactgatatatgaatagtccctatgaaatcctttgttattcctctagtcagacaaatgctcgtttggtttaatctgacttaacaaattaacgagatgaggaagaaaattccaggccttgggacattcactgaagcccaaccaggcaccaagagacacatgtccttctagtccttctaatgaagagtggaggaagatcaacacgatccttatttacacttcaagtcattatgactctgcagctgggtgaccttgggcaagtcccttcccttctcagaccctgagtctcttctttcctaaaataagtgtgatagcttcctacctgccctgtctagctcacaggattatggtctggctccaagacatcacggctatcatttattaagtccctcctgtatgcaaagtccctcttcctgaccaccctgcctccttccaggagggaactggatgctgcttgttttcaggacaggacagtgaggctggggaggtggcggaggatgctgcccagggagaggaggaagtagggggctggggctggctgggctgacgcagctgtgatgtcagacacccgccacaggcagccggcccagtgctaactgtgcgctctctgctggtctggcctggcgcctgccccctcctccccccgccaccccccttaaccccttcccggcctcctcttcccagacggccatcccccaggcccagccttgcccacaagattcccagatttcacaactggggctggcgctgaatcatgtacagtaagtccggggagagaaactcccggctgcctggcgtccccgggacaggacagctgccaagcctgccctccctcccaggggcccaccggcagccagggatcatcccctctgggcccctgaccagctagggggtgatgggcgagacacacaacctcccttggctgtgccagggatcaagggaccgtgtggtttccagggaaccttcaggctctggagggataggggcaggccagggtggtgggagaggggtcgaagtggccttgtattcaaccacggcctgccaccaaatcactggtgacctggagcagtccctaactgtaactctaagttacggtttccttatctggaaagtggggataatcacagccctgacctcacaggtggctggaaggactctgagaagatctgtgtacagtgcttaccgcaggaagcgcccaataaatattattattattgttgtgacgtcgagctggtcatgacacgctttaagaccctggagaaatcatccagttctttggaggacgtctcccctgaaacacccacccctcccgctgtgatacaaattacatcttatcttttcaaaacttcttcagtacatcagcaaacatttattgagcaccactgtgttccgtgcctgctaccaggtcctggagatacagcagtggacaaaacagaaagacatttaaaagccctctgttctcgtggagcctgtattctagctgaggagaatcagacatttgaggtcatttcagtaagtgagcagggctccaaaggaaataaagcagaaggtgcgatggagagagcctgggaggtcccctctgatggggtgacatttgaacagaagccccaacaaagaggagaagcccacgtgcaaaggcagggggtgggaaacggtgctccaggcagagggaaccgcaggtgctaaggccaggctgtgggatcctcttgttgaaggctcagcaagggcagtgtggctggagcagagggagtgagtgaggggcagaggggtgggaggtgagcttagtggggcccccaccctggagcagctctcctaatgccaggctcttcctgaaagtggccacctggtgcctgacttctacctgtaggggcagccacctgacaagggcccagcttcttcccatccggggtcccaaggccccggagctgcctgctcacagtagaaagcctcattcccaggaaccccacggagggccaggctccccgcccctgccctttgctcaggctgccgctgggactcccctgcccctcccggaggatgtgaccctccctgcctctcagccgctcagagtgtgggcatctgcatctcggagtctcagtgtgcccacctgtgagatgggcaccatgttgcctcagggagggagtaaaaggaggaagggagctctggccttagtatctgtcccctgaaccctggaagaaggaaaacatcggggctcactggggaccaggctgtgcgttcatagctggacggagagctcaggcgtgtgtatgtgcgtgtgtgcatgtgtgtgcatctgcgtgtgtgtgcatgtgtgtgtgtgcacgtatggggtgggggagacgggggtggcatcaagacccaggagccacaagagtgaggaagagggaaggggtgggcttccagggacagggggcagtcagagcctggttctggcgcccaagtggggattggggcagggggaataagaggcctgccctccctcctgggggcccagcggcagccagggatgatttcctgggatgttttaaaaatcatttatttctagaaaagtctttcatcatttcccttcaggtcacggaggctgagatggctgacggggtaggtggctgtggcctgatgtgtcacttttggcctcaaactgaggcaatggggacgaagtggctgcgaggcgcagtatctggcatatgtgtgagaaacaaccacagtgccctggggaggggccacgtcctcaccccgcaccgccagggtctcagcgtgtctcccaaaggtcatgtgggcctttaagaggtggttgggtcctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggtaggtaaactgaggcagaacccattgcagcctgggagcctagcctgttgttcccctgtgactcagcagctcaatcaatctctgctttcttcccacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttggtaacacagaatgattatacctaccccttgggtttgttgacctgaatctacccctcagtcattgcctttccttcttgctgcagccacactggccccttgacagttccttgaacacaacaagccctttcccacctcagggcctttgcatgtgcagtgccagatgcctggaatgtccttccttccaatctccccatggccggctcattctcatctttcttggctcaaatgttacctccccaacctagacagcaccgctgccacctcttcaccccgtcttactcttcttcaagcacttctggaggtatcttgctatttatcttgtttatatctttttcagctccatgagggcaggggattttgtctgtttcattcacaatgtgttcccagagctcagcacagtgtcaggcacacactaggtgagtaagaaacaattgcttcctctacctcttcccctgctagccccaagttcagctaactggctgtgtgaccctggggattgcttttcacctctctggtcccttattctcccttgtggacaaaggatggcctgggcatgagtttcttcaaggactcgggtagcagtgaaatccctgggaccctagcctcagtacctccccaggcaatggggtagagagcaagaaggcaggtgagcaaggaccagcctccgccacgcagacaccctctttccggcttctctgtcctcctactttgccctgggtttgtggacttactctgggcagatctccacgaccaaccaccccctcccttggcatgtctgtcagcacccttgggggaaagaatttggaaaggggagggagaaaaagaaagcagggtgcgaggggctggttcccacacctgtgtaaataatttgtcatcttaaaatgctcaagtatgctcacctttaatgcctggttcttgggcttattttccttggcaaggcccccacgggagtggaatttcggccaaagggagcccagttgtcatcttctaaacatgttcccaggccgggggccggggagggctctggctgatgctccacttccgtccccagaagtgctggaacgttcctgggatctagggagctgactccagtcctggaagctgtcccagaattctggaatgttggaattcaaacggcctcctgcccattttccggaggaggaacataagacccagagaggggaaggggttggcctgaggtcatacaatgtgcagagacgagctagagtttgctgggagaaggtgcgggtgtgtggacaagtcagcatctatctcccattttcaggtaacagcacctcgacttcctactgaagaaccccctcttcccttttctcagtccatgaggctgggggtgcccagaggcctctgtctccaggggtggacatgtgaccgggtcttgctctagtgattggtccagggatgggcacatgactgagcctgcccaatgaaacttgatcttgggacttcagggttggccatgatttgtgaaggagatgccattttccattggatggacagtgagcaagtgaacgcttagagaagaagaggacaaaacaagggaaaagcctgcctgacaggaagcagcacagagctggacaggctttgaactcctggatcccactgtacctgaaattaggcaccttcaactttctagttatgtgagccactgtctttcccatttttggctgaaaacagttgggactggctttctgtcccttgcatacagaaggtgctgactgacccctgccccatggaagaagatactccaggcagaggaaatagtgtgtatagacacccctaagcgaatgccaagcggggcactcatgtaccaagaagaaggaggaggaggcacctgggagctgagcttaagagttagtcgggtggtcaaggtgggagaagggggtatctttagcagagggaacaaccattgcaaaagcttggaggggtgactagttagtgaagatcaactgtgtgctgagctcgtgttgggtggcaagggacacagacgaaaagggcacggtggaacccagctacttctcacctgctccagcgcagtgcaggcttgtctgcttttggagccgagcctggacacctccgtgtccttcccccggcagagtgctgccagcacgctgtctcagactctccagcatctcctggttgatgtgcatcatggggaccacacaagattattttataggctgcacaggcaaagcataaaatcacctcgggtcacatagcgagagttattctctctgcaaattctttacagtctttcctttatatccagaagagtctctgtgtggtgctaacttgcctcgaagaccaaataattgctagtctccctttgtgaaaaggagagcaggtgtcaggctcattcatgtctcaggcacacaattgtatctagctagacttttcaaaatgtcctatagagctgcagcacatatgaatgaggtgtccagctggtcccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgcaaa

SEQ ID NO: 43 - DNA, 12310 bp, Homo sapiens
gcgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccaggtaggaacaatgggttctcagagaccaaggtggcagggcggggcggctgctgagcaggggcggcagggcgaggtggcgggcggggcccaggagacttcatgctcccgcctcctactccagctccctgtttgggatctggggacgctccaagcacctcagcttctcaacctggacagacccacggctccagcaggaggcagggccagccctgtgtataaccataaatataatgggcaataatcagatttcacgcttaccgagccctactacaggccagacactgggtcaagggtccttcctgggtcatcacaatcagcctaggaggtgcaattaggattagtggctttttacagatgcggaaacagaggtccagggagctactcagcacctgctgtgccaggacaaagaactttgggaagtggggccctcagagggtgggtaccctgttcccagaggcaggaaagttgaggtggactggactcagtggggctcagtgggacaccgtggggagtcagtgctctctgggggcgagatgaattagagggagcccttttggttttttagaatctgaacatggggcgggggaagcagagatgtggggagcagatgaagcctccctggcactgctgggaggattaaaggacttgatggacacccagggcttggaaatgtacctggtagagagtaggtgctcagggaacaactcctgtttgcagaaacagcaactcacacttagggagcctgctgtgcatctgaaccccgtgcttgggtgtttctgacccccttccagctctcatccctcctctctccattttctcccctgtctcaggttcattcctatgtttcctcttgccccaattaggccatcttctatgactgcaacagtaaaaatattaattaaatcttataacatgaagtctaacgtggggccattccagtgttccagggcaggctccctgcgctctaggtaggcatctcttcacttctctttcttcatgggccccagtgcctgctgtggctcaagacatcacgtcccacatgatcacatcctaactaggaagagatgaacagaaaaggggactttctcctccaggatctcacttttttttttttttttttttttgagacagagtcttgctctgttgcccaggctggagtgcaatggcacgatctcggcttactgcaacctccgcctcctgggttcaagcgattctcctacctcagcctcccacatagctgggattacaggcgtgggccaccactcccagctaattttttgtatttttagtagagatgaattttcaccatgttggccaggctggtctcaaactcctgacttcaggtgatccacccacctcagcctcccaaaagtgctaggattacaggcgtgagccaccgtgcccagccaacaatttttcttacatgtcccagtggatgtcccctggtgtctcatggaatgatgggctcacatgtccacatttgaaccagaaaggaattcccgtggctgactcaggccaattagggttcagcctgtctggctgctccaaagagatgtgggctccgaaggtgatgggggcacggctgggctggccaccagctggagtctcactgacggcctaagtggcacagtgggcctgggtttgctcggccttctctggctggtcctcttggcagcgtctgccccctgggtaactgccccctccttgagcacagtcttccccagcctcttgatggcggcttgctggtctcgctggttctcctcttacttccctgcccgttcctccttgggccttgaaaacgacccctctcctgccttcatctgacccttgccccgtgagctcagctgtgcggggtccctcgtgcctttatgcgggctctgtcagtctgtccatgggtgtcccaggggcgcaccccactgggagacatggatgtctttcccagctgagaagacagcactgccacccacccagtgggccaggcctcagaccccagagttgtccttaactcctctctctctaaccccaacattcaatcctcagcaaattccatcggctctgcctgtggactgaatccagaactcgacaagtcttccctcctctgtctggtcattgctcgcctgcctgggcagaatctccgccctggactccccacccaccccacacagccctccacactcagccagagggctcctgttggaacccaagtcaggtcacaccattgcctcactccaaaccctactcctacctccctcagagagaaagacagtccctgctctggtcccaaggacagccctgcatggccttccccctccccacctcccctcccctcttccctgcccgcagtgacctccctcctcctgctagaacacatagagctttgccccacctctcctgggtgctctttttctggatctttccatgatcagccccatcccctcactcgggcctgtgcacctcagagaggcctcccagaccatccctgaaagtagccctgcccacccctaccacacctgccaaaggtcagcttcggcaagtggggactgtgtcttattcagcatggggccagcacagggcagtgcgcagaacgcagcagctggcgccgggctccgtgggtcctcccacagatgcagtccatagggatggtgtctgggtcccaaggtgacccctgggctgaggtcaccacctttcctcttccaggatcactgcctggatgacggtgggtgtcccagtggtggggagagcagctccgagcctccatcatgcccagagcaatgggcactggagcctggaaccttctttccgtatcacagaacctccaggagtctggaaggagacagttgcaaggaatggaatttaggaacttttggtccatgctcggtgttccctttgggggtatcttgtccgatggttattgtttttgtttccccttttcctgagctgtggtgcctattgttcaaacagaggaccccaagcgatggcctgcctcactcaggcgcaagcacccgagctgtctggcaaggtggcaatccaccacggccaacttccccttggggattccgcaggaaggacgtggcccctccaaccgaggcggatgtacggtctctccatagattccgcctgcgtaatcccatggccgcttcagctgggtctcatggggccaccctgtggcctgcgttcaaggaccacatcgtagcaacaggtctgcgttaaagctggaatcgcacccagcagactcggcctggggggatccaccagcccacatctcgctctcccgatacagccacctggcaattggctcttctctctccaaggctgtatttgttctttttgctgagtgtgtgcaggtgaattctcgttagttaaagcgcctgcgcggtggccgccctgaatacaaaaaagatcaaggggatgctgtcctggtaggtataaggagtgggggccccccacctttaccacttctccaggtgacccgagggtctgtccttagaataccaccaggctcagtggaacccagtttgaaagcccacgatcgaggtctgtccctttggtctccatctgggaaagtgaggcgagagatgagggagggggcattttgaggaccagaaatgtcgtggcagaaacagccagcctggagaagggagtctgggcagggcaggacccaaaggctcgagcaggatgtgtctggtgaggttgtctgggggaagtgacttgcctgtccccttcgttcattcttcaacattcattcattcattcattcattcaacacacaatgaagcacccactgagctgggggtgacaatgatccctgcctacaagaagctcccaggccggtgggggacatgaacacccttcaaaatgtcaatttgtggctgtgacaagtacaaggtgatctgagggtcagtaaagggggaaggaggttgatgtggttagggtgttcgggaaagcttcctagaagctgagctgggaactgaagggtgagtagaggccaggcagatgagaaagggaggaacgaatattccagcaagtggacacagcacatgcaagggccctgctgtgaaatggagcagagtaggagaggctaataggctcgcagctccacgtggcggacagttcgcagtgaggggcagatgtggagaggaaggtgaggtgggggctggacaggctcccagtgaaagcagcccagtctctatgccaaaggcagaggggttcttgggaggatctgagccagcagcaccagcttcttcctgaatactccagggcttggggccaggggtggtcatctggactcgatcctcagtgggataggagacagggtcacctggcacttccgcccacctctgccttcctggtctgggtataacaatcactgtctcttcgtctttcatgatttatctcactgaacccccacccacagaccaacacctgcaggtgccaggggttgaacccacttgtcagatggggaaactgagtctgtgagatgttctcatggccccacccacttccttctgctcagagaaaagaggaacggggaactgatgcccctggtcagctgggaagagtctgggcagggaatggggagggtggggccctcgggggcctgcattcgggatgggcaggggccctgcttccgtttaaccacagccctgtgacatgccccaaaagggaagcagcagccgcctgtcctcacccctccgtgccctagggagggggctggggatgcccaggggtggggagcaggagtctggggaggcctcaccctcccaccccaggcctcgagtctgggttcttacagaactctggggtcagctgaacccagctggtgacctccatcaagtcccaagaagaccttggcttcctattctgtaaatggaggatcagtctctctggaatgttctcagattagcacacagtgggtcctcactgaatggctagccagcagttgttggttgaataagctaaaagtgtttttctccctgaaaggagtagccaattagataaggaacccatgtatatgacattccacaaatatttattgagcacctattagatttcaggcattgtcctggtactgtggagcaatgaacaaacaagacaaaaatgcccccgtcacctttggagcccacatctctttggagctgccctgcctttcctggtttgtggcagacatcactaattgatcatctttcctgctgcaaccagaattctctccaacaccgtgcaccactcagagactgacatatggtggggaacagcctgtcatccccagggagggatggcacgtggggacttggaaggtctcagtgagaatcttctagctgatttaagcagcttcctctcagtctctttcaacaaatatttattgagcacctactttgtgtccagtactgtgccaggcattggggatacagcagtgaccagggtggacattacccttaccctcgtggagctgatgttctggtgagaaagacaagtaaacaaataagcagacacttccagacacagatactacaaacacatgccagaggcatatggtggagggtgacagggaaggagtctggggtaggttggggttgggggttctggagggagggtatttattgagacctcactgagatgcagccaccaaaggaaaatatgggggaaggtgtcacaggcagcacagcaaaggcataggcccggagtggggaatgaggttgatagatttaagggacaggaaggaaatagtgttgctggcggggcatgaatgtaggggagagaagcaggagagggtggtggagaccaggctggggccatacatccagggctcggggccaggggtgggctctgaatcacatctccaatgggatgggcagtcactggagggtcaaagcagggaagagacttgggcgggatcccatttcagatccctctggctgtgtgaagcagggacacccagccggagatggccgcagatgtccaggcgagcgaggatggcaacttggacgggggcgatgccagtgaatgtggggagagatggccaggcctggcgggaggcccagggctctgcattcagtttcatttttccttttacacaatcccccccggccccgggcactctgggtcactggactttccctggcactgccggtggggcccacaacctgctggcaatctggcctctccgagtcccagctggttccctgccctgtcctggacccttcctctccaggaacaggcccagctccagttcctctgtcactgtttcccaccacctcctgccccaggtctgcctgggccctgctgatctcctaattctgcctctgctccagcaccccctgctccagccctgctggctgcctgggagccggcagatgcttcctctgagctgccttttccagatcaagtttgcatccaaggaagcgagcctgagactcccagccagctgggggagacaagttcgagggaagtaccccaaggtagcttgccagagggcagcctcgctcttgggcagatttttcctctggtccagtttgttgttggatggagcaggcagatctaccttccccactgactcaggccttgggtgctcggatggagactgtggccgaagagctgtgttgagcagggctctgaggctgcatctatgatactaggaaggagactcattattgattagtgatgcctgctgtggacccaggatggaggataggggccacgctggcctcataggtgtgtctgcggcacccagtaggtcctcaggtctgcactcccctgttgtacctctaaatcttcaagtataacaaatgctgtttgaaaataccttatgatggtgggccgaggtgggaggatcgcttgaggccgggagttccagaccaggctgggcaacagagtgagaacccatctctagaggggaaaaaaaaagaactagctgagtgtagtggtgcacgcctgtagtcccagttacttgagaggctgaggtgggagaattgcttgagcccaggagattgaggctgaagtgggctatgactgtgccactccactccagcctgggcaacagggcaagaccccccatctgtcttaaaaaaaaaaaaaggagaaaaagagagagagaaaataccccatggccttggtttccttatctgtgaaatggggatgatgatgacaagcccccagagggcttccccgcaccctggcagtgactgacacagaggccctgagagctgcgtgttccagagtcatgcagctggtacatggccgagctggtggggtttgaaccctgggtgcctgagtcagggagaacaggcggaacagttgggccagggaggggaaggtgctgcccagagctcccagtgaccttggaccccacttctcctttctgcccagtgtgctcggcacacaggaagcctggcggggcctcccttgcccatcctgtctgcagccgggtggacacggggtcccggcgtcacccaccgccacccaggcctcctccttcctgtgttgtgcaagacgaggcgtcccctgtgtggaatgggcaggcagctctggcgatgggtggacgggtgaatgggggcctctcaggcggggtcactgcccgcggttacctctagcaggcctggcctaagcctccgccccttcctcctccttctcctcctcctctgtttccccaaagttcaggcagccttaagcaagaggctgtgggacccaggaaactggggaggttgtccagccaccatcttgtccccacagagcagacctaggcttgcgcagtcttggagaggtcctaaacaacaacaacaacaaaactataataataatgataatagctgttatagtggagtggcttctatgcaccaggcatgctctcatttaaccacaaatacataaaacgcacctcctatgtgccacgtgtgattctcagacctttacctcatgtcccatcgaatccccggcaacccttgtgaaacagttttttttttgtttttttttaatgattcctttcttcagagtagaaaactgaggctctgagagatgaagctacttgccaaggtcacgcagcacagtcacatcctactgaacatcatcctgttctctggggtgagtgctgtcctggaagttggggggctcagaagctgttggtgcccacctgggaggtcgcccttgcagctgctatcctgaatctcttgcccaagggcttcctctggccacaagagtgtgggaagcaagtgagagacccctgccagtagaggtggggtctgtttgtccccccactcagcttccttgcttctggctcaggggacagtgggaaggtactttctgcgagttgtcccagaggcctctagggggttgggctcctgttgcccactgaggagacctgctcatctaccttccttgtgtcacttcctcactccttcccagtgtttctagaatcacctcccaaatatcccacttgcacccaaaaccttgtcttgggtcagcttctgggagccgacctaagccagcagctataatgctcagggcttaagagctttggaatcagatggacctgagtgtgaatcccgcccctgccacttaacctgagtgtgaacttgggagcctgccccacctctcggaacctcagttcctccatctatgaaaagggaacttacgtgcagaaaaccaagtgactatgagggggatggggcagtgtgagatgacgggaccagagcacgttcctggctgcagaggccacaagtcacgctgtctctgagaggtatggggacaggggcgcagaggaagaatgatcgcgagtcctcagccctgtttggctgacgggggacagggatgggtgggaaagaggtacagcgtttttccaccttccccacccatcacccctgagattccaaatgaacatcgggaccaaccccgggagcccagcggatgttcagggtagggcaaagaacaggtgccaagtttgctccctggggtgtgagactgggcagcctcaagagctgcattggtaggactttcaccaggtagacagcaggcacctcgcccctgcagatcacagcttccagggccacctgtccacagaatcccttcactgatctgtgcttgaggcaggggtgtgtggactgggagtccttcttttactctgggtggggcctcatgctcagagggagctctgtctacccccaccacaaacctgcagtttccctgctacagcgatggcaacctcagccacctggctgcccaggcccccaacctgggttctccctcttgttcccatggtcagcccatcagcaaactcatccacatgtccaagggtccacccccactaccctgccctgccctggtccagctaggatgtttgcagtcgtctcctcattggtctccctgcctcctctctcgccttcctaagccagaggaattctgtaagagctcaagttagatcctatcccttctctgctcagaaccctctatggctcccaactcactcagagcagaagcccacagggcctgcaggatctctgccctggccccgcctgacctcactgcctctcccttctctgttcacccacagccacggtggcctcatctctctgccataaacttgccaattatcctgctgctgcctcattgacttcgcacccactcttccctctggaacagaggacactctcgccagctctccccatggcggatccttgtctagggtcaggcctctgctccaaagtcacccctggggacaccttctctgaccagcccctcattcctatggcctcatgctgtttttatttcttcctaggacttagcacgtatcctagaaattaacctgctggtatatcctgtttcttgtctgtctctttccagtggaatgtcaccatcgcccaggtggggatttttgtgtgttttgttcactgctgtacacccagcccccagcacagcgcctgtccaggacaagtgcccagtaaacacttgggaagcaatgcaagcgtgcgtgcatggataagtatttctttggcagatgagggggctaaggttcagagaaggccctgggggtctcagactcatagcccagtgctctttctgctgacacgccctggtctctggggcagtttgttgcctgttcagcaacaaagagggtgtgcctcgttaggggtcctgcgtgcgaatcgcagtccctgcgtgtcttggctggaggtcaccaccctctctgctccagggcctgtaattaccacttaccctggtcaatgggtccgagagattacccttgtaggcagggctgtggccagggtgctcacctggcccccagcaggtcccatgggcactgtctggccgggcttcatggctgacattccaggtacatttctagccctgggctgccatgggcagagggtggggagagggtcgtgggcttcaggctggacaaaccagtcagccttcccagctgggccgcctgaccacccacttcctgtggggctccttgaggcctggagggtggagggggtctctgttcaacccccacccatgccctcttcccttctctccctcggcaggtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgt

SEQ ID NO: 44 - DNA, 85 bp, Homo sapiens
ctgcaccaggatggccgagtggttaaggcgttggacttaagatccaatggacatatgtccgcgtgggttcgaaccccactcctgg

SEQ ID NO: 45 - DNA, 519 bp, Homo sapiens
atgattatctaccgcgacctcatcagccacgatgagatgttttccgacatctacaagatctgggagatcatggacgggctgtacctggaggtggaggggaagatggtcagtaggatagaaggtaacattgatgactcgctcattggtggtaatacctccgctgaatgaccctagggcgaaggtacagaaagcacagtaatcactggtgttgatattgtcatgaaccatcacctgcaggaaacaagtttcacaaaagaagcctacaagaagtatatcaaagattacatgaaatcaatcaaagccaaacttgaagaacagagaccagaaacagtaaaaccttttatgacaggggctgcaaaacaaatcaaggacatccttgctaatttcaaaaactaccagttctttaattgtgaaaacatgaatccagatggcatggttgctctattggactaccgtgaagatggtgtgaccccatatatgattttctttaaggatgatttagaaatggaaaaatgttaa

SEQ ID NO: 46 - DNA, 591 bp, Homo sapiens
atgttttgaagatctgtattgcagatgcttcatcagtttgtaagacatgagtccaaaatatccagcagtttggtttttgaaagatctctgaatcatgtgcagttactttggcaagtgggccaagaccctgtgatttaatagttgggggaaaaaaaatctagtcaccacattttctctgcccacaaatgagatatggcaatcaagggaaagtgaggtatacgaaatgggtgcttagatgggttaatttacttgttaatattagggaaataatgtacagtactaaagagctaattaggaagatgattattagggtatgaccatgaaaggaaaggagtttttctataataggtgacgtagtgtcttgaaatcctagctgaaatggatacgccagtcaaaagtcaacacggcgcagaacatcagtattcctacccagcctgagaggtgtggcacatcagtatatgaaaaagaggtctagaatttatgtgggaaggaagtaaactatggtgaatacttggatacaaataacatgaggcagcaatcatagctgataacattatatttctgagggaccagacaaaagagaaggcgtag

SEQ ID NO: 47 - DNA, 2415 bp, Homo sapiens
tcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggtgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctta

SEQ ID NO: 48 - DNA, 91 bp, Homo sapiens
cgcccgcctcagcctcccaaagtgctgggattacaggcatgagccactgcactcggccaagactgcatttctaactgtgcccagccactct

SEQ ID NO: 49 - DNA, 994 bp, Homo sapiens
atgacagatcaggtctttgtgacactgaccacaaatgatgcctacaccaaaggtgccctggtcctgggctcatctctgaaacagcacaggaccaccagaagactagtcatgctcgccaccccgcaggtctcagactccatgagaaaagttttagagacagtctttgatgaaatcatcgtggtagatgtcttggacagtggtgattctgctcatctaaccttaatgaagaggccagagttgggtgtcaggctgacaaagctccactgctggtcacttacatagtattcaaaatgtgtattcatgggtgcagatactctggtcctagcaaatattgatgatctttttgagacagaagaattgtcagcagcacctgacccagggtggcctgactgcttcaattctgaatttatcagccttcagttgaaacatataatcagctgttgcatcttgcttctgagcaaggtagttttgatggtggagaacaaggcatacggaacacattttttcgcagctgggcaacaacagatatcagaaaacacctgccatttatttatagcctaagctgcatctctatatagtcctacctcccagcatttaaagtgtttggtgcaagtgccaaagttgtgcatttcctgggacaagtcaaaccatggaattatacttatgatcccaaaacaaaaagtgtcaaaaatgagtcccaccatcccaacgtgactcatccagagtttctcatcctatggtggaacatctttaccaccaccgttttacctctgcttcaacaatttggccttgtcaaagacaccttctcatacgtaaatgtggaaaatgtctcaggagccatatcacatctgtcccttggggggatcccagctatggcacagtctgtgtatcctcagaagaatggaaggagcggtgggaacagggctagaccgattatatgggagcagattcctttgacaacatcaagaggaagcttgacacttacctccagtag

SEQ ID NO: 50 - DNA, 16318 bp, Homo sapiens
tgactgaaaaggcagagtgtcatttgaggatgcgagtagtataatcatacttttttgcatggaagaaagcaagtgagtactttaaactgtggaattgggatagcaggggtggggcctatgatatgaatattcatacttttcatttacatttttatttttattgcagtaaaatctagaaaatgttgagaggatttttaaaaatttaaattacattcaattcccatacatctttctctagaaaggttctaaaggaaaagaaaaaaatagctacatagagaagtaaggtatgatgaactatcttgaagactgagggttttctactgttaataagtaagttttcaaattatagattgaatatctactttgagccaggctgaggactagggagacaattgtgagaaaaacattacacaatttctacccctttggatcttactgtctataataaagggaaatagacaaataatagtcataaagcatgatagacgctttgatgggggaatttcaggatataaggggcaaatttctgccctctgtgggggtaattaccaagtctaggaaaactgaaaattttcccagagaagacgacgttcaaactataatctgacgtaaggttggaaagccaggaaaaggaatatgaaatgaagggagaaagttccaaagaacgggaacaacatgtgcaaaggtcctgttgtgggtgagaataaagcaatttggaggaattaaaagccagtggagtatagaattctagagagatatggattgagcattcctaacctgaaatctgaaatgctccaaaatctgaaaaaaaaaagtattttcttattcttttttgtcttcttattaagagatggggtttcaccatgttgctcaggctggtctcaaactcctgagctcaagtgatcttctcacctcggcctcccaaagtgctgggataacaggcatgtgtgagccactgcacccagcccaaaatttgaattttttttttttttttttttggagacagagtctcactctgtcacccaggctggagtgcagtggcaccatctcggctcactgcaacctctgctgcaggttcaagcaattctcctgtctcagcctcctgagtagctgggattacaggcatctgccaccatgtccaactaatttttgtatttttagtagaggcgaggtttcaccatgttggccaggctggtctcaagctcctgacctcaagtgatctgcctcccttggcctaccaaaatgctgagattacaggtgtgagccaccatgcccagcccccaaaatttgaaaacttgagtggtgacgtgatgccacaagtggagaactctgcacttgacttcatgtgatggattgcagacaaaacatgggtagaaactgaaagcctgccattgtttgttattgttgttgtttaacagctaatataggtattctggggatgatactgccctatttaggtaccctgaacacattattttttcactgtattaagggtatgccatactttttactgttaagtacttaagtgtgaatggtataagaaaaaaattgcttatgggtagcatatatattcagagacaggaatgatgatgatgccagacaatcacagattgtccatatcagtagctcacatggtgacacctctgctttctgatggttcaatgtatacaaactttgtttcatgcataaaattaaaaatttgtattaggtcggtgcaaaagtaattgaggttttgcctttaaaagcaatggcaaaaacttcaattacttttgcatcgacctagtataaaattatcttcaggcagggagtgatagctcacacctgtaattccagcagtttgaaaggccaaggcaggcagatcacctgaggtcaggacttcgagacaaccctggccagtatggtgaaaccttgtctctgctaaaaatacaaaaaattagccaggcatggtggtgggcgcctgtaatcccagctatttgggaggctgaggtaggagaatcgcttgaacccaggagatggaagttgcagtgagctaagattgcaccattgcactccagcctgagcaacaagagtgaaactccatctgaaaaaaaaaaaattagctgggcgtggtggcatacacttgtgagctcagctacacgggagctgaggcaggataattgcttgaacccaggaggtgaaggttgcagtgagctgagattgctccactgtactccagcctgggcgacagagggagactccgtctcaatcaatcaatcaatcaatcagtcaatacaattatcttcagcttaggtgtataaggtgtgtttaaaggctgggcgcagtggctcatgcctgtaatcccagcactttgggaggccaagacaggtggatcacaaggtcagcagatcaagaccatcctggctaacatggtgaaaccccgtctctactaaaaataccaaaaaaaaattagccaacatggtggcacgcacctgtagtcccagctactcgagaggctgaggcaggagaatcgcttgaacctggaaggcggaggttgcagtgagccaagatcacgccactgcactccatcctgggcgacagagtgagactctgtctaagaaataaataagtaaataaataaaaataagatttgtataaaacaaatgacttttgtgtttatacttgggtctcattcctaaggtatctcattctgtatactcaaatattccaaaatccaaaaatgtccaaaatctgaaaaacttgtggtcccaaacatttcagatgagagatactcaacatgtagtagtgagaaaagaagctaggaaggtggacagacaccagttccaagagggccgctcaaactgtaataaggaaattgaactttattctgagggaatgagaagtcacagtaacatttatgcagaggacggaagtgatgctacttaaactgtagaaagatcaacctaactgcagtttggagaatggtttagaagggaggaaaagtgaaggtggagaacccagtaaggagacaaaaccaattagccttcctaggtaaccactttggaatgaaaagttgaatgaaaagttgagttttgttttcttatgcagtgtacaatttttgtcttttgtcttgccttgaagcagttttagtgtgatatgtctagatgtggctttctttatatttatcttaatggagtttgtagaatttgttgaatatgtgttttgaggtctttcattagcttggaaaattcttggtcattatttcttcatctattgcttttgtttcattgtcgctctcttctccttctgggacattaattacataaatgtgagaccttttcaccaaatcacatttgtctcctatgtttgtttttttattttataatttttttttgagacagggtttcacactgttgcccaggctggagtgcagtggtgtgatcctagttctctgcagcctcaatctcctgggctcaaacaatcctgtcacctcagcctcccaagtagttgggaatagagacatgagctacctgcctggctaatttgtaaaattttttttgtagagacagggtctcactatgttgtccaggctggtcccaaatctcctgggctcaagtgatcctcctgccttggcctcctaaagtgttatattcttctgtctcttcatgctaatctcaatatgttcttctgcctctcttctcattcacagattctccctcagctatatctaatcttctgttttttttttgtttttgtttttgtttttgtttttgagatggagtcttgccctgtcacccaggctggagtgcaatggcgtgatcttggctcactgcaacctccgcctcctgggttcatgccattctcctgcctcagcctcccgagtagctggggctacaggtgcctgccaccacacctggctaattttttgtatttttagtagagacggggtttcaccgtgttagccaggatggtcttgatctcctaacctcatgatccgcccgccttggcctcccaaagtgctggaattacagatgtgagccaccgcgcctggcctaatctgctgttaagtctacttattgtgttcttaattttagttattgtatatatttctataaattcacttcaattttttatgagttccacatctgtgctgaaactatcttgtcatttaatttctcgaacatattaatcacaactgttttatagtttgtgtctgataacttccatacctggatctcttgtgggtctgtttctattgtctgattttttctcttgattatcagtcacttcttatatttttatcagcatagttttttgaaatggaaaattgtgttttaaaaactatagagatgacctgaggttctagttgatatgttatttaagggaggattcactttagtttcaacaagcggttgggaatacatataataagcaacttaagtcctgctgtgcctcctcactggccacgctccttccaggcaccagcttctctgagccaccaacctgcggctgccctggcccacctgcgcctctggcagcaccatgacagatcaggtctttgtgacactgaccacaaatgatgcctacaccaaaggtgccctggtcctgggctcatctctgaaacagcacaggaccaccagaagactagtcatgctcgccaccccgcaggtctcagactccatgagaaaagttttagagacagtctttgatgaaatcatcgtggtagatgtcttggacagtggtgattctgctcatctaaccttaatgaagaggccagagttgggtgtcaggctgacaaagctccactgctggtcacttacatagtattcaaaatgtgtattcatgggtgcagatactctggtcctagcaaatattgatgatctttttgagacagaagaattgtcagcagcacctgacccagggtggcctgactgcttcaattctgaatttatcagccttcagttgaaacatataatcagctgttgcatcttgcttctgagcaaggtagttttgatggtggagaacaaggcatacggaacacattttttcgcagctgggcaacaacagatatcagaaaacacctgccatttatttatagcctaagctgcatctctatatagtcctacctcccagcatttaaagtgtttggtgcaagtgccaaagttgtgcatttcctgggacaagtcaaaccatggaattatacttatgatcccaaaacaaaaagtgtcaaaaatgagtcccaccatcccaacgtgactcatccagagtttctcatcctatggtggaacatctttaccaccaccgttttacctctgcttcaacaatttggccttgtcaaagacaccttctcatacgtaaatgtggaaaatgtctcaggagccatatcacatctgtcccttggggggatcccagctatggcacagtctgtgtatcctcagaagaatggaaggagcggtgggaacagggctagaccgattatatgggagcagattcctttgacaacatcaagaggaagcttgacacttacctccagtagaaacactgcattttcctgtggacacatccacttcacaagccttgtttctgatacttagtatctagagctgggttgagaaaagtctgttatggttgctagagattttcacaaaaacttatcagatgagaggtttttgtaggacaacaggtgagaactgggcaaaagttgtgaagcagcaattccgttgttacatggacagtgttttgctttttaatcctgtttagcttgtttcagaaattctcacttttgttgactgccaacatacaaagtaggggaaactcaatattaagctgttaagatggctgcatcaattcttaaaatctgcagagcctggttccaaatcagtcactcccttcagaagcagacatggcatctgatccttgcttgcttgctggttgtacctacctttcactagacctgcattttggaattgcccagtgctgccagagtgagtgattgtaattctgttttcaggtaaagatagcttatattaacactgctgagtgattcataaacgtatcaacaaatagcattaacccattttatttcctggtcttagtgtctgaagatgttcaccagttttctatgtacagtaaggcagcatgctaaaatgcttttgttcagtctgtatatttgaaaatagcaaggtgttctctgatggttacctgcagtggaaccctgtatgaaaaataaagacttactgccataaaaaataaaaaataagcaaactttgggaggccaaggtgggtggatcacaaggtcaggagttcgagaccagcctggcaaatatggtaacaccctgtctctaatacaaaaatcagccgggcgtggtggcgcacgcctgtattcccagctactcggaatctgggaggcagaggttgcagtgagctgacatcgtgccactgcactccagcttgggcaacacataagactccgcctcaaaaaaaaaaaaaaaaaaagcaacttaattcaatcagggattaggagggtttctgtgggtttctggacctcagtctttgtgagggctagtctatttttggcccatcttacttgtaggattctttagggttcccaactggtttagttgttcattgctgtatctcaaaccacttcaatatttgtggcttaaaacaatagtgatttctggcaattatctgggtcgactgaacagttcttcatttggtattggctgggatcattcgtaaagctgcattcagctgggcacttggctggggcattttagtaagttttcacatggcatctctatacaatattccatccccgagggcctctccacatggcctatttctccactgggataaccttgacttaagcatggaggctagattctaacagggagaaatccaaaagtacaagtcccagtgagcaagttcatatttaatctttgtttgtttcacctttactaatgtactattgataaaaacaaatcacataagccagatgcagtggtgtacacctgtactctcacctactcaggaggctgagacaggagggttgcttgaggccaggagattgaggagggagtgtgctatgatcacacctgtgaatactgcactccagcctgggcaatgtagccagacccccatctctcaagacacaaacaaaagaaaacaaattatatggctaagcccgaaaccaatgtgaagaggaccacccataggcataaatcctggaaggtttggttcactagcagccagctatgtaacatattaccatatcaaatgaaatcctatggtgcttaccagagtacctcctctttaatggctcctgatctccaattcttgtcatctcagccctgtaagctctcttcagcttttgggcttctcagttgctgattaggaatcagcaaaaacattaaaggaaaagcaataccaaatgatgggttcacctctctgtacttcctttctctttgggattggtcctttgagttcacgttttcttagaaactttccagtgccttcaaactggtatttcctgtattcttcccagcttttctagttgttctcagtaggagggatggtcttaagcaagctgatctgtattgctggctcacagtggccaggggagtagaaagagctcaaagagaagtgactggttgggtcccaggacttctagtctcagaaaatccctcagtctctagcagggcagggcagaggagccccagaaccacctttcctcaaagtactttagcctatgcaagcttagactgttgtcctttcactgttaaccagtattaaccagttaaccagttcttctgcagacaaaagcatcaggaagtacccaccatgtaccagtgggcccttcttgatgctcttgattgcagaggagccctgcaacctgaataaatcctcctggaaggtaagtgggggagccctaattaaaactgtaattcaatgtctcgatattttggcaaatgaaggttcaggtgagttttaattagtttcagaaaaagcaaagtaaaatgatatttaatgtactggattttgatggatacaaatctatatccattatatactatatgtttgttttttctaaaaaaaaaaaaaaaaaaaaaaaaggcaaccagaaaattgtcatcaatgttcataccttgaatactctaattgagtattgactttttttggtaacagctttcttgagatgtataatttacataccatacaatttacccatttaaaatgtacgattctagttttcaatgcattcacagatatgtgcaactatcactgttggcaatttcagaacattttcatcacctaaaaggaaactctgtagcctttagctatcactctcccatttccctgtttcccccaacgcccccagagataagcaaccactaatctacttttggtctctatagatttgcctactctagaaaattcatataaatggaatcttatgtgatcttttgagtctgcttctttcacttagcatacctttacaagatttattcatgttgtagcatgcattagtacatcattccattttatggctgaatagtattccattatatggatattttgtttatctattcatgatggacatttgagttgtttccaacttttgggtattatgaatgatgctataaacatttaagtaaaagtttttgtgtagatatatgttttcatttctcttggacataaacctaggacttggattgcgggtcaaatgttaattctatatttaattttttgaggaactgccaaattgttttccaattttatattcccaccagctgtgtatgagggttttgatttctacacatcttctctaatacttagtaataagtattaagtatctgactttttttttttttgagatggagttttgctcttgttgcccaggctggagtgcaatggtgtgatcttggctcactgtgacctctgcctccagggttcaagtgattctcctgctttagcctcctgagtagctgggattacaggtgcctgccaccacgcctggctaattttgtatttttagtagaggtggggtttctccatattgttcaggctggtctcgaactcccaacttcaggtcatccgcccgcctcagcctcccaaaatactaggattacaggtgtgagccactgtgcccggtgtttgtattttttttttttttttttagtagaggcggggtttcaccgtgttggtcaggctggtctcgaactcctgacctcaagtgatttaccctccttggcctcccaaagtgctgggattacaggcatgagccaccacacccggtcaagtcttgtccttcttcaggacatttgtttctaaatattttaccttttggtgctattataaatggaattgttctcttaatttcacttttgaattgttcattgcaagtgtataaacatacaattgaattttatgtattgattttgtaacctgcaaccttgctgaatttgtttattatttataatagtttttgtgaattccttaggatttttaatacgcaagatcatgttgttatcttgtatattaatgatatataagataatatatctttccaatctggttgtcttttatttatttttcttgcctaattgccctgactagaacctccagtagagtgtagaatggaggtggtaagagcagccatccatgtcttgctactgatcttatggggaaaatacccggtctttcaccattgagaatgatgttagctgtgggtttttcatggatgcctgtatcaagttgagagaggtctcttttgttctttttttccttattattatttttttatcatgaaaggtattggatctttgtctccaaatgctttttcttcatctattgagataatcatgtcattaaaagaattctgttgatatgatgtgttgcattaattgattttcagatattaaaccaaccttgcattcctggagtaaatcccacttggtcgaggtgtataattcattatatatggtactgggattcagcttgctaatgttttcttttaaagcatagtggccaggcacggtggctcacgcctgtaatcccagcactttggtaggccgaggcgggcggattatgaggtcaggagatcaagaccatcctggctaacatggtgaaaccccatctctactaaaaatacaaaaaattagccaggcatggtggcaggcgcctgtagtcccagctactcaggaggctgaggtaggagaatggcgtgaacccgggaggcagaggttgcagtgcgctgagactacgccactgcactccagcctgggcggcagagtgagactctgtcttaaaataaaaaaacagaaaaacgataatattggggaaagagagcaattagttttatttttttaattttttattatttacttcattttatcatttttttttgagatggagtctcgctctgttgccaggctggagtgcagtggcatgatctttgctcactgcaacctccgcctcctgggttcaagtgattctcatgcctcagcctcccaagtagctgggattataggcacgtgccaccccaaccacctaatttttgtatttttagtagagatgaggttttaccatgtttgccaggatggtctcgatctcctggcctcatgatctgcccaccttggcctcccaaagtgctgggattacgggcatgagccaccgcacccaacctattttttttttttttttttgagatggagtctcattcactgtcgcccaggctggaatgcagtgttgtgatctcggctcactgcaacctccacctcctgggttcaagtgattcccctgcctcagcctcccaagcagctgggattacaggtgcatgccaccatgcctggctaatttttgtattttttgtagagacagggtttctccatgttggccaggctggtctcgaacttctgacctcaagtgatctgtccccgctccttggcctcccaaggtgctgggattacaggtgtgagccaccgtgtctggccaagagcaattacttttataggaatctaggttctgagtctgtgctgggaaaaaaaaaaaagtcagtatggtcaatggagaaagcttgaagaaaaataattcttaagtttccctgtcccttagtaaagacagtatattcctcaatggagagtcatttgaaatttaatgtggtattgtccttcacttaagaaataatgtgattgataatctgactgatctaatgacaacccaacattagcttttagctatttttccagcagcagcagcaatgagttgttctcagcccccatcactaaggcagacctatttcctgggcactgcaaattggttccactgcctccactttggaatacattttacttatagtagttgagctggattcatacctgatagtccatagcattaaaaaatgcatgatattggattgtcaaatagagaggagacatgggagttaagaccaaggttttgactaccaaacccaggacttttccttgattcattaggcaataggcaaccattaaatgttttgagtcagggaataccatgattgaagctgtactttaagaagattaaactggcattagtgcattggatataaaagatcaaataaacagctgggtgatgagaatgaaaagcagcttgcagaagtaaggtaaattctgcaggagctggtaattagatttgatgatcaagggaaagggaagactactagattttaagactgggtaattgaaacaatactggtggtattttctgaagtcagagttcgactagaaggaaaggtgatggctttggccttagatgagttgagatttaactaggaaagtttgcctgcagacttccacaatcatatcccatgcaaacaattggaaacaaaacagccaaagctaataagcatttacaaggaaaggacactggggctatttaatttagaaagtgaaaaaaatttagcaaaaaaagagaaaggtgaaaggatctatttatttctctgatgacctagttcctagcctttaactcagcatactgacctacccgtgacactatatgccaggtgaagcaagcaaagcttgttttgggagaagtgccccaagcacacactgtcctttttgagatggagtttcactcttgtcacccaggctggaatgcaatggtgcgatcttggctcactgcaacctctgcctcccaggttcaagcgattctcctgtctcagcctcccaagtagctgggattaaaggcgcctgccaccatgcctgcctggatcattttgtatttttagtagagataagggttcaccatgttggccacgctggccttgaactcttgacctcaggtgatccacccgccttggtctccaaagtgctgggattacaggcgtgagccaccaggcgcccagcccacaccatccatttttaccccattgatcctcattttcatctccctgctcctggatagctggttccatattccagctttccatattgcttttgatctgcattgtggtctcttctggctattggatacctctttccatgggctcttagaatgctcagatttcagcaattgcatagtttctagcagaagacttcctctgccagtccagcccctcaaaaccctcctgctcagattggccccagaatctctgccaggagatggagattggggcagtttatcttaatttgattagcaggtttagcttctgcaaagcacattcttacaaggaatatttgagaatatgtagtcataatgtaacagcttgcagttctctttcttattctataactgattgaaaattctaataagaaatatgtgtaccttgatggcaatgttgaaactcagttgtttagaaagatggactcccctatatttagctgaaaaatcagggtttgaggcttttagttccctctgaaaccatgaggacttagcccttgagatccagtttaattctaacatgatttagaagtctgtttcatttccctgatgttgagtcaccaggctggattaattttccagggtgttgtgctaattataggttagtggaggaatgggctaaaccaaaatggcaacaagcgaaaaagtagcaggttactctgagtgctgctggagtgtaaagctatttataacatcacaattgaatggctactattaattaataagcatcgcagtgaccttcaattttcaaagacgttcaccatcattttctagttaatctttcccatccattactgcattcgttttatatgaagggcagagctgatgaattacttgcctgaagtcatgtctgtggttaagccaaaattacactttaaacagatgaataataataaaaataatatatttgtggagtgtttttcaattttcaaaggatcttttccttcgttattttatgactctttattcttcatgcttactaagcatccctatgaaggttttctgctggttagctcaggatagcagaagagaggagggttcagtttatgggtatcttggttaaatttgaactgaataggaacataagaaacacaacattcaggagtttagaggtctgagttgtatgatctttgttcctcatcacctttttttgttaggttttcttggcctttgaggacccatagagcaaacattcagtcacattaagtctttgtttttcaaggctttgattttgttccattcaaacctaaaatgtatgaatccgcagaatttgatgtcaaaagaagcctcaatttaagaaagtttggttaatccaaagattacttacattagaatactggaatacaatctccaaatagcttagctgatcctggtgtctgctctgaaccttcatgctgtataccatttctgctccctttttctcactcaacacctgggcttttcttgacccttatagacccaggatgtccatacagtacagttgatcctcccagaaccttctatactcccacaagcaaagaaacacatagttgcatggatgcttaaaaggtcatagagtctaacattgtcatcttacaaataaaggaactgaggctcagggagtagaagtgacttttccaagtcttatagtaattgccagcgctggtgtaaaagctgtcagacttttgctcctgtagaaaaggaactgaaaggcatcagaaagtcaaactctcactgcagcaatatttaccgtagcacaactactgagttagccacatatatcatagagcagttcccaagatgttcacggatgttctttgacatagggttttgtggtcatattactttgtgtagttgggaattcatgatgcagagttgaagattggaaactctggaaagtctcttaggaaggattttgttaagcatttctcaaatcatttcttcgttattttcttcccaaagaaaatctagtaacagctcgtgtaattagtgttcattggtgatagtgacactttgatgaacaaatacatggtgtctgttaaagcagataccaagcagtcacaagcaggctgaactgttgagttctttgttgcaggttattttatcttcacaacatcttaggattaggtattactattcctactttacagatgggctttggacttgttgcatgtgacagaaattgagctcaaacttgcttcaaaggaaaggagtgttattagttcctggaactgagaagcttggaacattgaaaccaacaacgttctttctcctatctgtgcttctgtctttgtcaagtctattcatcccttttacagacagatgtcctcacaagaatgaggatatggctgtgcacagcttagattcactccgtaacactgcagctagagacgaaaggactactgccagccccacttaaccagatcctggagagggactctggccagcaaggccagcccctctgctgtctgtctctgtggaggaaaatgggtaccattgttaaccgaaaggggtcctgatccagactccaagagagggtttgagaacgaattcagggtgagtccatagagtaaagtgaaagcaagtttattagggaaataaagaaacaaaagaatggctattccataggcagagcatccctgagggctgctggttggctatttttactgttatttcttgattatatgctaaacaaggggtggattattcatgagtttcctggaaaagggaagaaccccagaactgagggttctactccctttcagaccatatagggtaacttccagatgttgccatggcatttgtaaactgtcatgatgctggcgtgtgtcttttagcatgctaatgcattataattagcatataatgagcaatgaggaattttgtcaccactttggttttggtggggtttagctgtcttcccctgccccccacccccccaatccagttttatccgcagggtctttgtgatctgtatcttgtgctgacctcttatcttatcttgtgacttaagaatgcctaacctccttggaatgcagcccagtaggtctcagccttattttacccagcccctattcaagatggagtcgctctggtttgaatgcttctgacgccgtgattggtttagactcaatctcacactctctttgtggcataggagatgtgttttcagaaatccagaaaggagcttagacaaaacagtagtctcagggaacatagctagttaagtgatggaactgagatttgaagtcagatctgtctgactccaaagtccatgttttttttgtttgttttctctgtggtttgttgtttctatgatgtggcttctgtcaccctgactctccttttgtcttttgtccctcaccaccttctgtagtttcccagtcctcctgactcataccagggaagcctcctgtgtccatatacaatgaaggctcagggacttctaactcctggtggactggctgattgagccctggaagtgtactttctccttcatttccctcctgactctcgctgggagagttgtagactcctgggaaacacaggtctatggcctgcctaagagaggaccagcccacaccaaagaaagtgccactgcctcctcctcctcagtggatgccaccaagccccgaggaggacaaccttttccttaatctccttgaaacccaggcaaactttgacaaaaggaaaggtgtttccagtgtgttgttaactgaaccttggttgcttggcagtatgcagttcttgtctaatttaccccaaggaaatgtctgtgtgatgtatttttaatttgctgaagaaggataagtgttcaaacctttgtacatttatgctgaaattaatttttcaaagtccacataacttcagtgctgtgggatagtccttaagaacagaaattatgaccaaccataataaatgacacatttttgtgaaatgtcat

SEQ ID NO: 51 - DNA, 2049 bp, Homo sapiens
gctcccggaagcggcacgggaggcgaccgtgctcgccgttggcaggctagggttggcggcggcgtattctgtttgttttaaacgaaggagcggagggaggggccgcgccgcggagcgtgcctaaggtgaaagggctgccgtgcagccaggcagaggcgaggaaggcttctccatcgtcgccaccgcccgcctgtttcgccggcaacaggttcccccgggacgggaggggccgcagcgccgcgcagctcgcagcgctgaacgtcgcggaaatcccttggccggccgagcctccgcagccgcgacccggcttctctccgtccgagtcccccgagcctctccgaacccccgttggacttcccctccctggccggcgccgcccgacccgctcccccatcctagagggaattccctgcgccgcggctgtgaggcacctccaccccggcctgaaatgcaccgcagtcctgaaggaaatccaccctcatcccacgcagattcacccgcaacgctgcctgaatacgcctcgctgcccacagaaattcctgcccaaaccagacgcgtggaccacccaagacgaaattcacactcgaccctagccccgccagcccttgccgaaatcaccctaaacccgttgaaattaattcccagctgtccgaattttccttccaacattaactgactacctgtctccgccaagctgactgaactctaccgaactcttaccctgaaagcccctgagagtccaaaatatatttttccagcccgaaatctaaatcccagttctctgtatgaaaacctccagaaacccagactcttacttccttcggccacggactcgttcgaacatcgtggacatcaccttcccacatttttaccgcagtctttggctccgattctttgtccctgcctcttgggcagcatcctatccctgtttctttccacctttgaggattcctctacctctttaaaggcctgctttctttgctttctcttctcacctttggcattggcacactggggtcatatctttagttcccttgactccaccatctaagccaagggtgtccaatcttttggcttccctgggctacattggaaggagaaaaattgtcttggaccacatataaaatattctaacgctaatggtagctgatgaaacttttaaaaaatctcatcatgttttaagaagtttacgaatttgtgctgagccgcattcaaagccgtcctgggcctaagtccttgctatttttcctcttcaatttccttcaatccatagttctctaggttattttcccaccctttcccaagattcggatatcccttcattcttgctgagttcatctcctatgcctattcctacatacttgctgagttcatcttctaatgtcctcatcctggtttcttcctgaacctgaaatccagctaaccttactttttcatcccatcaaacccctgctgttgccagcccagcactcacgaagatctttacatacaccaaatattaaattagggccggtacctagacattgtctctgcactctgctggcatattttcccctggaccacgaacccttcgtacctagtaacttgccacctgtgtttataaataccagcaatttgatttacagggtgaatttgtcactattgtttacttttaaatgaagttactgtatttgttgtttccattaaaggcgacattataaagcctaggcctcatatccaaagcaaataaagtctcaattttttaattaaaagtaacaaaaggaaacctcacacttctgaacaacaatgacaagaaggaatgcctataattggtttgggtcacaatgtacatattgaaataaaatttttattaagtatcaacttccaggtacacaatgaagttttaaatgtttatctgtgacatatgaagaacaaagcaatctaaactgatgtaagcaggctgtcataaggtacatgctgaggaatttattcaacaaattgaataaatttattcaataaataaataattattcaataaataatatatttaataaatttaataaatagaat

SEQ ID NO: 52 - DNA, 405 bp, Homo sapiens
ccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtag

SEQ ID NO: 53 - DNA, 426 bp, Homo sapiens
ggcttgtagatggataactgagttctacaggtagggatttgtctaggtcttaagcttgaggtaaccaaaagaggattagacttggattttcaagcctgtgtaaagcatgcactcataccctgtcctcagtgggatttggacatctttgctactggttgctggggggaaaagatgctgtgggtggaaaatggtatattagccaagtgactctcaatggaccattcatatattttctactccctagtaaatttatcttaacatattaagaaaacaaaatggttcgtaagtggttgtgcttttaaaatttatggatttagcaacattttacagatttcacttgtatgactgagtttttgctagttagatgaattgttaaaaatcttaaagaaacgaatgtatcctatagtaatataatttgaaaacaaa

SEQ ID NO: 54 - DNA, 334 bp, Homo sapiens
gtaaagtttgctcaaagccttcagtcctttgcagagcagcaagctggatgccactgtggggctctaagagtcctgaattcttactgggttgatgaagattccacataaacattttttgatgttatcctcattgatccattccataaagctatcagaagaaatcttgacacccagtggatcaccaaaccagtccacaagcacagggaaatgcatgggctgacacctgcaggctgaaagagccatggccttggaaagggccataagttccaccacactattggtggttcttcccctgaagcttggagaaggcacaatactctccagctccaccgtt

SEQ ID NO: 55 - DNA, 103 bp, Homo sapiens
ggctggtccgagtgcagtggtgtttacaagtatttgattataactagttacagatttctttgtttccttctccactcccactgcctcacttgactggcctaaa

SEQ ID NO: 56 - DNA, 406 bp, Homo sapiens
accatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtag

SEQ ID NO: 57 - DNA, 848 bp, Homo sapiens
atgcactacaaatttagtggcttcaagcagaagttggtgggagcatgggctttgaggcctaaagcccacagggattaaagcctgtggtttcccttcccctcctttcccctcctctactctctcttcccctccctccccccttccctcccctccgcttccttccccctcctctcccctgtcccctcccctctcccttcccctctcctcccctccctcccttctttccttccttccttccttccttccttccttccttccttccttccttccttccttccttccttccttccatctttcttcatggagtttagctctgttgcccaggctggagtgcagtggtgcaaacttgagtcactgcaacctccacctcccgggttcaagcaattctcctgcctcagcctcccgagtagctgagattacaggcaccagccaccatgcctggctaattttttgtatttttagtagagacagggtttcaccatgttggccgggctggccttgaactcctgacctcaggtgatccacctgcctcggcctcccaaagtgctgggattacaggtgtaagccactgcgcccagccaagcatgtggttttcacagaagcaccacctatatcatgtttgctacaccaactaaactgacctccaattccactgcatgtgaatctgctgggaaaaacaaagttccagaactgcagaagtttttccagaaatctgacagtgtgaccatccacctgaaacaaggcctgcctgaccaaatgcattatgggacagccatggtgctgaactgtgggagggaccatctactacctgatcgccctcttcatggcttcacagccctcaaactaag

SEQ ID NO: 58 - DNA, 4445 bp, Homo sapiens
gggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacca

SEQ ID NO: 59 - DNA, 866 bp, Homo sapiens
gctgacttctgttttttccccaaacgtgtcagactcaaattacaatagcatcgagaaccgagaaaagtgattttcacattgcatccatataaagagaaactagagaaaacaaaaccaagtgtttcaactgcagatttcaaagtgatgcagcttagaaattataaaatttgtattcctcacataaatgaccaactccaaccttgcccaaaaccgggttgtaacatactagtccttcctttgccaaatattttgcctccaattaataaggtgggttgccaagatgcaccaggatactttgcagaattggcaccaacaattttgtctgaccaatagacaacttgtttatgagactccagaagtatgcttacccagaacaaacatgagtgaagaacaaggtaaaagcatcaaggatattcctgcaacaccatgaggggccagctctagtcatatatgactgcccacgaccaggacagcaaggcttcaaaaaagtctggtgagcaagagaggaagagactgatacttgaagagctgggaggccatgttggcaccacaggcaataattgctgcaagactcattgacgccaaaactataaaggctcattttattccttcacatattcaaggctttttgctgcaagtttctggctcaagtgttggtgtatagtttgtgggaaacttcactacagacacaaagggttgggttcacctatagttccatgcaggttgacttgggtgcccaacactccctggagaagggcttttcccttcttgttaccagcctgccctttcccactcccaaacctagaagattatgttatgccctgaatttgctaagagaaatgaagatgaaagggaaggaaaagcaa

SEQ ID NO: 60 - DNA, 715 bp, Homo sapiens
atgaaaccaagtgtttcttcaatggtagatgtcaatttcaggaactctgttaaaagtagtttatcatcctgaaactcacgaacaggtcaaagcttgcccaaaacctagttctaaaatagcaattcttcccttgctaaccattttgtgtctgattaatgaggtagattaataaaatgtattgtgacatttcacagaactagtgctaacatttgagtaccaatggccagaaaacaagtttggagctctagaaacatgcttaccctgaacaaaggcatgtgtgaaacatagtagaggtgtgaagaagattcctgaaatctcacaggtgaaatttcagtcatttgattggcaatgaccaagaggacaaggcttcggaagaggactaagatgagaaggattaagatggtaacttccactcagaaggctatgttggcttcatgggcaagaagtgctgcaagagccatttcacccacagctgtgaatttgtgttccagtctacctctgttgaaacctttctgtggcaagcctctgacatcaggcaatgtggggtccatggcaggcttctctgtaaagggttaggctcaccagtagatctatgcacgtcagacctgggtgcacaacacttaaacaagagcatttcttttaccagtctgcacttttccatccccagacttggagggtaacattgttccctaaatatacttacaggaataacaaa

SEQ ID NO: 61 - DNA, 463 bp, Homo sapiens
ccaaacttctgtatacagcagaatcattccacccaggcagaggacggagtcaaccatctggtctactttcatctgaatacctatatcttatcacctgctggcttttagtttggccacaaggatgtggccctagaaggcatgaacttttttcctagatctggcagaaaaagttgtaaaggtccaaaggcatcccgaagttgctaagtcagacagctgcacccacttccaagaatgaatgggggtcacaccctgtatgtgagggaggaagatatgaacaagatgctactggatccacatgccctgggctcaacaagtcatgcagacatccatccctgtgatttcctgaggcaccactacttcctgaaggaggtgagaggccttaggaaagtgaccaacttacagtgcagacaagtggccccagaatagaaggtaccttttctaaaagctctacctcaggcacaag

SEQ ID NO: 62 - DNA, 981 bp, Homo sapiens
atggtgaaagtgaaggccagactaaatggatttggccatagtggtgcctggtcaccagagctccttttaactctggcaaagtgaatattgttgccatcactgacccttcagtgaccttcactacacggcctaaatgttccagcacgattccacccatggcaagttctagggcactgtcaaggctgagaactggaaacctgtcatcattggaaatcccatcaccctcttacagttgcaagatttcaccaaaattaaatggggtgatttgggcgctgattatgttgtggaatctaccagcatcttcactaccatgaagaaggctgaggttcacttaaagcagggaaccaaaaggatcctcgtctctgcccattctgctgatacccccatgtgatgggcatgaaccatgagaagtacaaaaatggcattaagatggtcagcaatgcctcctgcactatcaactgcttagccaccctggacaactgtggcatcatggagggactcatgaccacagttcatgccatcactggcactcagaagaccatggatggcccctctgggatactgtggtgtgacagctgtggggctctctagaacatcatccctgcctctgtgttgccgaagctgtgtgcaaggtcatccctgatctataggaagcttactggcataactttccatgttcccactgccaatgtgttggttgtggacctgatgtgccatctggagaaacttgccaaatatgatgacataaagaagatggtaaaacaggcattggagggtcccttcaaaggcattctggactacactgagcaacaggttgtctcctccaactttactagtgatactcattccttcacctttgatgctggggctggcactgccttcaacaaccactttttcaaactcattttctgatacgacaatgaatttggctacagcaacagggtggtggaactcatgttccacccggcttccaaggggtaa

SEQ ID NO: 63 - DNA, 874 bp, Homo sapiens
atggaagatttgatggacatggacataaacccccggaggccctggaactatctatttggttgtgaactacaggctgacaaagattatcactttaaggtggataatgatgaaaatgagcactagttatctttaagaacggtcagtttaggggctgatggaaaagatgaattacacatcgttgaagcagaggcagtgtattacaaaggcagtccaattaaagtaacactggcaactttgaaaatgtctgtacagccaacaattttccttaggggctttgaaataacaccaccagtggtcttacggttgaagtgtggttcagggccagtgcatattagtgaacaacatttagtagcagtggaggaagatgcagtcagtagatgaagaggaggaggatgtgaaactcttaagtatatctggaaagtggtctgtccctggaggtggtagcaaggttccacagaaaaaagtaaaacttgctactgatgaagatgatgatgatgatgataatgatgaagatggtgataatgatgattttgataataaggaaactgaagaaaaatcaccagtgaagaaatctatatgagatactccagccaaaaatgcacaaaagccaaatcagaatggaaaagactcaaaaccatcatcaataccaagatcaaacgggtaagaatccttcaaaaaacaggaaaaatctcctaaaacaccaaaaggacctagttctgtagaagacattaaagcaaaaatgcaagcaagtatagaaaaaggtggttctcttcccaaagtggaagccaagttcatcaattatatgaagaattgcttccggatgactgaccaggaggctattcaagatctctggcagttgaggaagtctctttaa

SEQ ID NO: 64 - DNA, 287 bp, Homo sapiens
aagggaacgccatcgtttgaaaagtgttgcagtaagacgcacacattgtgccaccactgtggctctaaggcctgccaccttcagaagtcatcctgtggcaaatgtggctaccctgctaagtgcaagaggaagtataactgaagtgccaaggcttaaagatgaaataataccaggactggtcgaatgaggcacctgaatattgtataccgcagattcaggcgtggattctgagaaggaacaacatctaaacccaagagggcagctgttgtagcatccagtttatctta

SEQ ID NO: 65 - DNA, 1721 bp, Homo sapiens
gcagacttttagaagaactaacttcaaaaaagattccctatataataagagtcattttaaactgaaatgatcaagacctcctagggattctaggtcatgcctaaaccatcacggtcaagttggacatgtatagagacctggtactctcactcttccaccttcggccccacttatatcccaggctgggcattgaagttccccatcagtcagttggacgggggtacaggacaggcccctttaaacgcagaactccctcaatactgcagaacactggaagagctcttgttcaagtgggtaagtgcagcctgagtgtctggtgagatcaaacctgaagagagcgtgagataaggagagagttgagtcattagtcatctcttttaactaactctctgaagttggctggcttcacactagacctggtgattaatggtaaagagatagctcttgcaattcaacttctgtaagtagaaagaaatttaaagcttcccctgagcattcgcttcctcttcgaatgcttcaaaacaaatctcagcatcagtaggctgatgccagttctcatcatgccccacaggccttgatgagggagacggagagagccaggtgtgccctattgaacaggccccaatggttctctgccttttcatagcaatctcctaaagggagaaccagagtcatcaaatctcaggacaaaatggcagccctaagagggcaatccactgtcagaaagcatgcataagctattattctgaagagaagaagattatttccattcactatagggctagtctgaagtttgcaaagaagtccttttcattcaattatcccttgaaggaaagtatgtatgtaaaagttaagaaaattcaatatcaaaaatagtttttgttttggctttgaaatttttcttaatatgtaagcaaaattcttagttctggagttgcagttactcagttatcaaaaatgatacagataagataacaaaccccattaaccacccagttgctcaaacagaaatctaggattcatgttaattcctttcttctttcacccctcacacccaatccatttgtttcattagttctcccttcaaaataccttaattcatccactttctccattctcatggcaccattctaatataaatcatgtctcacctgaattgttatcataacctcttaaacagaactaactcttgcttccatagtctatttcatggcagccagagagagatttttaaaacacccataagatctgtccaggcatggtggctcatgcctgtaatcccagcactttgggaggctgaggcgggtggattgcctgaggttaggagttcgagaccagcctggccaacatagtaaaaccctgtctctactaaaaatacaaaaaattagctgggcgtggtgacaggtgcctgtaatcccagctactatggaggctgaggcaggagaattgcttgaacctgggaggcggaggttgcagtgagctgagatcgctccattgctctccagcctgggcaacaagagtgaaactctgtctgaaaaacaaaaaacaaaaaaattggccaggcgtggtgatgcatgcctgtaattccagctactagggaggctgaagcaggagaattgcttgaacccaggaggtggaggttgcagtgagccgagatggtgccactgcactccagcctgggtgacagagcaaggctctgtctcaaaaaaaaaaaaaaaaaa

SEQ ID NO: 66 - DNA, 18402 bp, Homo sapiens
gatgggaaatggctgacagcaggataaacaagcagctccctttttggtgagcttcaggggaatcaggtggacagaatcaaggcttcaggtatgctcttcagaggctctgtggagtggtgggaggctgtaaaacagcactggagatggttgtggttctcccccagcaaaagcaccggcaggaagaaaggcagattggcaaacagtgtgggcccacagtgcgagccaggggagaagccatcaggtgacacatcaagccgtgagaggcagctggtcagggacccctcagttccccaccgtcctgcagagacatggggggcagtgtccgtgcctccctccctcaccacctgagctgctccacaagaaattctgagcgccactgggcaagtagagggaaccaaatgcctcaagatggagaagagtgcaaggtctaactagcagtactgtggaagagcaacacagacaagaggtgtagaattagctgggcagggtgtatgggttccttccggtgcctgcatacctgagaagaagtcattcgttgagcttagtttaggttttaaggcagttttggtgtttgaggcttatttagcacacataagtccaaggtagcatcagacagaattataaacttcatgtgacttttcaaaacaacccagtgagcccattgttagcaaatagcagtcagccgagataagcggccattctaggagcaaaggcacttgtgccaggaaaacaagaacaagcacgagcaagaagcagggcaatgcaatccacaaacacaattcatgctttacagctgtgagacaatgcttcttttgcttggacctcaggctctgcaaactgcagcacagaggagggtaagtgtgcagtggcccctagagaagagtggtcagtaatgaaattgcaccccactttacttgcccctttgtgttcctgggtcactgccaggctgtcccaatcctgcaacatgtggaaagccagtgtgttcagatggaatagtaggggatgcaacctaaagagattactagtaagattttccagaaaaagaaaaataactattttttaagcatgagcaggggtggggaggggtggggggaagaaagtttctttgtttctcattggaaagctttgcaagctattgacttattgaggaaaatcaggacaattgggtacacagctttgacttctggtgatttctgacactttcctcgaaagcctatcactccacactgagggccccaggattgactgttttacagaagctcttatgtattgaggtcctgtatgaactggacccatgtaagatggggagtggtgacaaacgttggctcaacctcaattgtgagattatggttcaaggttattttcttagagatagtgagtcttcagaaaacctttgagtaaaggcaaatgaaaggcttgtgtctaaaaacaggcttccaaaagtggaaataggacacaggaagtggagagtcggaaaacaaaacaaaacagatgagctggaatgagaagagtagagagagaagtagaaagacagggagagactctgtaaggaaagctgtgaaggaaaaggattgcagcctcttggctttattttcagttagtgcctcatacaattcacgaggtgaggctcccacacattctggcctgttctccccaattatgggggtggggaggtaaatgaactacacccagacttcttgcagctgtcacctcaatatcaggtatctgcgaggtggggagagaggtgggaggattggtaaggggctgtataattactgggaactccagccaatgtaacacatggttatgtgggcctatgtagttaggtttcactatccctattgactgtgccagaccctgaactaaatactggagtgtcgagatcaagaaggcatgattcccgcccttaggagtgcaccatcaaaggaggtgaggagtgcatctcctcacaggaggagacagatgagtaaactgaacattttgattcagtacgttttgggatacaggtaggaaccagagctgcagggccaggggaagggggcacctcccccaaaggcaaaggtcctatcctcggtcccacagaacagcttacaagactcctcctcaggtgcagctggttcggagggtacggtcgtctccagctgtctcctacatcgtctctattttctcactggctccttctagtctaggtctctccaatcctatacacatcgtttccagctctgttatgccttcaggctactggctgagactttttcttttactgctaaagcatagcatacattttcctgcatttcctccctaccctctcatttttcacccacgccttgatgtcaagttcctctctgtaccactttatcataatctccctcttgaagaagaaccaccagtgatttcctcatcactaaatccaatgatcctcattgatgttattatacagggagctgactggcaactaccacactacaagctaaaactctcccctctttcactttcccaggcctgtctgcccttgttcttcctgcagttctcctgtgcttccttcattagcaccaattccctttcccatctcataagtgggagcgtcccccagtgaacagccgcagggagcgcacctgcatccagagttccagcccttctccatgctgatgacacccaagtctttatctctaggtctgatcctttaccttatttcgagtccagaatttctaatcacgtactggtcaggttcactttcatggtcatctgtgtctctcagggttcctggcatagtgcattgcatagatatggatacaataatattaagctgaatgatgagtgaacaaatgaacggataaaatatcccagtctcctgcagaaaatcccaccttgttacctctgcctttctttcctgaccatggtttccagcctgttatcttccaagagacagacaatttattattatcttcctagaggagtctcatccccaaagcctggaaatggggctttgtattatcggtctaaagatgggtattattgtctctcacccctccattctcttttcagtgtctcattttctttcttggtgaaatagaacaaaagtgatcagcccttgtgacaagtcatattattcatggtaacattgtttcgtcttgtaagtgactgacattaggactgacatatgaactgatttataccccaacttcaacatgccctttcccacgatccttaaccccaaagcaacagtaacagctggactaacagcccttgcgatatgccaggcactgtgctgggctaagtgcttcacatgtgttatctttccgaatcttttcaaaaagcttataaggcagaaaccatttccagagaaggaaaccgaggcttagggaagttaaagtaactgaatcaaggtaagtggtagagccagggttcagggagacatgaaaacatcccactcttaacccttcaccacacagcctcttgtgtctatcggattcagttacagggggcttgagttggttcacgtctacaaataattgaacgtctgttacatagtgagcattgtgggatacaaaggtttaaaaagatcaagtccatgatctcaaggagcttacagtctagaggaagagcaccaacatgagactgacgcctgtgcagtgaaatgagacttttggatgaaagggttacatttacacaaagcacgcacagttcagtattacatgtccctgcccttgaagaagatcccagctgctagagttttgactatgcagtgtttcagatttagtttcccctcctctttgatcaggctcctctgtctttctaaagctcatactatacatataatttccattcaaattcaaaatctttccaattattgtagtgaatgcaatgttattcaaggatttttttttcctgaaagagcacctatctgacatgcatttttaattttatgtgcaatatgcaaatgtcatcactgtagttgttaaccgcagtgcaggattgcaattaactatggagctgtgcattttagttatatgctaatgctaatgagattttcataaagcaagtccaattaccagccctattttttaactgcaagagctagtgcaaagcaaaggtgttgactttctttagaataaattaccctttgtccttggctccttcatcatattcaatcatcctaaaaagtaactcctgctactttgaatattgtatcctgccttgctctccagtacaatattaatggagactgtgggcaagattgtttagaaaccaatttacactgcacaggcagtgggaaaacttcctccaaatgtaaactgctccaacagaggagcagagctttgagtactcaaagtaaacaggacctagaggagactgaagacccagacagtgagttagcaaaaataaatcacaagagagcgcatatgtggtataaccttgcactgaggaaacacaagcggtgaatgggtgtttaaactcagatttatgatcagctgtgtcactggtggaagacaaccaccttagagggatattcattcattcattcactcattcaagaaacagttgtggggacttctgtgttccagacactaaattagacactgaaggttcaaatatgaataatataggggaggagagacagactttcatattttatttctatactaattgattcttttacaaaaagaaagtgtctgtgaattacttgggcagtgaaagaatgaataagcacaatgcctgccttcagtgagcttatggtcaagtaaaaggatacaaatatgtaaaacaattttaaaaggatacaagcatgtaaaacaaaatgtgacacatgaggtatttttagaggaggacaaaatgaaggcaaaggtcagtttggagaaggaaggtgatggggagaaaaacttcttaaaagataaggagattcttgagctgaaccttgaaggtggataagtattagctagaacagggtgggaggtcagtccagaaaagaacaacctgaagaaaccacagaagtatgcaacagcccaggtgactgtaagcgatccaaggtccctggaagcacagggtgtgcagcagagccgaggtgaaaggtaaagttggaaaggagccactgagaagttttcagcaggagaataaacaatcagacgtgcctcttgggcagcaaagtggaacaagggcgaaaggtgagtgggtgggggcaagtaaatcacccacccataggaaccacttctgtgttcaactcagaccctgagacaaatgatcagattatatttcccctcaagatgtttcccgtgcccctatggaaggctatgaaacaacaaagtactctttatttttaacattttccttccagaaagaaaacatgagagacagggaaaaaacgcttgatgacgttgatatacagtttgagtgtcttttctaatctggatcaacttcgaaccaagatgaaagaagcatagaaacaaaagcacaagagaagaaaaggcaagaaaaataaggggagagaggatgacaagaatagtaccaggctgggcacaggggctcatgcctgtaatcccagcactttgggaggctgaggcgggtgggatcgcctgaggtcaggagtttgagaccagcccgcccaacatggtgaaaccccatctctatcaaaaatacaaaaattaaattagctgggcgtggtggtgcacacatgtaatctcagctacttgggaggctgaggcaggagaattgcttgaacctgggaggcggaggttgcagtgagcagagatcatgccattgcacttacagcctgggtgacaagagcgaaactccgtctcaaaaaaaaaaaaaaagtaccggctgggcgtggtggctcacgcctgtaatcccagcactttggaaggccgaggcaggtgaatcacgaggtcaggagatcgagaccatcctggctaacatggtgaaacaccgtctctactaaaaaaatacaaaaaattagccgggtgtggtggtggtcgcctgtagtcccagctacttgggaggctgaggcaggagaatggcgtgaaccgggaggcggagcttgcagtgagccaagatcgcgccactgcaccccagcctgggcgacagagcgagacaacgtctcaaaaaaaaaaaaaaaaaaggtaccaaaaatgaagtagaattaggtctgggtaatgggagtaccttttctccttttcataccaacctgcccccaaactcctgacacctctgcctgggagagaaaagccaggaattgggaaaggaaagtggaacatggaatcttctggagtcgtcagtagaagcagacgtccattaaaggcagaagtacacagagttccacttcattgtaacaaggatgaaaggttaaaagtcccagtacataggcaaatatatttagtggtggaaagttgaggagtttctatcagatgtcttctgctttaattgtgaaatatgaagtaaagttatctgccctgaggggagaggtgggaattcagacaatgaaaaagtttgagcaaatagtggggttcgtccagaattggggttttgctagataacttcagtggaaggatcaagggtcaagggaatttagaatataagtaatatgttctggataggaggaaactgaagacaaaagtggttggtggatgggcagaaaggaaagaggaggagtgatgggagcaacagagtaagctggagggagggggatgtagccggagggcagtcatctgtacttgttatctcaggggggatgtccaggtctagggtgaagctgtgagaatggaaggcggagatggggtatggaagatcactggaagatgaggaggtcagagaactgagtgctcagtggttagatgggtcagatagaaagaatatgaaacaaatgccaggcttcaacgactgaggaggagtgaacagaaaaccaaaagagaagaacatcatggaagggcagtgggggcttggcctgatgacctgggccttcaaggagcaggaatcctgaggcagatgttggtgatttttaacctcatcctttcatcatttttcttgctgatagagccttccttccccatggagatcacatgtatgagctcatgacccaaccctagccaacaggactagggggcaataagatgggggcttcggggaaagattttcctccttgttaggaaattgtaggtgaggagaaattgcactttccagttttgacattatagcaggttgaataattcccctgagagatatcaggtgctaatccctggaacctgtaaatgttaccttgtatgggaaaagggtctttgcagatatgattaagtttaggatcctgagatagggagaatatcctgaattgtccaggtgggccctaaatgcagtcacaaagtgaccttttaagaaaggggtagagggagatttgatatagacagagagaagacacacacacacacacacacacacacacacacacacacacacacacaaaggtaatgtgaaggtggagtcagagattggagtgatgtggccacaagccaaagaatgctggcagctatcagaatctggaagaggcaagaaacagattctccactagagccttcagagggagaagagccctgctaacactttgatgtcagcccagtgacacatcaaacctctggcttctagaccagtgagagaataaatttttgttgttttaagaaccaagtttgtgatatttgttacggaagccataggaaactaattcagatgtagcagtgagggatttgatgactggagtggcagcagctatcttgaaaccatgaggacacaaacctgaggataaaattaaatacaatatcctggagaagacagagtggaaaaatggaaagacctgttgaattagccacatatcactcaaccttttgacttcttatcatgtaagataataaatgtctttattgtttatggctcttctggttggatattctgttacctgcagccacaagcattctaattgatacagccctatccaaaagggtaggagagtcctggctgggaagcagcagtgggtactaaggaagaaatctgacccacttgccaactctgacaagagtgcataaaatgaaaaatgagcagctcccacttgagagaggagcagaacaggtaacttggagagagtcagaagattaagaaaatggttagggaaaagattgtagggataggggcatttgttaattatgcaacaggccttttcaaaggcagtaaaagcttaggaagaggaagataattgggaggtattctgagaaaaggtgtatgtgaatcatgacactgtactgttatgatgaaattatatagagtataggtggagtggggaataaggagagactcgcactttggacaatgaccaaaaaaaaaaaaaaaaaagggaaaatagatacaatgcttgttagatttaaccagccccagggttgccaagaaaacatttctaccaatgccaggaccaaagtagtttttgaactttaatgtttataaggttcatggagtttgttaaaaatcttaaacattcctaggccccaggaccaagatcctgactcagtagatctcagtagggtccagaaatctgcatttctaatgagtatcccaagcgattctattgcaattgatttgggaccacattttgaaacacactgtccaaaacacttgctttcacatgtttttgactaaaatctgcattaagaaatatatgttgtggcataagccacatgcacacacccacacataggcatgcacacacccacaagcacaaacgtgtgcacaaggcaggtaaaacaatctggcttaaccaaatagacatttatttttcatttacacaaaatccaaagctgatgtccctggccaggtgactccatttgggtgacattcctccaaataatggctcaggatccaggctgcttccacatgtgcctctgagatcatgtggcttcaagattgtcccggtgtcatctagtggcatacgggaagaagaaagcatggaggagcctgtgtgggagggttttaagggccatatctgaaagtggcatatatccctccagacatactctatcaacagggtctcagtcacatggccggttgtcgaggctgggagaggtagaggagcccacaggtcctggtaagcaccatcagactctccactgtagacagactgagatgtgtgtatttaaccaagaccaaagtttcacaaaataatactcctatcacatccaaatcctctgatagttttctgttttgttccatcccattcttttctagtttatttttcaaaacgtcagtcttcacaactaaattgatctcatgttcagtgaaactcactcaacacgccacagtttcaaaagcatcatcctggaggatgttgccatttggccaacggggtgggtggccccacatttttgaggggctctgttttctttgaatatacattcagcacccccacagtccagcccactcagtaagtggtcactatcattgctctcatgattgtggtggtgaaaaatacaaaggcttccccagaaatggcaattttttgcaattaacagcacgtaaaatagcctccttttggttaagactttagaactgaaacttgctagtggggcaagacgaaggaggaaaaagagctggaggacgtgtgtctacactgaaggcaggacggaatctacagagtgcctctgctgctgtgcttaccacgtggttccctttctccctgcacttggaccagacaggcaagattcaccagatgtgcaacctttgcccggctggaaaaaccagaaacccaaagccatagtagacatttccatagggatttcttacctcttttggtctggaccgacccaatgattagttactgaatttgaccctcgattgtatttctgaagctccaggttggaaatggggtgagtgggtgagaaggagcggccctggctccggctcctccccacacccaaactcttcctgtcctttccagctgtctcagacacaggcttggggaaggaagagatacacacagggaatgggaaagaggattaggaaaaggtgcggaaatgggaaaaggaagggagaagagtgggagagaggagaagggaaatcaggggacgtactccagagcaaatttttaccagatgaagagaaaaaaagaggaaaggctctttagctttcactccacctcacgcatggacttaggagaactcgactacaggactcagtttttgaaactagcttctggaaggattcagaactcactgagtttcacgaaaaatgaaaattacctgaggaaaatgctaaatgttatttaagaatcacagaataaggactgctcactttagacaggttaatgtgtggctcttggataaaaatttagaaagaggcagctgtttggaaagtccgggaggggcaccaagccagagacctggagcagctcgcagcccagccttatgctggagtaacctgagccctcagagagtccaggaggtgaggctacagtccagcattctatttttaattcacagtgtggagataagagttaaatataaagcagattaagacttcccttaaatctcctctataaaagaaaaactggaattaatctacaggagcactccatggatagctcaataccatcattttttaagaataaaattagaagcagaaaactgtgtccttatccttttgacatccaagaattattgccatgaaagtactacagcccatgaaattactttccaggttacactcattagatttagcattttcattctgtagacctgtggttttaacggaaaagaaaagaaaaaaaaatcccctcccttcatagtacaactgttcccatacactggcccattaatgggatgctaatgaatgcggaagtcattgtaaaatcacaaacgcagaactgagaagcagatttcaaacatcgataggcctagccttgttttggaaatttggatcatgagagcatgggactcaggtagagccctgcagcctgtgttttctgcacactgtagctaaagaggccctcaattacaggctcgatttttaaaaaatttttagtcatattatacaatcaccattatgggttagacattaaacagatgccaacctagctactacaggctttgtcactggaagtgttaaccacataacacggcagcagcagagcaaagagattaagagttcaggctctagagcagttggccagggtatgaacccaagccctaccaattactcactgtgtgaccttgggcaagttgcttaatctctctgtgccggtgtttccacttttgaaaagcggagataataatagtccgtgcctccagttaggattaattgagaaaatgtatgcaaagcactaaatcagttcctggcaccatagtgtgtgctcaacagcagttggtggttgttagtattttgttgttggagacgtgagagaaacgaatctgaaatggctgtgcactccggtggctgagttcaaacctgctgaggtgtctggtcttcacgacatctcaggcctcatgctgcagaggaagaggaaccagtcaccttctctgacggtcttctgtgtatctgaatctattgccatgcactgagccttgcatggtgtgtaatgccttggtttgtgtatttacatcattccagcaagtcaggatgcttttctgagcaactctctgtttgcatggtgcctttaaatacacacaagaattacaaggcaatcctctgtttgtagcctacatgaaggccagttggagagatttcaaacacccaggagattcagcaaactcattatagggtctaatataagaaggaactgtatgtatgaggagctgctaggatgcaaagatgagtaagaactgacctctgctttcaagtcaacaattagctgaggggcacagttaagacgtaggtggattgacttttgtgttatccaaacaacacaaacccattgttacagagtctccaaagatgaaacaccaaacaagacacaccttagagagcagcacagcacagattcatttcacaaatacctactgggcatcatcatttgccaggttactattctaggtgctgggatatagcagtgaacaaaagtccctgcccttgtggagctgacattctagtgggcaaaagaacaataaatagaaaagcccaagagtatgtgtatatacacacatatacacatggatagtacgtcaaggcatgctaagtgttacaaagaaaaacacagaaggggtaacaggttagggagtgacagggaaaggaggggttatatgacaagctgctaatcttgaggtaaaggaagttaaagaaagagagaaacagatgaggactaagagcatcatgagaaaattctggaacctgggtaggcaggaaggccatggtagaaggagcggggagcaggttgttctaggcatgggatttagagagagcagagaatggccagagataggaggagggccagaggagaggcaggcgcccccagggtgggcacagcacctctggggaccaggttaactaggggcctgaagccagagccatacaggccattaggtgtaactctcaagagctactgcaaactgcctggggaaaaaacataagcagtcccagtttttatttcagctggtgaacaggaaccagggccaaaggacggcaccagcctggtaacaccagacactttttctaactctcattgtcacttgtcataaagaacttccaatactgcctgctgtcacaggtgcaatctaaacaagctgaacttatagaggcagagcatagaacagtgtttgtcaggggctgggagaaatggggagttgttagtcaagaggtaaaacatctcatctatgtaggatgaaaacggtctgcagatctaatgtacagcatggtgactgcagttaataattctgcattgtatacttgaaatttgctgagagagtagatcctaagtattctcatccacacacacacaaatatggtaactttgaggtgatggacatgttagttgaccatggtaatcattacacaatgtgtatgtgtatcaaaacatcacatagcacaccttacatgtataccatttttattttaagaaaaaaaagaacctccaaatgtgcctctctccatgtgctagagaagagccttccgcagccacacattcccccttccagcctggtcacatttgggagcccctcccagctcgtgctcccccatttcaaggaaggctgcgcatcacttctccactcactctcatggtggctgggtttgaggacattatgcttggagtgatgacaccagagccacatggagaagaagcagggtggcctccaaaggaaaggaagctgggctagggcaactgtccaccacacgtggggtgtggttctatgtgtgagagttttgctgcctcttccttcagcagcgtccagaagccgtcgtctctgctgcggcctgagtgctcgcctcagcagccttccctacccctctggggtttgctgcctcaagtctttgtgatcaggagaccaaacacataggcctttaaaaaacacccggcatataagcacagaatgagagcttaaagagggccactcacaccttgggcttttgagagaccatttctaagaattgtgtctgtgtttctgtgggtagagttggctgaaattctaatgggcaccgcaacatcctctgtatgaagtaagtgtaattccttaacgcgaaatagaatggctgaacatcacgtgagtttgcccgccttgcaaactcacagaggcagtccaatccacagaatctacaagatatgctatttccatttttttcttttgtaatcaagttagcctacaagtcagtatctctgatactgagactctacaataagcagctcccatggaagcccactagctttgctcaaattgaactatttcatttcagtaaccagtacattctatgtctcattgatagaaattgctgtttggaggtttgttaatttgcttattcatttttttcaacaaatatgttgaacacataatatgtgctaagtacaatgctatgtcctagaggttcaaaggaagataaggtccttgtcaacccacaggtatatgctacatcttcttggtcttcttaagtggggtttttaaaactcccgcagaaaaactctgattctggctatgctgtaagaattttgtttttattagttctcttttaggcactgtaccttatttgaacaatcacatcattgagcacagagcaggaaaaaaaaaagagcagagaaaagttatatggagtcattctttgaaaggcctagattataaaatcagaatataaggtgaaaatcatgaataagcacaagtagctttgaaattcagttatgcaggtaccctgctggaaaccaacacacaccatgtctaggtaaatcaaactcagccatcatttcttctagctttggttaggcactagattaaacggttgacttgcatttagaggcaatattgttgataaaaacatgcctttaaaatgctaggattgcattctgtatctaataaactgggtcagaatgacagtacaacagactgatgtgtagaatattctgaaatagtaactgatgaattacgtttgcatctggtaattctaatggccctgcagctctgaaccactgagtcaaaggcatcccttccatcatatgaggatgggcctttaagccaccacctgcccttctactccctccttgtagtgaagaaaggtagctgagggttcctgagctttccaaggaggattcagacatcctgaagggaccactagaccagaagaggcctgggttgggtcaagggcagtgtgtagagtgtggacttggagcctgaatggccaaccatcagcagtgggatggtgtcacagtgcccacaaactagagaggagaagtcctacctcaactgaggtcagcacagaccagaggagagcaagcagagcgcaacagatatgttgagtctcccctgtgaagaaactcaggagggtgggaagaaacccgtagtgcccaaatgtgtacccaaagagactaaatattaaactagaagtgcctgagttattttgaaataatatttttacattgcctaccagaaatggaggcttgagagctaagttgtgttcagttatagaaaaacaaagccacatttctactcatgaatagtgctgtatgtggtaaactgctacatatcccaaacataacctcagtgactgaaatggcagaatcaccagcacaattaaatgagttctccttatgtactgagagaaatatatattgaattttcatatcttaaatgcatataggacatcatctcctcatcctcttggatcctacattcctatgccacatataacactaagctcagagaacacaatagtttgcttggataccaaaacacatagcatgtatccactaatactcacacccatccaaactcaccaaaagcacaagagaaatgagaatttttgtctcttaactttgtgcttaacaccctttgtggtttttttgtgtttgtttgtttgtttgtttgttttgttttgtttgttttgagacaaggtctcactcgtcgcccaggctggagtgcagtggcataatctcagctcactgcaacctctgcctcctgggctcatgtaatctttctaccgtagcacctaccccacccggtagctgggactacaggcgtgggccaccatgcctggtggctaattttagttttttaatagagaaagggtttcgctgtgttgccaggctaatgtcaaactcctaggctcaagcaagcgatcttcccacctcggcctctcaaagtcctgggattacaggcttgactgggttttaatgagactgaatattattctgtcatttgggtttctttctttctttcctttttttttttttgagatggagttttgctcttgttgcccaggctggagtgcaatggtgcgttctcggctcaccacaacctccacttcctgggttcaagcgattctcctgcctcagcctcccgagtagctgggattacaggcattacacaggggtaattacagggattacaccaccactcccggctaattttttgtatttttagtagagacgcggtttttccatgttggtcaggctggtctcgaactcctgacctcaggtgatctgcccgcctcggcctcccaaagtgctggcattacaggcatgagccaccacacccggccggcatttctaactctaaaaactactttagaatcatattacattctatcttgttatccaatattaaatggggcacagatgttcagtacatttttattgattaatagattaaaggactatgtttataaactggattggtcggcaggaactggggcaggttatatattaatatgttaatgtgaactaagatatggaaatttatttggataatgtgatattgacatcctacccaaccctgaaatcccatgatttctagttcaaactacctagcataacagtagtttcatctttagggataaaagactattgattctctagtggagaagcagcattctctttcaccatcctcagtctaattctccaaaatgctatttttaagaagccccagctaaaaggcaaacagcacagtgggttagatttggtgttggaaaggtagaaatagatctttccttgttgagaactactcaattcggtagaataggagacaaaaaccatttgtgctgtccagggctgagctcagtgaggctgttaaaggtagaaacagaaaacaaatctatcacggaacctcaattagctttagggggcaatatctcagagccatctccatggagaggaggccacttctctcggtgaccaggacacagtctcacagctgctcgggcctcgagggcctaaggagacaaagtgagcagaggtgagatcatgttctgtagagatcgtagtgccagccaatgtgcccctgtcctcacatgctggcaggctgcctggaagtagccagcccagctgttagatctggtggcagtctatttaacctgaccatactgggaacaacatcccagctctcctgttagtgaggcattttccaggcaaaaggtcttgtatgcatttggttcagtggttatttgcatattaggaagggctgagaaaatggcaggtagatacatccagccttccaaggaagatacacccaccctttcaaggaagaaagttggatgttttatggctagagacactatgatacttgcaaccagagtcatagctaacaactagcagtctctaaatcatatttgtcataaaattctagagtcgaaagagactttggagattgtctagttttaggaaagaatcaggagcccagagattaagaaacttgttgaaaattacacaactatttcatggcaaaaccaggacaaaaacccaaatgacctaattgctaatccagagatcttttcgtcacacccaacagctgtttgagaacatacaggacagctctcccttgctcactgctcagcctttatatccctcttcccctagtgtctgaaaagggtgtttggtggataaatatctggagggcctctgcaaattttgtttagaaggtctttgtttgctgccaatatccttccatcattttgtgacattttcctgaatatattcatttttctaatttttaagatttaaaaaataactcacgatatagaaataaaaaatagaagttctcataattttcaaactttggagatagccacattaaagattaggtgtacattcttccagatgtttatgtatataaagattttacacacacatgcaccccatatgatatgatatatgagttgttaacaatttattaagctttcactattttaaaagaagcatgctgttcattcttggtagatgggagatgagctactgaatatctattaggcatgagatttcttacccaggaagtctttgctaatgaagtctacccttcattaaccaccctgttgcaccctcattcctcactaccccactgttaacatactcttttgtttttcagccctaaagatgagaatttaagctggatctcctagaggagttgggatcaagtctatgtacttggagaatacaagagaaggacccagctgggtgtggtggctcacacctgtaatcccagcactttgggaggccgaggcgggcggattacctgaggtcatgagccccagaccagactggccaacatggcgaaacgctgtctctactaaaaatacaaaaattagcctggcatggtggtgcacacctgtaatcccacctactcaggagtctgaggcaggagaatcacttgaacccaggaggcagaggttgcagtgagccaagattgcaccactacactccagcctcggtgacagggtgagactctgtctcaaaaaaaaaaaaagagagagagagaagga

SEQ ID NO: 67 - DNA, 54874 bp, Homo sapiens
tcagcccacttgcatccgagtgaataaacagccttgctgcttacacaaagcctgtttaggtggtcttctatatggacacgcatgacaatatttacaacaaataccaaggaagagctaagagcacatagcatttcccaggcttattagactgtgggatcaacctctttaagaaagcattttgcagaattgttgttcacaggtcattctgcagtgtgaagttttttttgcaataagatccttactctagagttaacttcactaggaagtacactctgggtgtttacctttagagcttcagtttctacaagaatttggcaccggttgggtcttgtagaaatatttactgcatggagttgaaagaagagtctggactgggagaaggatgtatggataaagaacaaggtaggaaacttgtacttgcctgcttcttcttactgctttattcttggataatttcttttcagctttggttattcagcaattcatatttggaagataggatcataggaatgaatctagacatgctaaattataggctgcaataatcttctcaatcactgtcttgtttaatctggaacttcaactgacttgtcttaagtcatgaaacaaaatctttcttagttaagatttccttctccaacatgagtgaactgaaattaatcaatggcatagataatgagaggcaagtagtgtggcaaggaaagacaacttaatttacagaaaaagtgtggttttatagttagaaaagtttcatttgaatgctagatttcctgcttactagttgtgtgacaaaatgaattagatgtttgtgcccatcatggttccaaaacagtttatgatgttttaggaaaataaaaactcatatatattgcttgtgagaagaatatgcccaatttgtggcagtgaataagaagcagagacacaaagtgcttttgggggaacagtgattctctgtggctggagcacagattttgaagggagagtgtagaaagaggtaagaatgtaaaaatgcacagatgattgagtctggagatattttaacaagattgtggagggaatccaagccaggttcaggcatgtgtacctactgctgtagacaaggcatagctattaagggagtctgaacaggagaacaatatgcgaatgattttctttagaaaacacaatctgataatgcttgtatgtttgtgtcaatttgattggattatcaggatatgcttcccagcttcaaataggaattgtagcctcaagttcaggagcttttcttccttttgaatttgtcatgttttgcaatacataatagaagctaactataatccacatttgtttagagcaggcactttggcaccaggacaccagctctgtccctgacaagttctgtggtctaagttacttcagctcagcagttttctcatctgtgaaatgggaatgttaatggaactctccttataagggaagactaaattaactaacagatgctaccgtagtgcctagcacatagtaaatgtgcaaaagttgttggctcctatttgtactactatttttgcaatcctggaatttttccagtcaatcactcacatttttacaagctttcctctcatggagatttatcttccagataatcctttggatttgaaattcatctctaccacctcgctctcacagtcagtgttttgaaaaaaaaaaaaacattcccagaaatttcataattcctaagctttaaaaaatgtttacatgtaacttaaatatttttgtagtttttaaatctcctttttctcaatacacctttctttgcctaggcgcatgcattttacaaaattccctccacttctctctcaggacttcaggaatcttctgatttaggaaattaactcatcagtaattctcctgaccatggtgaggaaacacaaatattacgcagccagtctttattttctgaccctaaaccaaagagctgtgatttgacaattttccttggtctgaggcacagtatttgccacagtcctcttcttattgttcacgttgccgtttatgatgactatcatcagaaaaccacgtcaggtcactttgtggagacattgcttctgctgttcccctcctgttccacctccacctttctcaccaaattccctgggttgtaaagccccagattgggtggtccagaattacagtcaaaggtaagagaaggaggctgtgggtcactggtctgcagagctgtaagactttctgtacacctggaagtgcccagacaagctgtagtgggaattcttttgaaaagaaatgcactcaaagttaatgagataaggtattttcctgccttcatgaacacacttcccacttttcctgaaaagtccttaggaatatgttattcttgtgtttgagagttgtactttgtataacaaacctttccttcttatactcatctacaagggccaattctcatcatttcctgtttggactgttgagacccatcctcactcacaatctggcctccacatctcttctcttcctctccaattctttatttgtcattctgaaatttcaaatacagtgtgatcatattgctttcctattcaaaatcatttacagtttttccactaaaaaatggtaaaatccaagctgcctgtgtgacactggagattctgcatgctttggctttttcctaccttgcagattcatagctgcctcacctcccttacacttggtctggaaacactggggagcttttatttttccttaaaccccgcccccatctgaagcctcgcctaattgttaagccttcaaatgtgttgcaatctctgcttttcccttcgctttcatattgtctgggtacgcttgggatatagctgtggttcctaggctagctactggccctccctatggctccagagctcctgtgctcacacctgtgcgagcactggttattgtacgatttaattgcctgttcatgcaccagtctcctctcttgggctccaacggcagaggttgcacaagtagagtggatgttcaccctgcatcacatggcattgaggacctcccagtcttctcttgcttcctgccaggcctacaaatgtgtcacagattctcagtcacagcagcctgctctgtgtcgctgtacctctgtacctctccctgacatgtgaacatcaatgcacaggtcaagatgtgtcaccagggtaggtttcctaagggttttcatatagattccagtaaaaagggcttccttttctattcagcacatctttcttgcctatgtgatgtctacaattgtatctctagcatattattgctatcaattgtttgtgagtatatgtcctacttctagacttaaattgtcttaaaagacagaaatattcttgattttgctttgtatcttctgagcctggcaaagtgctaattaaagtagatgctcattatgaatgctgtgttaaatgaagaaatgcacaatgtaatattatctgttctgcctggggagtaattttgttttttattccattgatttggccatattcttgatcaatggttctcaaactaactgaacattagaaacagttggagactattttgtaaacatcctcaaccggtgttattcaaatgttaatgtgtgtaggaatcaccaaagattcttggactctgattcaataggtttagaatagggcctgagatcttatgtttctaacaagctcccaggagatttggatgctgctgagccagaatcacagtaagtagagggtcctggttctttgcatcagaatctctggggatctgatctgggaatactcctaagtattcctgagaatttcccaagtgtctgtgataaagcaagattgtcatctacattaggagttgctgtgagtgtcctatcacctatctcttacatactttacaatattattgagcaacttgccagaaatcatgctagaggctttggctatatggatgaagataagactgttcttaaccttatagaactcacagtctaatgagagaaacagaatatataaaatgaatccctatacattgaggtaaatgtaagaaaaaataatcaaggcactgatattggcaataaagatgaaagaaaacatctatatttaaactaagatttgaatgctacatttccactcctcatgggattagaggggcagtgatgttttaaacaaagttagagacatataaaatccctgagttgggaaaaaatgtggtgaattttaggatctctccaaagactcttgtgtctggtacagaaagtaaaagtgggagagtgtcatgtagtaaggagggcagggtccaagcacacacatgctggtggcctaacctagcagagcatgtgggcacaacaagagaaactttctctaatcaacatctagcatgctgtggagcttgacccggtctgtcttggttcctttgagacaagacccatctcaagctagatgcccatcaatggcagttgggataaagagaatgtggtacatatacaccatggaatattatgcagccgtaaaaagaatgaaatcatgtcccttgcaatgatacggaaggattggaggccataaccctaagcaaattaacatgagaacagaaaagcaaagaccaaatgttctcacttataagtggaaactaaactttgagcacatatggacatcaacattggaacaatggacactgtgaactactagaggggagagggaagaagagggtcatgacttgaaaaactacctattgggtactgtacttactacttgggtgcaacatatccatgtaacaaacctgcacatatacccccatgtctaaaacaaaagtggaaattttaaaaatttaccccacatctaaaataaaagtagaaatttaaaagaatagcagtgataatccttcaacttatctacaagcatttatatttctgaatttctggaaatattatttatgcataacaaggacaagatggacaataaaagctttcactttcacttttcaatgacttaatttttgtttttcatttctctaaaccagcaatcaaaaaatattcccatcaatttatatctggggctagtgtgttgaagaataaataccatctaactattcctacccttcctttctactacaaaagggaagcatggaatgtcctatctttgatcaggcaaatagaggtcatttcaaacgtacctgagcctccatcatatggcaagatctaggtctcttgagataacattaaaacaatgaagtgaaccaggatacatgcatcttcttttttttttttgtgatggagtttcgctgttgtcgcccaggctggagtgcaatggcacgatctcggctcaccacaacctctgcctcccaggttcaagtgattctcttgcctcaacctcccaagtagctgggactaaaggcatgcgccaccacacccagctaattttttgtatttttagtagagatggggtttcatcatcttggccaggctgatcttgaactcctgacctcatgatccacccacctcggcctcccaaagtgctgggattacatgagtgagccactgcacccggccttttgatacatgcatcttctaccagcgtatctcttgccctattttataagttgtggggagggcaatgcctagcccaaagaagtttttaatttggttttaaaaatgaaagaattcatgaaaacttatatatatataaatatatatgtatatatatgtgtgtatatatacatatatgtgtatatatataatttacatgtatatgtgcatataggtgcatgtgtatatatcatacacacatgtataaattatgtaaaaaatgacaaataatttttttatgaaaatagactttttagtgaaaagcttagaaattcagtattctaagaatgcattggttctatgtttatccctagtattctttttctctttgtttctttcctctagacccagaatccgtagccagcatgatgagttcagagacctggcccctaccctgggagtagcacattcagtcagagaggtttaggtggattcatccaaatactttaatcccagagctctgtcctacaaaaaccaacaggcttgctcaactgtagcagtcaacaagaattcatggtgcttggttggactgcatacatattatctttttcctttagaaagctgtgaattccttggctgttttatttttgaaataaatgtgtcaattccatttttctgccatttctgctacttcttttctctatagaaacctggatttgttactgagctttaggtataaaacaggtttattaagcttaattgttttactattaccatagtaaccattgtatttccgtcacagtaactctgaactgtaagccagtaagccattggtcctgatggtaaagatagaaacccacctccctgcacctcagattctacacctcagagaatttccaggctctaattccttcaattatgccccttctttctagcattttaagtgcccctctctgattttttttcaaactcacaccatggtggtcttgattcaacaatgaagtcacagtaggcattgcagtggttattttatgaatccacacaatttacagattgctcctgataaagctctaaagagttttcacaatgtgtttattctgaaaactactctctacatagcccagtatttttccaatacaaataaattttaaccaacattacaacaacaaaaaattttgatgtgcattgaaatagctagtcaaattggcctcacagtagcaataaaataatctgagataatagttttgtttgattttttatttcatgcataatttatttacgagtaagcaacatatattttacattgttcctcatgtcattgtatgttttaatactgtgaagtttactctgaactctttggatcccaatcttaaatctaatcaaatcaaaataaatatatagaacagctcaatatatgacacatagtaggcacttaataaatagtacctattttattaacatgattatttcctttttaatattattatgtgaatatattctagatagaaacttttagaatcttattaccaattatatgtgttaagtcaagtttagcctaaagatgcctccttccatattttaagttcaacctaaaagtttctctgtacattgtgaactataacctacacagaggtgtaaacagactgtagtctactcttgtgccaatcaatcactgagctttggttcatcaaaggtggtcaatgttcaaatcatgttcaaataaggcaaatgccgagctgtaaacaatatggctgtttctgtacctcacatccactttctgtatcactttcctttttctgtccataaatcttcttcccccatgtagctacactggagtctcagtgagcctgctctggcttgggagattgcccaattcatgaattgttctttgctaaattaaactttgttaaatttaatttgactaagcgttttttgttttgttttgttttttcctcatggtaagggcatagaaatgcagagggcaaacccaataaagagaggaatcagatatgggagaaaatagttttagatacaatgaaaaattgaaataatagttaactcttaacacttgaagttctcatagtatgacggtaggtaagaaaccatggagaggaattgttctgagggatttctcatcgtcattcatgtagccgttgaatttgtaaaaatgtattctattttcagatgctaaaactaaggatcagagctatcagggaaataaggcagccagtgaaaaactgaactaagtctgaaacagatttgtcttatgcccaagtccaaagcataacttagccctggagcaacagagtgagttatctgtgcaagcacctcaccatgtcaactctgggggcaactctgtcagtctctcctgcaaattggggcatgaggaagagtctgtttaatctgcaatagtatccaagaggcaatgattgggtacaaatcatcaatagtgacaattcctctctaaggtaggtttctagttggatacaacagcaatcagtatcagctgaacaatgatcatttacactgaatagtgaaacagtaccactggaaaaatcatcaggtttatagaccagcaagctgagtgcgtaaaatgttactgtaatgatccatgccaaagtctctctataatccatgccaaagtctctcttctgtcagttatctgtttgtctatatcactctacaacatattatgccctgtgggacaatggctttgtgttcagatgacacatgctcagccaaacagtgttaaatacgtttctcaacactgaaattctctggcatccttaatagctatatatccacaatgtgaagcaattttctaaattttgtgagaagaacacctgtgaaatattgttagaggatgtgtattcattgctcagaaacagaaatcctccttcaatatttgacctaagtgatttaatatttaaatctttcatttatgttacaattgtattttgtttagattctttctttgagtatattctagtaacaagttttgaacttatcctggaggagttaccctggatcacttcatattatttcaagtcaaaagggaaagacaaatgtagccaagataactgagacgatcaaaactgcaaattcaagaggcatttacttgaagttaagagttgagaacatagggccaggcgcggtggctcacacctgtaatcccagcactttgggaggccaaggtgggcagatcatgaggtcaggagattgagaccatcctggctaacacggtgaaacatgctttctactaaaaataaaaaaaattagccgggtgcagtggcgggcgcctgtagtcccagctacttgggaggctgaggcaggagaatggcgtgaacctgggaggcggagcttgcagtgagccgagatcgcgccactgcactccagtctgagggacacagcgagactgtctcaaaaaaaaaaaaaaaaaaaaagagttgagaacatagaggtcaaataagcacccaagctatagtcacaggaggtagaaaaacgatcaccaaacctttttgattgcatgttctataagaaaaacaagtacattcacctccaacatacaggtacttctgttcagatatattatgtatgcaattaaataaattaacaaggtttaaagttgagctaaagataaaataaacaatgtatattttaataacttgccattcatttttgctttctgttatcattagctagtaacttaagggcacaatatactcaaggcgatgtttattcttcataataatgatagaaaaaatatattttagtcttccaggtaattttaatacttagtggacaagtgacaatgatgagagtatatcagaaaagggagagatatcatcattgctattgtcttataatttacttgtgtttacatttagcacaagtaaatgttaagtacacttacattattgtttttaatcgacagtctcatagcagcaatctggtttgtgaagatttgtgtacatcagatacagtaatatgttctgcaaatccaaatgacaggacacaagcctctgatcatgatggaggcaggaggcagagatagaggctctaggcagagagagacaggttcctggtgaaaccccacctttaagccaaaaagcctaaaacctggggcccaaagtgagaacttctattcccgtttgcccactctctccagattggttctttgtgaataataccttttcaccaatcaaatgttgccttttccagaactacctatgggctgccccatccccaccatcctgtgcctataaagaccccatactcagttggtagaggggagagatggcttatgttcagagagaagatggccaggctttggggaagaagagacagcttgacttcggggaagagacagccagactttagggagaattatctgcccttcctgtcccctctccagctccccttacacggacagccattcccaccactcgataaaattatttgccttcaccatccttcaagtgcccccacaaaagcatttttcttgtacactggacaagtgctcaggatccaccaagtgtgggtacccaaaacaaggccgtcacaccagccctttgcccttgctggtggagggcagctgccccatgcaatgaggcaaggggctaactgagctgttaacacacagctgtccacaggcagtggaactaaaggagcattgtaacactcgctctgggtccttggggcaggttgcaggcattcgctgccctgacctgggcgctgccgccagagcttgctcctgctggcacctggagtggctggccaagtctcacactcgctcatttgtcactggtctggtcacgggccccgcagagaacttgctcctgtgtgagttccccgagtggccagccgggttctgcactcactcgctcaagtgctccctcccgcaaggggttgagcatggcaggcaaagtaaaagtttgcccccatctcaagtcccatgaacagcctgagaaaaatcctgcatcagtcaggaagggcgaggagggaactctggtgaagctgtctgtgccctggactgacttcctgctgggcacgcctcacccatcctgtgtcacctggcactgataggcaggagaacctgccagagtgccgttgtcagcccatgctaacccacttaagattattttctgctctataagttgacttaaactataaagtgctgttcaagtattttgttccaggacatcaataaataatcttaaattcttcctgggactctgtggcaggctgataatggctctcaaagatgggtctatatcgttatctcagcaatgtgtattaccttatttggaaaaaggacgtttgaggtataattaagttaaggatcttgagatgagactatccttaattctctgggtgagccctaaattccatcccttgtgtccttctaagagagaagctgagagagattaggcacatacacagaggaggaggcaacttggcctgaaaggcagagactgcagtgacatggccaaaagccaggtgatgctggcagacacctgaaacagagaggcaagggccatattcttccccggggccccagagggagcacagggagtcctgctgacagctcgatttcaggactccagcctccagcactgtaagataataagtatctgttgttttaaacctcaaaactaagtttgaggtaatttgttatggccgccacaattaaactcacactggcatcaagtgtaaatttagagtccctgatatagaaatcagtaaacatatatgtaaataaataagttaatatgggaagggaggggtctaatttagcaacttttaagtgggcaatcagcggggatgactttatggaggacctggcaagatgggacctgaaaggcccaagtaataataagcatctgtgcccttgggtgaagacgcaaatgcaacgaatatgtgtctaagatcatatcaaaaatgttcacgttttcatcatcttattttcttctgacaacaaacatcctaagattgatatacattcccctccttatggggaagaagtgcaggctcaaagatactaaataacatgttcaagatcaaacaccttgtaggtgcaggcttggagttgtggcctgggtctcctgattccaggtccagtgttcaaatgacataacatcaacagcccttggcctcctcttctgaaagagaagcagtatgaatttcaggtctccccaggcccattgcaaattcattttatggttctaaaatgagtgcataaatttgtggtaaatgcaagtaggaaaatgtgcttctatcctgcatggcagagtccctggcacatgcagaaactgagtgcaattggcattaattcttataagtccctatactgaaatgaattaaacatgtgacactgctctctcctccatgcaggaaaatgttagcacaatcccttagagtacataaacaaggatccctcaggtttttagtgtaatatataaaaccagaaatggccttgaacattctcagaagccaaaatcctttctccaaatcctaaatattcttcacaatgttttcatcttcgatgctcttttccagggacaaattcctgttatcctattagctaattagcattcagtgtgtttcttaaagcgctcaaagaaacattcaactttcattcatttatgacatcagataaagtcatcagaaaatgcaatccattctttcattgttctaaaagacatgctaggctgcatttcactgagagaaataggtgtagcaaagccataacctgctagtaatatcaatgacaccagagggtaagctcttaaattttttccagaactcatcatgcattggtgaccaaagattttgaaaatgcgtttcaaaggtaaaaataggtcttcttccctcaaaaccaggattttagaattgaaattccatctgtaaattggtccatcctatcctaaccctgcaccttccacaggcgataggaatgtggccccaacacacaaaggcatgtgccctgataattcctgtcctaagtcctttctgcttggcctgctctcttcctacatttgctcccatctggccttgagtctggttgtctctcctagctaaaggctgaggggcatgtcttcatagttggtgccggtgcccagtttctgtctctagtgttacttgcttctctccagggaccttggcacaaaatcacatcaccactgggtcttgcctcagaccagcctactgtcccaaggaatctgatttcttgctccaagtcactggtggggactcttgtctggtgacctgaccactctgtttgcagacgtttgtagtcctagccaaattgaagttcttaagggactcccaagctcaaagcttcttaaaacacagtctgccgtttctagtctatataatatactaaactatagcacctctcatgccccagagaatatacaatctagaaggagagacagatatgtaaacatataaatttggtgccagttataaatacagtaataagaaacacaggcatagaagttgtaggaagaagggaatgatcaactacagttaaagagcagaaccatctttgctgaagaaattaaaatcgacttagtctttaagcaatgattaggatgttcccagagagacgaagaagagaaacttatttacctaatttcaagaaaaaacagagttacagggccagaatgtgaaactggctgattgggcaattataaagcttcaggaattgctagaccagcaaacaaggtcatcaaagactgacagcatcagcctggagggcctcctgagctaggatcagaggtttcttatgaaggctctcagtagaactcatatcaagtataaagccattacaatgactttgtgaaaatgtttccaagctgcagttttcaatcaaaaatttttttaaagcttccctgtttctgagaacttgcataaatgggcagacaaaaagtgtagccctgtttcacaggctaggtagggatggcaggcagagctgtgttagcttttggcctcctctttgctccctggtaactcctggctgcagaatcctacaaaactgtaattaacaaatggaattcccattgactgtgcaggttctttgttgaaagtgtgataactcgatgtctgatatttagaggttagagactggccactgtctgtctttttgactgtcctcatatgtgttgacagcattgtccaaatctagtgtctggctcatggtaagccctaactatgtgctttttaacattcacgtgaaagataaatatcatcacaggtgcaatgcaatcaatgcaacatatgaatttcaaaattatgagaccacaacagagggaaactattttactggaaaatgcatgttctttggtgtcagctacacctagatgcaaactccaattctgcctctaactgggtgtgggactgtgagaagtgtgttcaacctttttaagttatcatgtcttcaaatgtaaaattggaatagacaccaacatacagatttttaccaattgagataaaatttagtaacaaatataaaggtcaacatagtccagtgatgcagagcacagagacttgagatatattaccaaggttcaaatgccagcactgccacttcctacctgcacctcatgtccttcatcttaaaattgggatgatgatggcatctaccttgcagagattgtgtgtgagggtacagtgagtcaatatgtgtgcatctctgttatagctgggtcatagtaattgctctgtcaattgtagccattaatattggaaggtacctggaatgtaagaaatgtcaataaaatatagttggatgatgatagagcttgaagagcttgagcaggtacttatggggcctgaagtgtcctagaagtgtcctcaaatcttagaattcataggtttgcacaagactgaatgggatagccatagaagagtgaagctgaactgaattcctggtcgactgacaagcaagagcaactgaaacaccaagtgtgcactatgggcagaaactgcagtgaaaaagcctgctatggaggccacataaaatgatgagaagagctttaggatgagtttcctaaagagactctctgaggcaacagagacgaagagccccagactgggggtaaatctgttttaaaatagagtatcatctcagtagaaagatgatttgaatcaactaccaaatttctcactatggacattagttactttttaaaaaatatattatcttttacaaatatggcactagtagtaatttcatcaatactaaactagataatgtagatatcaagtcctgtaggcaataagaatatttatttttccttaccatgtattcaactttaccgggctttgccatcagaaagtgatgttgacaagacttcgctggtgttctttgttataacaatttacttctttccttcagaggagagttggaggtgtaccacatgaagcatgaactcctcttcccttcctagattgtcaacctatgcaatacggatatataaataaaaagctgcagtgagtcattttccccaaggcttgaaaaataagattgcttttatcagaaatatatattctgtttgggaaatttttactctatattctgtgcagaagcatgagagaacgatcatacaaccaagcagccctcaacaggtactctacacatacatttttattacttactagatccacctctggatggtccaatgtcaaatgataggctttattccattctaatcagagagtagagcacattttcatagatcaatgtacactggcatctttattcaagtaaatctctgcctgctgttggctgcatctcttgcagaggattctacctaatatgacaggtttcttagactaagaatgagatactgtcccaacaccttgttgcattccatcactctatggtcctagaaaatagaggttaatgaagcaaattcttttttttttttttttgagacagagggaaccacgctcttctcttttcagcacttctgtataacttccacattgtagtcagatctgtgtgattttattttttctccactctatgaaagcttgctgaaagactgatagtctaaccaatatttatcttttaaaattgttattcatatagatgattatgcataatcatgacaagattgttaatttggtgataatgaaaattattattatcctcttaaaaaggagaaaactgacacccaagagaaagaattttagtagacaaaaggggaccggatgcagtggctcacgcctgtaatcccagctctttgggaggccaaggagggtggatcatgaggtcaagagcctgagaccagcctggccaaggtggtgaaaacccgtctctactaaaaatacaaaaattagccgggtgcggtggcaggcgcctgtaatcccagctactcaggaggctgaggcaggagaatcgcttaaacccgggaggcggaggttgcagtgagccgagatcgcgctactgcactccagcatgaacgacagagtgagaccctgtctcagaaaaaaaaaaaaagatacagaagggaggaagggaagtgctggatacaggagggcatggtccctggttagggctccaccaccatggatctgggtgaggacaggcatttcctgactaaatgttgcatttcccaagaccaccctggcctgccactcccccatactgtacctataaaagccccccaagactctagcaggcagacacacaggtggctggagcacatcagcagaggagcacacaggcagctggacgtcaagaagagcacatcagcggaggaatacctgggtgactggacatggagaggaacacactgacaggcactgacacactgccaggccacccacaggcaaagtagaacaatgcagaatttggctggggagttggaggacagccctggccggtgagtggcctgactccaggggaacatctccccattccatcccttctgacttcccctgagctaccgccactcaataaaatcttgcattcattctccaagcccacgtgtgattcaattcttccagtacaccaaggcaagaacccaggatacagaaagccctctgtcctgcgacaagggagagggtctaaatcgagctggttaacacaagcctatagacagcaaaactaaaagagcaccctgtaacacacacccactggggctttaggagctgtaaacattcacccctagacactgccgtggggttagagccccacaacctgcctgtctgtatgctcccctagaggtttgaatagcgcggcactgaagaagcaagccacattcccatcgcacaaccctgcgagggggacaagggaacttttcccgtttcaaaagtgccatgtaatgtaactagtagacagattttcagaaaaccccatggaatatcactggaactaagtagagtctctggattgatgtcaggggaaagattggagtcaagtggcccaggacccacccctggctcacccaggttctaactgaatccatggacattagagtcactgattaaaggagcattaaaatatggtagtgtttaagtgtgctagctcaggtgttagattgcctgtgttctcaccttgtaccactacctcaccaggtggacatagattcattttcataacctctttgccctctgttattcatgtgttaaatagggatggcacttttgctaacgctggggttcttggaaaaatggaataagataatacatgtaaaatatttacagtaattactgcacaatcataaggtctcagtgattatcaacagtgttattatctctatcatcctcatcattgttgattccactggcacccagatttccacctcctacatttaggaaaaacttaaactgacaagagcagagactgtgccaaggccatctatcacctttcttgaatggggaccttgatttagggtgactaactgtcccagttttgagattgtactggttttagtactgaaagtactcatcccataaaatccttgattcctgagaaactgggacagctgcttacccctgaggaacagctgaatctaacagattccaatgccccattcagtcaaaaaagagagactgaagaaaggcaagctgccctcagggaacaaactgagaggtgaagccagctgggcttctgggttgactggggacttggagagcttttctgtctagctagattattgtaaacgcaccaatcagtgttctgtgtctagttaaaggattgtaagtgcaccaatcagcactctgtgtctagctaaaggattgcaaatgcaccaatcagcactctgtaaaaacgaaccaatcagtgctctgtgtctagctaaaggattgtaaacacatcaattagcacactgtaaaaccacaccaatcagcactctgtgtctagctaaaggattgtaaatgcaccaatcagcactctgtatgtaactaaaggattgtaaacgcaccaatcagcactctgtaaagtggaccaatcagcactctgtaaaatggaccaatcagcgctctgtaaaactgaccaaacagcaggatgtgggtggagccaaataagggaataaaagctggccaccctagccagcaggggcaacccactcaggtccccttccacgctgtggaagatttgttcttttgctcttcacaacaaatcttgctgctgctcacttttcaggtctgcactacctttatgagctgtaacactcacagtgagggtctgcggcttcattcctgaagtcagcgagaccacgaacccaccagaaggaagaaactccggacacatctgaacatgggaaagaacaaactccggacacaccatctttaagagctgtaacactcaccatgaaggtctgcggcttcattcttgaagtcagcaagaccaagaacccactttgttgaagtcagcaagagcaggaacccactggaaggaaccaattccagacacaaaagctttgttttttccaacagggagaaaaagcaaagtttgctgcctcaagggctgtccaaccagtgctgagcaataagcttcctaataccaccaactagggaaatccaggccagggataccatcagaccctcagcactcaggctgctgctccttgggagacaggagcggttggagaagagtcagatcacttatttttaagggaggcccagtcttgactacagtcatcaaatggggacccacaattcatacatgcgtcaagatttcttcaactcatggctttatgtggtctatagatgccagtattaattgtggaattgaaagcatgagcatataactccaaagttacttcaaggcaattttataaaacaattatgaatgttgtgaccaaaaagtcatgccataaataaatcaatcctatattctacatgtttctttgcaaataccctatgatctccttgtctcttatctctttttataagataatagtcatgttctgtcctttcttgatacaggatataaaattcttccactttgcttatttgttatttcaatttgtacttcaagctgggtgtctttggcatgacatttaaagtaaacttctgttctttccaacaggatgtataaaatgtttgctacaaattataggtttggaggcagggttttgctttcttcatatggctctatacctttttgcctttctaatgttggctttctaagtctctggtcagttacctgttccctataccaggatggttgataaacccttctctattaagagaaaagagtatatttctgaccggggtttgagcaaaaggtggattctccctcttgacagagctgtgaacaaaaaagctgcttcttttatggtatacccagtgatagtaacaatgaggggaattttgtctgcattagcattctgtgcctactgtcatatgggattcatgagtgtttcttttcttatcctatacctgggaggcacccagtgtaatgaaaaaacatatttgaatttatatgaacagaatgaattctaagttaaaatatggttccctcctctgagaaaactctaaggggatttaattccaggccagtttgtatatctgatgcatgtgttgaaagcatgaaaggtgctgcctgccccttttccagcttctcatcaaaaaataaacccagtaatgttgcagcttctccttattcttaatttttaacccaacagttttacttctatacacacataaatttagagagagagatttaaaatatagttcttctaagcttcgaaactttgaacaactggagatgctagaaagataatattttcttttatttaaaaaatcaactgttattgagatgagactttcatacaattttaatttttcaattttgaactttggttcctaaattcaacaaaagttaagacaagacatagaaggacattgcagctgtcaattttctcaattcataaaataccagtaagaatggtatctgatctcaaagaaataaatacacaagaaagatgtgaattaccttgtcaaaagagcctgagcaatagcgacatatatagatacagcttagctaaaataaggcttagctaaaagtaccgggaaagagatacaataggaagtgttagtcatgaagtaaacctggcttatggcgcttttatgtgaaattttatgactgtgttagttaggcttttttggcaataagtaacaaactcagctcacacaagttaaagcataactgaaactttattggctcaggtaactgtgagggttgtcggggaagctcacaggaaccaagatagttacagttgccaggtctcaagtgctagaaccaaaattcaacatggccaggactctttctttgatctgcccttattcatgctggactttattttgcagaggaagttagttcctccaataaaaatgatgcttgggaacatgttctaggtaagtagctccaatggaatgaagttttctatgtcaatgtctgtccactaaagtcctgtggagagctctgaataggttctgtttggtttcgagatgtctactctggcattagtgtagctggtggaatggaagactcattggccaaggtgagtcatgtgaccaatgaatggataaggagaagaaattttgttgttagaactgtaatgaagggaaaacattctggccatctaaaaatgataaatgcttaagtgttttgctttaactttggacaagataagcttgtatgagtctcagtttccttgtctgtaaattagttataaaatttgccaactaagtgtaccagaaaaattaaaagtaacgtgtaaaaattcctagtaaattgcagaatttaataattcctaatacaattgcagtagttacagacttcaataaatgtgagttccaaccactatctgtatgtcttagtctacttgggctgcaataacaaaatgccataaaatgcatgttttaacaactaaaatttatttctcacatttttgctgtctgggaagtccaagatcaaggcactagcaaatttagtgtcttgtgagcacctgcttcctgattctatggacagccatcttttactgtcttctcacatgctggagatggcaagaggtctctcttggtccttttattttataagggcactaatctcattcatgagtattctgccccccacaacctaattatctcccaaagttcccacttcctaattccattaccttgtaggttaggatttcaacatataaattttgaagggattcaaacattcaaaccatagcactgtggtaacaagttaactgcccaaatttttgtagtttaacaaaatcaaagttacttcttgctctctaaaggtgtaactattgacaggtaactctctttcagtgacagagacgacttaatcttactgttccagtatcctaatcttggagccatttatacccaagtggtggaaggaaaaattgatagtaaaaaaaaagcacacctgctccctataactccgtggtaagaagtgacttgattacacctaaaggccaggaagcatggcaagtgtaggttctcgcaggtcagctacctctcagtgactaattcattttatgagtaaaagagaaacaattttgatgaacgatgagggttttttgtttgttttttgttttgttttgttttgttttctacagccaatactgcagcacttggatcaaatgatcctcaggttttttctttatgtgtgtagcattgagccagaaggaccaatggctaaattggtccttctgggaactcaaagttaaaactacttaggctatttacaaatacatcaggattctttggatctcaagctctgttttgaagttatatgacctccatggtacatgttctccatgagaaataaaggtcagggcaagaggtgcttcatctaccaccctctcaagatactcaagactgatcatagtaaatggatcaaccaacttaaaggagggataaataccataaaatgttcccactggaaacaagggttttgattaaaataagaaagatgatttactgaatttgccctaaaagaaataaatagagaaataaaagaaaaagaaagaaaataaagctcagacatgaggaattaaaaaaaacttttatctgaggaatatgagtccttttaaattattaggcccagagagatgtcaaatgagattgcagcaggtcatgtcccacttccccccttgagctgtgtgttcatttcttaaacctgctattgacacaaatagcaacacattaacctcataatattgctctggacactataaccaacaccctatagcttgacaatgtgtagccaatcactatcaatgctgtttccctaaatcaatgagaaaccctgacaaacaactttgtatcagctcgctccctcttcctcttttttttttttttttgtctttaaaaatctacttgtgactgctgctaattgaagggtatattcagggcaacttgagtctatgctcccaggttgcaatccacaagtttagtgcaaataaactctctacttttgttaactttgcctcagcatcttcttttttggtcaacagacacaagtttaaaataaaattcctgtgactcaagaaaccaagaaagccagttttcattcaaaagtatctgctaacattgacttccatcagcttctctttttaacatataaatgagaagaaagaaataaatcctacagccttcccagggtaaggagttcgatagaagagtgcatacaactgagactcacgaaaacttcgatcataagtgacaggtgaaaaataaataaccccctcatgcagaagaagacagcaaaaaacatgagattcttaaacttttctctaaagggagaggtaaaaaatctcagaaattcacaattaaactttcacatattttcaggcctgaatacatgtcacttgaatacaaactttttattgacaaagattattcaactgggtaagaaatcagagataaagaacacatttaagctagatataaaacatttattttgcaacatgttgtgttgtagatatgaatggtaaattgggatggagttttccaacaggcaattagatatttgtgtttataacttaaacaggtttgaagtgtagctatccatcagtggggtataacatctaaggccattcgaagccatgaaaagtagatgaagaattcgctttcaaaaattggtacactaattctgatagactcttcaactaacaaaactggaaaaagtggattaaattaaaaacagaagaaggaacaaagagagaatatctttcttagaatttgaaaggaagttatcacagtagctacagaagagggcttctgtatgtgacttgtgattttaggtagggaatttcagctgcagtcatccaatggtctagcagaaaagaagcagagaaggtcctgccaaccttccataccctgtcagtgcatccctttggaaaaatctaactgaaagcctggctcatgaagtccatagtatcaacctgttgagccaagctgtgaatcttgtaaggctattaaagaatattcagaaataagaaacaacaacaactgttatgtatacatatatatgtgtgtatatgtatatatgtatacgtatacacgtatacacgtatacgtatacacgtatacacgtatacgtatacacgtatacacgtatacgtatatatgtatatgtgtatatgcatacatgtatgtatgtgtatgtatacttatatatgtgtgtaagtatacatatatacgtatatgtgtgtatgtatacatatatacgtatatgtgtgtatgtatacatatatacgtatatgtgtgtatgtatacatatatacgtatatgtgtgtatgtatacatatatacgtatatgtgtgtatgtatacatatatacgtatatgtgtgtatgtatacatatatacgtatatgtgtgtatgtatacatatgtgtatatatgcatatatatgtatatataagtgtatatatgtatatagaacatatatatacacacgtacgctttttgatgagaagagctataactcattgggcaaataaaatggttctaggctgtcaaagaatgacattttaagaagttgagtttaagaatttaagaactctattagtctgttctcatgatgctaaaaagggcataaccgaggctgggtaatttataaagggaagaggtttaattgactcacagttccacatggctagggaggcctcccaatcatggcagaaagcaactgaggagcaaagtcatgtctaacatggtggccaggcaagagggcttgtgtatggaaactccccttgaaaaagccatcagatctcatgagacttattcactctcataagaacagaaatggggaatccacccccacaattcaactatctccacctggctctgcccttgacacatggggattattacaattcaaagtgagagttgggtggggacacagccaaaccatatcagtaacgaattagctttaattgctcattcactgatagggcagcattcaatctgtgaaatagaaaggtgctttgctgagcagagcaggggtggtggatcttataggcagaaaagactgaaggaaggagaaatgaggaacaaaaagtgaattggtggttcaaagttactttcctggtatgaattaatgtcagattatctgggcttcttataactgcttgctgtgaatctcctgttttcttttggaaaatagacccattcttaaattctgtttgattctgtgatatttagcataagtgactccattatgatttatctatcaggaccttgttgaggatctcagttcaaaacaatggctgctatttattttatttaaggctcccttgtgaaggtgagtccatgatccacagagtgagcactttctggggcacagcggtggccagtccagaaagagtccagagagtagcaccatgaatccagaccttgctgcaggtgatacacaaaaactgtgaagtagaagcaatctggcttcactgtccccaagagaaagccaaaaacaaatatttaatgccaagatcgtcatcagcaatatcctagaactcaaatctgtagctgagaaagtccccaggggcacaaagaggttaaaaactcagagaaatggtaatacaaatagaattctctatacacaatgcttccctcccaatctaccaggcaccatgcacagaaaattcctcctggacttaatggcttctacactggaaaaaagtgaaattggggctgacaactagcgtccccatcattttggatttccttgcagaaaaaccgtttctgcctcaacccaagagaagcattccaaatgtgtttaggtagaaaacacctaaaggcagctgtgaagaatgagaacagcaagaactaaaaaaatcagcccataaaaccctgctctttatcttagtgaaaggagatgctaaatcacagtgcctatgtactagcactatgctataggaggcatgttccatgggtcttctgggcaggcacctacaccagcctttccacatagccacatatccattttgcaattttcccttccaggatgggcagtgctcttcatgtttgcaagagccaaggctaacattgacttaagccaccatctagtactgataaggaaacagtgatctaggactaaggggactcataggcaactgcaaagaacctctaagtaaatatacataccttcaaaagacctaaacaaacccgacagcaaagactagaataaataactagaatacctcttcaatgtgaagccatacacatatatctacaataaacaagaacagacagggaaccatgacctccccaaatggaaaaaaaaaacaaggagccaatgactaaccataaagagagagtgatgtgttagttttcagattaagaattcaaaacgatgatcctaaagaaactcagcaaactctaagacaacacagaaaagcaattcagaaatgtatcaggtaaatttaacaaggatattgaataatttaaaaattaaacagaaatcctggaactaagaaattaatttattgaactgaaaaatacgttagaggctctcaataacagaaaggatgaagcagaagaaaaatcaatgagtttgaagacaggctattgaacaatatacaatcaggaaaaaaaagaatgaaaaagaataaggaacatctggaagatataaagaatatctatatttcttgcaaatcttaggataatcagcactaaagggagagtggagaaagagcaaggggtaggaagcttattaaacaaaacaataaaagaacacttttcaaacctagagaaagatacaattattcaggaataggaagatcacacatcactaaacagattcaacccaataagactatcctaaggcgtatgataatcaaaatctcaaatatcaaagacaaagaaaggattctaaaataagccaacaaaaagaagtcagtagcaaataaactacctttaattcatctggcaagagacttctcagggaaaaaaagacaggccaggagggactaggatgaaatattcaaagtgctgaagaagaaaaaaaactttcaagcagaaacactgtattcagcaaagcttttcttcaaatatgaaggagagacagagtctttctcaggcaaagaaaaaaaataccaaggtaattcgtcaccattggacttctcttatgagacatgccaaagagagttttttgtttaaaataaaatgatataaatgtgcaaaaagaaaacatttgaaggtgtaaaactcactgaccaaagtaagtacacagaatcaatactttaacactgtaattatggtgtgtaacccactcacattctagtatgaaacacaaatatgaatctatccaaaaataaaaataactatggaaaactgttaagagatagtcaataaacaaagatgtaaattaagacacaaaaatgtcaaaataggggagatagagttaaagtgtagagtttttgttatttgtctgtttatttgtgataaaagttacttgtcatctgtttaaacttacttattgtgtctacaagatgttctctgtaagcctcatggtaaccacaaagcaaaagtatatatatgcatatatattttagtgtataatagatacactgaaactagaaataaactctcaaaaacaatagattaaaatatactactagaggaaaccattaaccacaaaaaagatggtaagaaaggaagagagaagttataaaacaaccaaagaaaagtaaatcaataataacattgcatgtattgcatgtaaatggactaaatgttccaattaaaacatgtagtgaatgaataatttaaaaaaaagaaccaaatacatgctgcctaaaagaaactgacatcacatacaatgacacagagactaaaaatgaaagaatggaaaaagatattccaagcaaatgtaactatacttttatcagataatttagacttcatgtcaatgactgtaaaaagatgtaaataatgtcactatataatgataaagaggtcaattctgaaagaagatgtaagaattgtaaatatatatggcccaatgccaatgcacacaaagttttaacacaagcattagtagagttaaatggagagatggaccataacacaataatgactggggacttcaacaccccactctcggtaatggacagttcatctagacataagatcataagattaataaagaaacatcagttaaacaacactctagaccaaatgagcataatgatgtttaggaaacattttacccaactgctgcagaatatacattcttctcatcagcatgtgaaacattctccaggataaaccatacttttggccatagaacaagtctcaacaaatccaagaatgttaaaattttatcaagtatattttctgatcacaatggaatacgatgaggaattttggaaactctacaaatacatggaaattaaaacacatattcctaaatgaccactgggtcaatgaagaaattaaggcagaaatttcaaaatttcttgaaacaagtaaaaatggaaatacaatattctgaaatctatgagatacagcaaaaatagtgctaagagagatgtttatggccataaaagcctacaacaaaacagtataaagatttgacacaaacaacctaattatgcacttcaaggaattagaaaagcaagaacaaaccaaaccccaaatcagtagaatgacaaaaataataaaaaccagagcaggtgaaacacagtggcccatgtctgtaattccagcgctttgggaagccaaggcaagaagatctcttgaggccaggagttcaagactagcctagacaacacagggagacccctgtctctacaaaaaaaaaaaaaaattaattaattaacttggtgtgatggtgcacactcccaggctcaagcatttcccccacctcagcctccctgctatgcaaaaggaaaaaataaaaaaaaaattcagatcagctataaataaaatggacactaaaaaaaaaaaatcagccaggcgcggtggctcatgcctgtaatcccagcactttgggaggccgaggcgggtggatcacgtggtcaggagatcacaaccatcttggctaacacggtgaaaccccgtctctactaaaaaaatacaaaaaatttagctgggtgtggtggcgggcacctgtagtcccagctactggggaggctgaggcaggagaatggcgtgaacccgggaggcggagcttgcagttagcggagatcaagccactgcactccagcctgggcgacagagcgagactctttcccccccccaaaaaaaaatcaacaaaatgaaaggtttgtcttcaaaaagtccagcaaaattaacaaaccattagctagattaagaaaagagaaagaagagtcaagtaaaattataaatgaaagagagaaataactgataccacagaaaggcaattgaccaatagagactattatgaacaactatatgccaacaaattggaaaacctatcaaaatagactaataactggacacatacaacctactaagattgaaccatgatgaaatgcgaaacctgaacagatcaataatgagtaatgaaatcaaagcaataataaaaagtctcccatcaatataaagcctaggacctgatggcttcactgttgaattctacgaaactttaacagaagaattaatagcacttctattcaaactattccaaaaaatcaaagatggagaatacttttaaactcatgctatgaggtcaatattacccctataccaaaactagacgccaatatccctgatgaacacagatgcaaaaattattttaaaatactaacaaagtgaatccaacaacacattagaaatattattcaccatgaccaagagggattcattccagggatacaaggattgttcaacacatgctaatcaatgaacatgatatatcatattaacagaatcaaggaaaaaaacaaatcataaaatcaatagatggtaaagtagtatttgacaaaattcaacatacttttatgataaaaactgaacaaactggatacagaaagaacatacaaaaataaaggacatatatgacaaactcatagctgacatcagaatcaatggggaaaattgaacttttcctcttaagattggaaataagtcaagaatgaatacgttcatcactttaacatagtattagaagtcctagacagtgcaattagacaagagaaagaagctaagtgcctctgaaatggaaaggaagaagtcaaattatgcttgtttgtagacaacatgatataaacactacctaaaaactgttagcatgtataaacaaattcaataaagttgtaggatacaaaactgatgtaaaagtttactaccatttatacatgccaacagtgaacaactgaaaaataatcaagatagctatttcatttacaatagtaacacaacgtatgaaatactgtagaataaattaaatcaaaggagtgaaagttatctccaaggaaaactataaacactgatttaataaactgaagacaacacacacatacaaacaaaagatagcctatgttcataattttggaagaattaatattgttaaaatgtcaacactatccaaagggctttacagattcaatgcaatctctaccacaacaccaatgacattcttcacagaaataggaaaaaaaaaaaacaaaaaacaactaaaatctgtatggaaccacaagagactctaagtagccaaaacaatatggagcaaaaagaacaaagctggagacattacactacctgacttcaaaatatactacaaaggtatagtaaccaaaaaagtatggtattagtattaaaacagacacatagacaattgaaaagaatagaggactcagaaataaatccatgcatttacagccaactcataattgacaaaagcgccaagaacatacactgaggaaaggacagtctcttcaatatatgatgctgagaatactggataagcgtatgcagaagaatgaagatagattcctttatccaccatacacaaaattcaaatcaaaatggactgaagtcttaaatataatacctgaaactatgaaacttctagaagtaaacattggggaaacacttcaggtcattggtctgaataaagacttataggagaagaccacaaaaacacagacaacaaaagataaattagacaaatggaagccataaaaaggagactatgttatttgccacaacataaatggacctgaaagacatttcactaagtaaataagtcatatgcggaaagaaaaatattgcatagtctaatatatatgtgtaatattaaaaaataacttaaatacacaaatatagagagcaaaatattggttagcaagggcagggggaggtatggagaggaaatgggaagatgtaggtcaaagggtatgaaatagcagctacatagaatgaataagtatagagatctaatgtacaacctgaggactaaagttactataattgtattatgttaagaatttttgttaaataagtagattttagctgctcttgtcacacacaagagtaactgtgtgagataatagatatgttaatctgccacactacgtaacaattttactatgtgtatgtataccataacatcacattgtaaacctcaactatactttctttgagcaaaagtgtatattttttggaaaagactaatataaccaataactagtgaaactggtagtgaaaaacatccagaaatttgtaagtgtacatcatgacagatcctgcaaacattaaaataagaatattatttacaaaattgtctactatgtttcagaacataaacggacaaattcctagagagatagtttacaaaactgacagaaaaaaaagaatgctaaataagtctgtatctattaaaaataatgaaacaatatttttagaacttcctataaaaaaacttcaggcccagatgacttcattaatgaattctagcaaatatttaaaaaagaaatgtaacaatcttaaatttgtttttgagaattaagaaaaaataatatttccaacttgtgagaaaaatctgtcaaggccatcataagagaggtaaatggtatgttacctttttgcatggagatagatacaaaccctttaaaaatttgcagacactcagctaactatacaaaaagaaaataaattacaaccatggttgaatttactctaggaatatgaagttagtctaatagtcaaaaatcaatagttgcaattctctatattaacaaaatgaaggagaaaaatcgcctcaatacatacagaaaatcaagtgatgaaattaaaaagtcatcaatgataaaatctcctagaatcctggggataaaagggctcttctttgacacactaaagaatatttcctaaacacctccagcatgcatcatacttcatggtgaaatattagaagcattccctctgagactgggaactagataaaatgcttactgtgaactgtcaaagtggaaaggcaaaaagaaaaacagttgaaaagtattaagaattaggtcattaattatcccattctattcaggtttctagatatatgaagagtcatgataaagaaatataaaaagtggtaaagtgatgcatcactgtgtatataggctgcagaacggaggaagggattccatgtgatggtgatgaaagggagagagtggaggagaatcaatgaggcagctggagacacagaagacaaagatcagaacattgaatattagagcaaagttttagagatgcattgctttttgccaggtgagcattgtattcacaggctaataggtgccctacctaggaagatttatggattcgaggagctcaagaatctttatggttaggcatttattcagttcacccatatggattttggagttgccctttaaaataacaggagtttgagagaaaaggaagactgtggcaaattcaagttttctgagaaatgtgggaagaactaaaagttcagtacacaattgttcacaaggagacataataattgcaatagctaagtgaacttaaaaaataatttacattgtttgttttatttcaatagttttgggggaatctgcttgattatacagataagctctttagcggtgatttcttatatttggtgcacccgttacccaagcagtgtacacatatccaatgtatattctttcattcctcaacccccctcccacccttccccttgagccaccaaaatccatcgtgtcattcttatgcctttgcatcctcatagctcagctctcattttagttttagtttttgaatatgtaaaacatgtatatagttctaaagtaaagattatatacacagctatactcagaaaatttgtatatccatttctttctttttcttcttcttctttctttctttttttttttttttttttttttttttttgagacagggtctggctctatcacccagactgcagtgcagtggcatgattttggctcactgtaacctctgcctcctgggctcaagccatcttcccacctcagcctcctgagtagctgggacgatggtgtggaccaccatgccccactatttttttttttatttttcttagatatgggatttgaccatgttgcctagactgggctcaaactcccaagctcaagatatctacttacctcagcctcccaaagtgctgggattacaggtgtgagccaccacactcagcttccattcctatccaacttttttctcacaagtaattgttatcttcagattctggtatatacttcctgtatttctttttgcaagaaagcatgtaaaatacctacatgtatacaaacatgtaagtatatatcctcagtgctccttcctttttacatagaggtagagttacttacaatacgtagtaatgtctacttgcttttttcacttcatgatacatccagtaaatcacactatattatttgatagaaataaatcttatttcatagttgaaaattactcttttttttaatgacacacaatttattcaaccagtaacctatggatgaacattaaggttgtgtctaatacgacactattgctacaatgctgcaatggataagcttataattatttaactgcctttcttacctctgtccacttgtcactctgtgatgacaataaagcatcagttgcctgtaatataactagagaaatctgaagaaccttagagaaaatggtcattaggaagagctgtcctgaatgattgagagaatattcattggacacctagctgttttgtacctgaggttgataatgtgatatttctcaagaagccccaaatggctttggaccagtttataataaatgtgctttccttcagtcatttcaacctgttccctgggatcatgtcaggagtgtgagctgtgctgacctgtataaagagacatcacaacaggtcaacagagatgaaacagagctgaagaaacaagctagagatgatgaatagaatcagcctacacccagtgctcaccccgagacaggctacagccaagaaatctccatcacaaacccagtaagtgccaggaccttcctcagaaagggcagcctcccagtaatcagaaagatatgcaaggctgcatcctacctgtcgcaaaccacccaacagaagtagtgtgctaccaggcagaggctgggggcctcttgagagtgtgtcactggcaatgggtgggtgtctaggaaagccaggattttgcgtaacagggcaacgagcatcaggctctattggccactcatgtagagtatggcgctagccattccagccttccaaaacagtggaagccccagcggattcaggaagattctggaagaaccatgattactcagctctggtgtctacagttcagctttaagactttaggcttaagactcctactaacaacaaaggtcctctgtcatagctgatctagagcactgagcagaaaaaggaattgtagaatgccttgtgtgggtgtggtgacattgaaaaggcaaaagtatatcagctggggttcaaggacagaacaaacatagtgaaagcaaggaagacagagataaatttccaagttgctgagctgagattccttcatttgtctttggcttgcagtggttgggcagcgctccatacactaggaatataatgagtatttctgcttgttagaattagagggaccgaaggacaggaagaaaggatcaatgttagaaaagcaatcatgagttacagagcagcagactagagaccaatgtgaccacagcagggacaaagcaagtttccagcagagggcagaattaaccaggatatctggatgctgaggccatgggaggcaagtccagcatgaggagtgagctgtttagaacctgaaagtagaagtggatgggcccattcacaacgcatgcaagtgttgacaggactgaagtgcacaaatgcagaggcagagttcagagcagatcagtatggaccgtaagtatttccctgacttttattttttcacaggcattaggaatgaggtggcctcttggggtgcacatctccatttgggagttagagttgaatagggcataattgtctgtcttctcttgtttttttgttttgttttgttttgttttgtttccttgattcttagcctattaatggggaagagacagtctgaatgcttcctttaaccaatgactcaggaatgatgcctttgtgcatcacctcctcctgtttttaataaggccattggtccagaccaggagactgaacagtgtaggtccccatggatttctttcaactaaaactttgtatttttaaaaagcttaattgcgatcttttgaagtgcccaattaaagatttaaagaaataatgaatatcctgaggtggtctgtctgccctggggttcctctgcaaatgagggacacatgtttctattcaattacaggaaacattttaaaactggctcttttatttcctgctcctcatctccagttcaatttttctcttccatcattttctgccctttcaccctgcagctctgaagtttgctctgaccagcactagaccactgcttcctccttttgttctctaagaaacaactgagcctttgctggcggaacaaacaaacagcagcattcttcagtccaggggtattttgaatcctccagaaaaaagctggtgtggttacccgtgagctgactcaggacatctgcaagacagaggttttacacagccaatccatttgaagtggtttacatcaagtgtcaccattccaatgattaattttagtcctgagggtttaaaatgtaattggggggttaaccttccatccagccctgcacttggtacagagtgggcagactccttttttgctcagtggtggttctatgctgggcttgacaccaggctctgttccctgtcgccagccatacagcaagtcccttgagatcaggtcctatgcattcacacattcattaacttttgctgtctgcaaacacttactgagtgcctccatgtgctgggtactctgtcaggtgctggggattacccgaaaaagccattaccaaaggaggtatggttcttacccacatggagctgtacagacttctgggaaaagagacagtcaactgttctataaatgtctaactataacactgtgagcacacagtgctatgagtgtacagtttgatgtatttgggaggtcaaaacattcctatgaagtagcaatttatccaaggtctacatgttaagtaggaattaacttggtaaaagagagggtggggatagcactggagggagaaagagcagcaagtgggaaggcctatggtgggatgactcatgcactccaaatgtttctcaacagagacattattgggtggaattgttacctacatagaaaaatatttggcatttttaccttcatctgagaaaggctaggatctgggtcccaacttctaccctgcttcttatgacaacaaaatgattcccacattttgaagcatctccaagacagctttatacctccagttaggaaccactacattgggctctaaaaagccctttgtctttgaaggtgactggcaggattgtaaaaaaggaattggtatgaaataacttggaaagaatggtggtacccagatctcttagccctcttagggagtggataagtaggtcagttcttcagaaattgattcctagagtcaattcttctaaaccggtgagccacttacctcacaaccagttggactgatcactgagagttttagtcttgcccctgtctctgtgtttgttcttcgctctgctgtttacctctgtatatgtttcggatctgctgttttgtgaccatgaacaagagctcacaagagggtaggggcagattcaaggtcaaatgacaaagaaggaacaaacagaaaatagaaaactacaaaataaatcctcataattcagcaaatggcttttgatgaactgatattcagttaactgacccagaaccacattgtctaccatcttaaagtgggcatctttctgataaaagcaatgggaaggtggaaggaaaggtgttaactcagtaggttagttgcagcatggaaaatggactggaaaaagtaagagcagatccaagaacaccagttaggaggttagcataatagcacacatgagaaacaatggtagcttagaccaagttgatagatagagaagtggatgaattccatagacatttagggggtaaaatggacaaaaatgggtgatgacatgagggtaataaagacaaatgtgtaaagcttggtggtagtgacatggacgtagagagagaatactggaagatggccatatctgagtgggagatatcattaatttggttttgcagatgtgttttaaagtatccaagaaggtatatcttgtagttgtacaacacagtctagggctcaaagaagacagctggtttagaaacataaatttaggtagcccctgcatatagatgatgtattagcttgttgggcctgtcttaacaaagtatgaattgagtggcttaaataacagatttacatcctcatagttctggaggctagaagtccaagatcaaggccttggcaggttgattccgaggcttcactcctaggcttgaaactggtcatcttctttcagtgccttcatatgttcttcccttggtgccgatatcctctttttataaggacagtggtcgtattgaattagagccaacccatacaatctcattttactttaacttctcttcaatgcttctacttccacatacagtaatagcctgatacacttgggtttaggatttcaacatatagattttggtaggatacaattcagctcacaagagatagcaattaaagctggagatgtggtgtaattttgcttagaggaagaatatatagtaaaaggagagggtctaagacctctaaagtttaattttcaaaaagaaaatagtggaagataaatccctaacaaagaaatccctaggtcatggaagccaagggaattgagtgtcttcaaaagtaggcagttgtgaaactgtgaaaatttgatgaaaaatcatatagaatgaggattgacaaggaatcctgctttctgtcttatttactcactgcctagcttggtgactggcacctagtgagcatgtagtactaaattaattatgtattgccatatttgagtatacagtggggagaagaaaaggagagggaatgttgggtatcacagaaatggctaaccacatctgtgccaacttgaataggatgaacatctcagatcatcagtcccaaattatataaaataagttgaatgatgtctatctcacagggttgaccgagattatatgcctgacgaggatatcaaagacacattgtgactattattcaagcttcccattaaaatacattaactttaggctagaaaattgtctcagattggctagaagtagaaaaaaacagaaagtgaatccatatcaagccacattcttactacagaacaaaatggattagatctagaaaggctgttttcacatgtgaatttcaaaatgcgtcaaaggctgagacaggactctgctgcagtgtgagagaaggcagacaatagcaatgagacaagaggggacatatggacaactcactgtcactaatgtctgtgtaggagagtctaattttacaatcacatgaaaaataaacatacccagaaatgaaatatctgatttatcttatttatatgtgtgtgtatatatataaaacccagatatgcatgtatctttctctgagtgaatactctaaccccttgataggggaacagtctcatgtaaggacaccagaagcaaaagggcctcttgccatgttgctttatgtttaggcaaaatttagagtcacatgtcaattagtaaactgattataaagccatagaagtctgtgacccttttcctgtatttctctgccttggtgtcaatatttccacatctgggtacccagaatactcctgacatccagaataaaacaaaatgaggaaagggagaaaaaaacaaaataggaaagggagaaaatgttacttttttttttttgagacagaatctcactctgtcacctaagccagagtgcactggcacaatctcggctcactgcaacttccacctccggattcaagcaattctcctgcctcggcctcccgagtaagtgggattacaggtactcaccaccatgcccggctaatttttgtatttttagtagagacagggtttcaccatgttggccaggctggtctcgaactcctgacctcaggtgatctacctgccttggcctcccaaagtgctgggattacaggcatgagccaccatgccctgccgaaatgatacttttgaatctttattataggtcaaatactatggtgagagttttcatataataccttatttagtcttaccatcaatatttgaggaaactttcctagtctccactttacaggcaatgaaactggggatttgaaatgttaacttatcccagttcacagaataagtcagtgtgacctcgatatggtgatgtgctggggctggctcctgccgactctccaatttgtgcttctcttcccaaatccacgttcaatggtcactcaacaatggcctaggtaaaagctcaaaactggcctaggtaaaagtgtttataccatgaaaaaagaaaatgctacagatgagtgttttttttttattttttaaatttatttttattcatttattttttttccagagagctggttactaagcatttaccagaatcccctgactgagattaggagcaaatccatgctctcgccaatctattatcattgggggtgacaaggtggaggctttttctccacattattctattagactgaaatctgccctgaggtggcagagactaaagcgtcatcatcattacttaagaattgaattatctgctttatttcacaatgcccacatttgaattaactgtcatctcttatatgaacttttgcaggtctgtgccacactctaaacctacatagaatcaatgaaactcaccaaccttaataaagtgtttgttaatggaaccagtttactcgactcaggacctaggttagataggtgggtgaagactcatgaatgtggccaatggaaagtcacccactgaaacaaagccagatggcaagaatttacaaaaaggctccaagaaaaaataaatcagaatattaatagctgacatttgtgaaacacttatatggcagaaattattccgaggaatttacacaaattaacacatttaatccttgcaataatcccatgagacaaatattatgaaactctgtcttacagatccagtatctgaagcccaaagagcacaaacagctggcaatgagctcagccatgatgtgtgctctcagctgctaacagagatcctggcacataggggccctcattgatattaactgaaatgcacacaaggccagatgtgcagcacaggtttcctggacttttcttctttgtggcagtttctgcagtatattttccaaagggtgattttcataaattaatttcaaatctctgcttgtcattctaatctgacccatcttaagatggcatctgataaagttgggaaagaaacatagggataaagtatgtgatgtttcttgtaatacaaaagaaaataaacaaaaatatttaagcagatctgtctatctatctatacatcaatccatccatatatatatctgcttaaatatttctgtttatatgtatatctatcacctatctacctatctatatacatatatatgaagagagagagagaaagacagagatacttctcagatatttatttatttgtcatctgttgtctcttactgactggcatccattttcaaaatggacctccacaaaagtcaaaattcagtacattggccttgcaaaatattgtgatacaaagccagtcctcaaggaatggggcataactgcccactgggaggcacagggcttcaccatgcatctctgaactactgacttgggtcagcctcatgaaatataaaaggaaatctttcagttggtttagcccccaggaagagagcttcaatgccaaaaagcttctccttctgtgcctgctttgagtttcctctttccagtgagtctaagaggctggggagtggagtttgggtgatacttcccgggacctgcgataagtccctcccttgatctgggtctccacttcctcatctttagtagacttataagaaatggtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatgtctctgttttggtaccagtaccatgctgttttggttactgtagccttgtagtatagtttgaagtcaggtagtgtgatgcctccagctttgttcttttggcttaggattgacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaagaaatggtgataagataatctctaagatttccttcaaatataagattttataattcaaagagtctactatgctgtccatgcggaaatgttagttgttgcctgtaagcaatcgtgttgccttggcctaaacaggtctttatttccaggaatatcctcaccatgacaaccatcgatttcaatgtggctgatgggctgctttcttaaagtccagtgattttaggacttcagaaattaggtgataagctagagtagacatcgaccactgcctttgttctctaggagccctggtattgtagtagtgtttgtaaaagtctgcttgatgtctttaagaaaaatatcaatccctttttcttctagcactactgatatttttctccaactagagaaaaataactttatatccaaagttacatcatgagaatgccatctttgctggtaacaaaccttttcttgcttaattaggacagcctgaagtctgtgtgaagaagaaagtataaaataaccaaactttttttttttttttgagacggagtctcactctgtcacccaggctggagtgagtgcagtggtgtgatcttggctcactgaaacctctgcctcctgggctcaagcaattctcctgccttagcctctcaagtagctgggactacaggtgcctgccccttgcctggataatatatttttctttttttttttcgtattttcagtagagatgaggtttcaccatgttggccaggctggtctcaaactcccgacctcagataatccgccagcttcagcttcccacaagtgctgggattacaggcatgagccaccatgcctggccagaagattttgatttctgaaatattctctcttcctctctcaatcagtgtcccactttcttcttcttacatcttcacactttcccccacctatccttatttctctttctcatctttgccttccatctctctccgtgcctctctcactcctgctctgtttgcttatcccaaatcctcttaatctctgtctaatctctttcttcttcttatactgactgcttcttttttcttttatttttcatcctgtttcttcctgccagctcatgtttaacaagaataacccctgtaacatgacattctttataagtgaagtgatttaaaaaaaactttcttagatgtagctcattattttgggaaatcatgtctataactcgcaattcaacaaggattgagtttgtgcagtatgacagagaccatgttgagtgctgaagttttatgaagacaaataattcacagccctctattaagaatctgaagcaggtggctggggggacatatgtaactgttttgattgaggagtcgaagtgtgtgatggataattttgaagagtttttatttttttcagtagcatccacaattgtgctctgccagtctcccttttgctgctgaaagttagactcatttagtgtcatgtctaccccatagggtttagttgacatttattgctttatattttctaaataaaagccttggtactaaatgttttctcagcagttgcagattcattcaccataacaatgcctgttgtaccatgatggagacatttccaattttaattcattttgaaccaagcatgagaaaaattatatgcaagagttaaatatgttctgccattcaactgctaaaagttgaaaagagctataacctaatatctccatgcatacgaaatgaattcacagatttgcacgtaaaataaactgaaattctgacctttcttctcagtctataggttgtcttctctgcctgggctatgctctcttatgataattctttatattaacgcattaagcaatgagcccacagggtgagttaggtttcagcctaggtcaactatgtcttacaaacatacacaaattttgcctgtaaataactgactggtagatgcatgcctatatataactcagtatcgtattggtatctaagacagacaggctggaaccaagttttgttaccaaacccattatcaatgtattagtcagagttctccagagaactctgtattagtctctctccagaggaagtgtcaataagcactgttatatgtgtagtatatatgtatatttattgagagagacagaaaaatatttattatgagagattgcttcactctattatggaggctgagaagccccacagtctcctctctgcaagttggaggcctaggaaatccagtggtgtggctttagtccaatcccaaaggcctgaaaaccaggagagcaaaaagtgtaagtaccagtctgagcctgcaggtccgaggaccaggaaaatgatgtccaatgataggaaaagaaggaagtccccgctcaggcagagactgaatttgcccttcctctgcctttgtgttctattcagaccctgcatggattggatgatgtccgtctgtattgatggggatgatctttactcagtcaactaactcaaacactcatctcttctggaaacaccctcatggacacatccagaaagaaggtttttcagctacctggtcattccttacccccaggcatgtttacacataaaattaacgaccataaccagtcattcagcgtgtacctggtatgtgcttcctgcaattgttccaatctgaccatgtagcctacagcacatgctatatgaggccttatggattgcaagctcttggacacttacttcccattcgatgtataaaaacccaacagcccagacatagggaggctgctggcatctggcatctctctctctctcttttttttttctttgatctttcaacgagtgaatagtgttaggtgcacattggttcttaaaataagatatataagtgaacaggacatgacctgtgacaaaacaggctgacaaaggtttttatggaattacgaataagcttgtgcaggaggcagagaagggtccctaaatgaacaaggtggccagatgtgatacctattctgattataacagggaagagggaattatacaaaccaaaagacagaaaatacatttcagaaaactgaagcaagtgtgagaagaggaggaagagggggcgactaataatatttgagtttgaataaaatagatcctgatacagagactcaacgtcagattattttcctctctcatgattatagatagatatagggataaatatatttccttaattgggcaagggatcatgttattctatactcactgacaagaaaaaaagaaataaaagtaactcttcaggagattattctgtgagagcaaccacccagctcacatcccactagacaaaagtgtttctctaaatatcatcagctcccaatgagagatgttaccaagggcattaaaaatgagaaaacctatactttttgataagggccactgggcatactagcttcatcaaatttgaacttcgttgtgtagcttttttggagaatgggattcctgaaaacagccatacacagataatttaatgaaccaaattcatgtccttcaagtacctgatttgaaatctagtgttatgcctcttgcatctgataaatccttccctctgtcacaaccaattaatttcaggaaggaactccttccttgcactggatagcagaatgcaatgccggctatcactcaaatgttattttttttatgaatgagatcaataaccacagcagaaagggtaatgctagggcagctggtttggtggggctaaaggaagatctgggacaaatagatcgtacactcttgttttcctttgtccttttctgctgctgatctgacaggtggcagactcggaagatgctgagtcttgcttgcctctgggtcctgctggattggcagagataatgaagcatgttctttaccattgttcatcactagactccttaaacatgttaatggacttctacattcgctgaatatcctgtgcatatctcttgttataggaggacatgaggcatagaggattccaatacaccaaattcatcgaactgatattttaaggcaagcataggcaaaagtttcctaaggacaagatacttcttatttactggaaaatctgaaataaagactgaattccatttaagaggagaattgttggtgtttatgtgtgtggatgctgttatcagtggaggagtttaatatccctccttctggtcgtatttcacagatcacggtagttcaacaaaggagtactaaagaatagaacttatgtagcatcaggacagtgggtgcaacagtaagtctgggaaacaaaggcaaaataaattagacaaattttttttgaaagcaatttgataatgtgcatcagaaatcttcaaatgattatgcagtttcattcagtaattccacttttggaaattgaccttaaagaaataatcatatacaaaaataaaaatgtaatcacagaagttcattatggcattatttcaacaaggaaaattgaaaataacctagatcattttaacagatttttttttttttttttttttttttgagacatggtctcactctgttgcccaagctgcagtgaaagggcataatcacgactcactgcagcctctacctgcctgggctcaggtgatcctcccacctcagacttcagcctcccaagtagttgggaccacaggcacatgcaaccacaccaagctaatttttgtattttgtgtagagatagggttttgccatgttacccaggctggtcttgaactcctgggcttaagtggcccaaagtgctgggattacaggtgtggatcaccacaccctggccaccaatataattttgactggaaagagctagatgtaaatttgtgcatgcagcgtgtgtgtgagtgaatatgtgtatgtggagacagagaatgcaaagaaatgcatcattataattttaccaacaatattctatgagtgcttgattttggcttcttttgttttcctctgtagcctttttacccctaatttacaaatcattaccataagtattttatagttttacacttagataaagtcaacagtttggcagtatttgtccccatttacctgctgttcttgcctaagagtgctttacttccttgtctcatgggtgccatgtttgggcatgtgacacaccttggtcgtgggatgagagcagaagtggcccatctcactgttgagaaggaactctcatagcctctagtgttctgctgtgtctcagttctcctagacctgacaacagcatgcgtcagtgtccgagagaggtgcattgcctttaacctgtatctcagattaaagaagacatggagcacatcaacaggtgacccccactggaagacataagccatcaatgggaatccagcctttttgttgtaagccactgggaattgaggattgtttgttacctagcccaaaaaaagatacctaactaatatggtctatttagatatatttatataatattttccattttaaaaattaagtaataattaattagctgtttatctgaagcaattaattatcattaatatcacagacctgaatatagacaggttcatatgtcccaaaagtaaaaaaaaaaataagcaaacaaaactttgcctagtttttcaattttcctgatcagatacatgaacgaatactgtttatgctctgtcttcactttttgcctttatttctcaattcctgtaaatgtaacttctgctcatgccaatatagtctatgattttgtattcatagttttgatattttgaacagtataggcaagttattttgtggaatattctttgaacgttttaacgtctgatttttccttatgagtggatttgtttagacatgttggtaggcattccaataaaaactgatgccgttttcttctcagtgaatttaattaggaggtacacattgttggtttgtcctgccgccagtgatgttgactttgatccttagttaagatggtgtttaccaggattctccactgtgaagttaccagctttccctttgtaattaatggatgactttcagagcatgtacatatcctgctcctcatcaaacacccattagttcttgtatatactgtagctttgtctaaagttataattgtaagatggttgccatggagacagataattttccagctccatcctttattttacatttatagttgcctttatactgtaaagaaaagctttgccatcttccccatttttttatttattcctaatttttatccaaatggacacgtgttttcatttcattgaattatttataagccattatagtcattatccgctttaatgagcaactatccaaatttggccaatgagagttccttcaatctggctataaatccttctgatgtgccccgtcattcttgagatatttcctatttctgacccagaagaagatattcaaagtgaccgtggacattccttgtcctagacctgaaatcagccatttcccaaggagcccaggttccttttcatggagaagagtatttagaaaccaacatgtgggcttctgatgtcctccttgctttgtgtgccactgtttctaggctcagtggagctaggaagaattaatagatggagagatgaaaatattttgacttctccatatatttatctctaattgtctaaaaccttgtctacatttcaatatctccaattccaatcaaacgccataggattcactatacttttattcgtttttcatatttgtaagcccctcaaccctgggagatctgatccctgttacattcattatactttgttttttacttaaatctatcagaaacagaaggtagtttcggaactgctaactcatagtactggataaagaaacctaataacatgaatacaagagtttggggttcgtccacagctaattttgtttgcagtctgagggtatatagtcaaagcacttcccttaaaagctacttaagttataactgatttttttcagagtagttatgatatttgtttgaaattaagttatgccattttcttttgtttgaattccatttatttcgttttaggatttttcttcttcccaatgcttaatgattttattttatactgtagaatgtgtaaacattaactttgcattctaagtcaaaactatacaaaaatataaccaaagaaggatgctgcctgcactttcaacatttctactccattcctgtttacctttcataggtcagaaatctcataaacatatggcttaattttacagtgtttcttagtaatgatatgttcacaacacaaatatttttacttatcaaattatcttacataaaataccatatttttaattcccttttaaatttaatttttttgacttagcaatatttcctggaaatcattccataacaggtgtatgtatcagagtttactcacccaatctcttacatatcgtcatttatttctaatatttgtaatggcagataatgatgcaattaataatcttgtgcatatgtattttgatattgttggtgatttgtcttgagaatgcattcctaaaagtgacagtactgggacaaatgctttttgttgttgtttgtttgtttagttttgtgaggtctttcttaattctccttcataatagttatgccaatttgtgcacctaccttaagacttatttgacagtacctgttttcgcaaagccatgctctggaatgcatccttggtgttaagcttaactctctgttcagtttttcccctagaatttctgttatttgaattggaagtttggaagaagtgatacaatgcgtgagctcagtccactaaagtaatcagaaatgttcatactaaacagagcgcttggcatgttacagctttgactgcattatgatcacgtccacattgcactcagtagatctgaacctcatccaggaagaagattagggactgcttgggttttcatccactgtctagcatagagttctatattggtgttgcacaaatatatttatttaactagcttatttgttttaaagagacgggtaataagcaatgggaccctgaggcaaaaataagaagaaaatagacagaggccatgtttttaaattttttgcttttgtttattttttctccttcacaaccatagccgcactccttctagattgtaccatgcctttctttgtttttataatcttgaaaagcaaatcaaaaccgaaacctaaacaaggggtcacaaagtgaagggcactgcaagagcccatgagaaattacccggctacttgatgagatatttggatgggaaaatgactccttgatgagtctgaaatacagtatgtctcttttcctgggctctccatttcctgctgccatttcttacatcaagcccccaagacaggagagtttctcagggaatttaaactgacagctccgtgctgattagaagccataggacagggcatctccggaatgagatcaatgtcagagtgcttttgcccacagcagccacagggggagaacatataaaatcaaccagttctttgacacattgtttattagaagaaaatataagagttaggagtgtgaggaagaaaaaggaaagggtttcacatgatgtcctagaaaaacttccagcaacgacaatgggagacagacttttccccactctgaacagtgtgaataaaggcctagatatccacataaaagagcaccacaacttgaatctccagatattcagaagtacccggcatacagttagtcttttgagattgttttctgtttctttccttcacagcagattctacctaattggagtcttcaggacgaagcttagaatatcatcctatttctacaggtgtgccccaagaatgggcttttacacttggttagccaagtcacaggaaaggtgatttaatattttctagctctgggaaagggactgggcagaacagaacacacctaaattaaaagaaaatgcttgcctattttggactcatttcttcttcgttattgccagcctgctctgcccaaaatgaaagtcctcatccagggtgagaaggaatatgctggttgagggagaggtttttgttttttgattggtttctatttccctaaacttggcagagttctctgaaagacttaaagttccccaaaatttgtgagtaaagaaatataaattaatgcaaaataatttaatggtatggtcacctttttgtgtgatatggatagtgatatggaaaactttatttagaaactttattcttatgaggaagaaaaaaatgtaactaacacctcaaatacagctcagtgataacaacattgaaacattcaagattctagactcagatttaatgtcacctcttccaataagccttccaatgacatctgaaagaattgagtacttgctcctattattctagaaatcttttttataatatgaccattttatataagtcttaaaaatgtaaagcaacagtatatccttttaagatatatgggtatagtaaatacatacaaatatgcatgtgaatgaaaaacctcagggaggcacattggatgaggaaatgtgttttgccagaaatgttctctaatgactcacgttgcactggaaatatgtatctatttattgtccttctcttctgtgacagcagaaggacagggagattattttcttcctctctggatgctcaggaatgagcaacagactttgcctatagatgtttaaatatgcatattgcacaaatgaataagtggatgagtgaacacgttaagtcccatgtgggctgatcttgagtataatccatcacccttatctgtgataccacacgccaacctgatttccatctatcctgatgtctgcctgtccagttaggtaattttgtttctttggttgagaatgttgatacctgttgaagcaaagtaatgagtgtgtggatgtggatgtgtgtgtgtgtgagagagagagagagagagagagagaaaagcatttggggttgtgaatgttttccgtattgaatactatattggtgctttcttttgaacctgtttcagtagaaatagagtctgagggctgggtgtggtggctcatgcctgtagttccagcactttgggaggctgaggcaggtggatcaccagaggtcaggagttcgagagcagcctggccaacatagtgaaacccccatctgtactaaaaatacaaaaaatcagctgggcatggtggcaggcacctgtaatcccagctactcagctactcgggaggctgaagtgggaaaatcgcttgaacctgggaggcggaagatgcaatgagctgagatcaccccattgcactccagcctgggcaacaagagcaaaactccgccaaaaaagaaaagaaaagaaaagaaaataaatgaaacagagagtctgagtagagtctgagggcacttatgtttaagacagggaaggagaatgctgctgtcaagagaccacagctttggcatagcatggcagctggatgttgtagggggctggccagggggcacctggagggcaggaggattgaggccatgaagtagaaggtcacaacctgataatctcatgcaccaccaatgaacacattttaagatattatctttgttgaagtacaattaagcacactgtatttgtgcacatactcaaagtgtacaattgtgtaagtttgacttacatatatgcctgtgaaatcatcacctcaataaaggtagtgagcatggtgatcatagccatcctcttaaagagtgtctttgtttctgcaatttcttattcttattcccatccctcccgttgtcctagggagccattgatctctgtcccagggagttctctctcagtgtagaaaattttgcattttccattttaaatagatggaatgtacctttgttttctctttgggagtctggtttctttcactctgaatatttctttaaaattaattgtattattattagtaataatggcgatgatcagtctcttaaccaggttatttatatacatactcatttaattaatttcatttataatgttcagccaaactgaattattaaaaggatacttaaaaagatccttgtggaaactgatttgtttctgacaaggacaatcactctatttatagaggctaattcttttactcacataaaagaaacatggcattgttcttatacaagtaaaaaaaaaaagaggatgtaatacaatgattatctgtaattaattccatatgggaaagaagagcacagtttcctctcatatacaagacatttttatttttcagaaattaaaaaatatgcatcctagccttaaagttctgtataaaatgtcagttctaaaagttttttttttgtgaagctctttattaactggttttatactttgaaaattctctcaacgatctctaagtctggcttaaaactaggactggcttcatttccaacaaaaacaatagtattaggggaaagaaactaggctttcccgtaaaatttcttaattgaaaggaagacaggagtttcaggagcagacagagtttttagaaagcgatattttgaatacaaggaagaaatatccatttcacagacatttaggaggagccagcatgacattaatataacccttatttcagtgaaagataacttagttcaacaagttttattttttaattattttactttcagtattgtggtcgaaaagaaagtgttatgtgtcaatggaagtatcaaagcaatataatcctctcctaccaaaaaaggcttctggtattccaaccagcactccatcagtcaacaatatttgtttcttatgtgcttcattagcaagatgctgtgctagatgctgtgggcaatagagcatactttaaggcaccatccctcctctcaaggggatgaataaagcaaacttttgatagataactaagaatacttggtggtatacaataagttttcaagagcacagaggagtgaaattcctctgataacagagaagtggtcagaagagagactcattggtggctgaattgtcctgagaacctcaggttggaggactggaagatcagtcttgaagtgagcagggttagatgggtgatggagggggttccaggagagagttcctggctggaggaataggggaactgagatgaacagaaaaagataatctcaaagaacagtagtctcttgagggaatgaggaagatgagcaaagaagcagaaacgtgtcaaggtgtgtgaggtttggagaacccagaaggaagcctggcttttgtcccaggtctctgaacagatatgcctttgcattcttcagataactctgtaatgtccttatattcttatcctccctaaacgccttgcaaaacttctatgctaatattcatgactaaagaggaaacattgataggagttgcagaaactgactgcacctagcccactgttagggggatgggaaatgattagcctctggcagttatctagaaagtccagaaatactgactttttttgttgatgttctagatgccagtgttctggggtaggtggagcaggtgttgctgtccacatacctgagcctcagaacttcttccgggattatgtgactcataaatccagcaacaagaactgacttttcctggctgtcatttcagggttcttttcagaaaaccaagcagctactggatactgaccttattctaaaggccaacagaagtggaataaggtgcaatttggaattcaatcaatattgaaggatgacggtgacctttgggaaataggattcagcgatgtctttttaaattctgttatttgtacataacgcactcttacagattttttaaaaaatccaattccacatgaaaaacttttacactgaatttattacatttttaaaaatacataaactcagactttattt

SEQ ID NO: 68 - DNA, 7887 bp, Homo sapiens
cctttaaaacatacctctgacagctccttctctgggcaagtcgcatgagcctctcctctcaaggtatataggtacactctacactgccactcagcacatacctatcataacatatgtgtggttttggaattacttaatttagattctcattttccatattatcctgccagattcttgagggtagtaattgtctcattagtctaccagatcaatgtttggctttaaaaaggtgctttgtaaatattaacatggcttcatcttaaggaaactatattggtctctccaagtatgtgcccatgtgtgaagcccagtgtcctctggtcaacatttccccaattacattctctaagattatggactcttatggtgctcttcccttccagggcccatcaaggcaaattggcatattctcctgatgttttgcccactgtatcccacaggtcattaggtgaatttgtgttattttttcacttgtctaaaagtgcttattaagtatagtccagagttatatggagattttttaccattcaagaatggatactggtgggtatactgagagcccaaaggaaaatagtaatataagatctttgctgtaagctgaagtcaaaatttcattggcgatgttgatgctcctgtgtctgctaatatctttgtcaaataccatatgatgtaaattgtttgatcatggtgagagggtttaggggaaggggtagaaacatgctgaaatagaagaatattacaaaatgttgcagttggagaacaatttctaaattaacttgatctatattttctttttagttaggcctgatgcaaacacatttttcacgactccactggaaatcatgttgctaattaaaactcctgtgctattggaaacccagaattgtccttttcactgtatactacacaaaaccccaggtgcaatagcaatgcaaatattgttctgggagagataatagtttgttgaatgaatgagtgatctagtaaattactgagctgctaaaaacagtaattaactgtggatacacatgataaattttatttctacctctcccattatatgcctacatttaggatggcatttgtgctgcagagcagatactcaatgaatgtttttatttagggaataaaatcatttgccattgtatatgtgcactttttaagtcctctaccattagaagaaaatctccatgaagccagaaatctattttgtagtttctattttctgggaagaatttactgaagcacagacccacagtgggaggccagttattcattgactgagtggatacttggatttaaaagaaaagcatcaacgctggactatggcacaggatgataacaaattcatcaatgtaacaattttgctgatttctaatggctacccgcctatcacagttccaatcagattgatggtgtaatgagctaaatttgcaccaaaataacagtttgattattgagtggttttgtaagctaagttgacaggaatgtagtcattaaatccattgtttatcacttgctttttatttatttaattggaataggtttcttttgaagccattcgacagatgtttgattacgataagatttattttggcttgaaatgctcaattaaagggtcactgattatatcagtcagggttcaactaggggagcagaaaagtcagacaggtagtcaggaagggagggtcacaggcaagctcaaagccacaagcacaagttgaagctgtcatccacacagtcaggaagagaagctcagtagcaggactggaaccccatggggatggagcaggctgctatccacaggtggaatctcttccccctcccagggaagccacagtcttgccttggcacctttcagcagattcagtccgagccatgcagttatccaggataatcaccatgacttaaaggcagctaattggggctttcattacatccgcataatccattcaaagcagcacttacattattgtttgactgaataacaggatatgtagcagagtcaaacttacacgttaaaaaagccgtcacatctttctccaccaggcctaagattccactcctctacacagagacagaaggtcagggaacaataggagaaggattttgccacacacacacacacacacacacacacacacacacacacacacacaaaatccatttcatgaagtgttctctattccacacaggcagggaagatcctaccaaaataagcaagcccctagctcactaaatattatttgtcccctgcagactggagactccccttccttgcctagcagcagcaggcacctcaaatatggaaatgactcctgccctccaggaaggaggcctcagctgccagcaaggaccagtgggagccccagttgtttgagattgtcaagttttttctaaaatttatgtgaaaagatgtgggccctaaaatagctaaaatcataaaagattaaagtgggaggaatcactcattcagtatcaatgcctactctacagctgcagtgattatttagccacaccagttttggtaccttctgtctgttatgctcccaagctgaccaaagagataattaaaaatagtatataaatcacttctgtcttagaagttgactaatgttgtattttttaatacaaatataatattaaatgatttccaagttttgttaaatgtaatttactaattgtttctgcagtggtgtcacctttcaaggacaatatagtattctttcctttataacgttgtaatgagacttttaaaaatatgaaaaatatttgttggtgttttaggtgtggctctgtgcttcatgatttacatgcaccgtcattaagtcctactacagcttattggcaagtattatttattccattttacagatgaaactggagctcaaggtagaagttagatgagtcagaatttgaattaagacattttgagtaaaaacccaagttctgtcattgtgcagactccacgcccccttcaccaaaaaagaaaaaaagtcattaattacacatttacatatttttcctttaaaaaatgttactttgggaaaatgcatttgttcatatatttgaaacattttcaaatatcgagccccacttttaacaggattttagagccagtatgccagcagcaggaatacaaacacaaacaaacgaaaacagttattactttatagtcacatttcatttttataaaatatgtttcatcaactttgtaactggtctttttctctagtctttctaaatgtcatctatttctcatatcaaactctttcataatatttatctgtttaagcaggcatgctactgattctgaatgcagttgtaaacaggaattccaaaattaattttagttatagaggcattttgaaataagtggataactcttgtgtttttttttcaatttatactgaaaatattacagtatttaatatatttaggaaagtagaaaaacaaaacaatttatgtatcatcacatcccctcagtcctagagtcaagaaaattggctttttatctcagttctgctatttagttgtaagaagttcagtggctttgaggaaagaacccagagattcttttctaatccccactttcctaattctagacattcatgcaataattataatgccagccttatgggttattgtggaataaatgagaatgtatgtggcatgctttcattgattgggcaccgtatcctaggatagcctatatttcacacacatattctgcatggctgcattcataatatgcactgttttatgatgggagctacccattttcaaacatttgttatgaagttttgtataaaaagtcacatgcatggatagatgtgaaagaattttcattttgtttagtctcaccaggaatttaagagtaattcccaaattgcttctgggccttgactttctgtcatctattcaaatgtcaaaaccttttcctggaagaatgtgctacacctgctgcaggtatgaccaccacgtttttggatttatgtgccacctattggcttctgaagtttgctcatactgaataaattctgatctaagttctctgcattcctggaaaatggttcataattcaatgaaactgttataggtaaagatgaaacagagaatttaagtgacatgtagtagatcttgtgtttggttaaattcagaactagaattttatgttcatagaacatttgtttttagtgtcctcccattttctcccatccccccataaatggacagtgtttagattgctgtcatttcatgagatgaagtgagggtgctgctgtttttctgagtcagacctctgacctttcagggtgacgctaaacacgttctcatttcacatttacagcaattacattagagattctttactcttgaattgctctttcaaagaggacttaattcattgtgtattttataatgaatttaatcagttacttgaatagccaatattcattagaaataaattattaaattaaaacactattatttgtatattatgtcatgatgtaccaccttcactcctgtttgaccttgacaaggtaaataaacccacaaggtatatattatcgtttctaatgtgttatgtaaatgagtgagcataggctcagaaaatttcagtgcttagcccagagaaagaaggtgacaacgctgaattttaatttctgtggcacaattttatgttccctttaatgtaccgtaatatcatgtaacctccaattaagcaacgtgaatgagaaactaaagtcttttaatctattgtttgatatatcttatcacgggcttttatattttctctctttttgtgtcacacagctccagttatgcccttgataaaatcagtcagaattatttgctatacaagagtcattcattgatttgtccatcctttctataagcatttcctgaacatctattatgagcaagataccacattggatgctagataaaaagaacagagaaataaagtctattcttaaaggcagcacagtcaagggaggtatggacaagtgaataaagtgtgacagtcactgtgatgagggctatgctaaaggtaagcacaggtgcttgtgagaatgcataagagagaaaaggagaaaagtcttaatatcaatgtcaactttttttaagactgcttaactcacaaactaaattaagcaaacaaaacaaagtgagcctcacaaaagtataatctaatttggcataaattacatttaagagtaaatcattgaatagaaacctgagttactctaagttttctgaaaatgaagatcacagattgcatgatagggcttattctgtaacttgaaagaagaaagactttgtattgtgaatgtatagctcaacaatgggctgttggtgccaagcaagatagcataggaaagtgcaaatgcacaggagtatttatgccaaatcccattgctgatatatgccttttaaaatgaatccttcaggaaaattccatattggctctaaggaaaacttcccttaaactttgtctttggtgcactttccatacgcaactatattcttttgacaagaagatgaatgttaattttttttatcacaacagtttttcttatgcttcatctcctgcttggaaacctttctctatatttatctaaatgtccccaacccataaaggcttagttttaacaatcaactaatattgggcaattaggtaatgtgccaagtacttcagtagatgcttgaattagaaaggcaagtaagacaggtttgtcctgttcctcatagaacatttttttgtgtggtggatttaaacatggcacttatttcacagatatctgattacaactttggtaagtgctgcggagaaggtgagggtataatgagagggtgctaatatgctgctgaatcacagaaaggagatggtggtgcttgtggctgactctaggttataccaaataagtagacgcaaagttgtacatgatcttcttgactttaagggtacttattgaaatttaagttattattttaaacacatttatattttatagacatatacttgtttatggaggtaaatacaaattgaaaggttgatgtcacaagaccagacaagagaatatttctgtaaggcaagagaaaaaatcttattctaggctagcatgttacagaggagatggaaataaattgatagaattaaaacatattaaacaaaaaagcagtaaatattcattgatggaatataagaataaacaagagatgagtgaaaagcatctaatctacttgttggcttgtgtgactatggtggatagaacacagatagctagagaaaataaggttagagatgaagatcatgagttgacttttcagcattgagactttgattacctatacgaaaagtctagatagatgtattgagtagaattttgaagtatggaactaagaaagcaagtctgaattagggatccaaatgtgggaactgtaagacagaaatttgagccatcaggatggaaaatgtacatatatgtacatttgtacgtatatgtaccatttgtacatatatggcaggaagggaagaatatctttaaacagaaaaccttgagaagtgcttatacatttatcaatccagtagaggagattaaattggcaaatacaataaattaggtatgccttagcccaaccaactccactcaatccagataatttaaactgaacatgagataactctgctaacacctgcccttgaccttgcccaaacaatgtacttagtaagtaaagaactttttttcttcatgtgcaaggctaattccaagaactgcctctctcacgccatcctggaattatccatcatctcagcaaattaaaatatttgaatacaaatgaagttcatatgagaaaatatattatttacaataatggaagccacgtttcttctgcttgagaagttctcaaaaagtacaaaacaagaaggtgaaataccaggggagtgagcaacaagtggctcgggctcagacccctggcagttacttggccagaatccctgcccctgttttcccctgccccgtatccagggtaggaaggaaataaagctctctccatcagagaagggaattacaaacatataaacaggtagggtgaaaaaaaaatgaattctgtgacattggagtgaagttgaacatatcaatattagctcagacttaggatagaagatagatgatagatgagtagatggatagatagagagagacacagagagagagagagagagagagagagaagaaagatagatggtagattttctaattctgtcagtttagagggcctagaagcaatgaaatccctgtatcaatgaacacatgcagcacccagattttagttttctaatattctccactaaagggaacaactgatctttttgagaaatagcaaattccagactgtgtatgggaagtgtatatgagtctcaaatgtcttcttgttccagaaggtagaagattgcttaaaaaatgatgggaacttattagaaggacaaaagaacctatttaaatgacttttactggtctagtatgggagaaactcatcataaaataagtaatggtagtaatgaatcataatctattgaataaaataattcattagtctaatactgacatatatatacatttatatatacgtacataaatacataagataataaaattcttccttataggagaaaggcaattagtaaatgtagaagaagaaatggaatttgaaaatcactatttggccaccatcatggtaataattgcttgagtcaagaatcatcagtggatcattctaatgggtggaagtttaaccactaacaggatatttcatggtctcaaagcctcttcccacaagatgtttataataaaaaataaaaagcagaaacttcagagcaaa

SEQ ID NO: 69 - DNA, 15788 bp, Homo sapiens
agcaaatcatggaaataagaaaatcagaatggattatttcaagcatgagaaacattttaccaacatttacatttgctatatcaacagtttctattggtaagtatgagtttgtcagtctcatatgaatcacttgtaatcttttctgacttgaagtcaattttgtctgacattagtatagccacccctgctgtcttttggttactgctatagcttcaatgtgtccccaaaagttcatgtgttggaaatttaatccccaatgcaacagtgttgagaagcagcctggcttagactatgagtagaggaaggtgttgtaagtgatcttcaactaattgaaccttagtatgaagattttaagaaacagttatatgtgacaaaataaaatctttgtcttcttattgacaggtggagagaaaaactctatgtccaattaagatcacaggagagaaatggcaggaggtagctgtgaatatgcagaaaagtagattattcaagatatatttgttcttaatgagtgtttaaaagaaatgcagacaagttaggagacaagcttaacttacaggtttctggcttgtgtaaatagatatggctttaaataaataacactttagaggaaaatgacagtccagatttgaacatgttgaatttgaaacgtttctaaaacatccaaaaggagaggaaaagtagtcaggcaaacatgtgggactattatggagataaaggtgtgtgcattcacagctcatagctgagaattaaagccattacagcatattggtttgccagatttaatgtataatgtgaggggagacaagagcttagaataaataacaagagacattaccatttttgtagagttgatataagaaaaacatgtaaagaagactgaagaccagacaaagtggtgctaggaaaaccaggaaagtgaggaaaatttgaacaatggaaataatgggctcaaataacatccaaaatgttgccaagaatcaaatggcagagtctgttaatgccaaaagctaaggccttataggagtagataaataaatcagtgggtagtgatctggaagtaggagagtaactgtcaaagagagaatggctaaaaaagagttggatgggaagaggagaaattgagagaaatattttattaatttataaatataaaacagaaattcagatttctgattagtggggaaacgagtgaatgatagggttgagaactcaagagtgaattttagcaagcagagatataacaggcactggcaacttttggcaattcttgctacattatttttggcataacacaatgcgatgcatatgcaattactgcattgtctttcctattcctagcaaaagaaaaccttgtaaattttagtgtcatgtttatcaagtgtcattatgaactagcagagtggttattgttatttttgtttttcttatttttattttggagagggtctcttaagcttgaacggtttcatgacacaagtgtaaaaaataactttagtcttgtgaatgttcttaaaagatcatattcactaccatgagctggaggaaatttgttttggtcaaacttacttaacattttgagtaaagtttgctaatcattgaatatgttataatacactttcaaatattctttatttctctgggacatttcaaagacaagggactttggtttggaattataattgtcatcggaccttttcatggttcttctattgtcaaggatttacaatagaatattacattttataatgttctgatgaaaaagtaagacaaatttaattaagagaagaggctaaacaaacttttaagtaactttaggtaacaaatgtcacagctattgagtgaggtgggaaaagaaagaaccctgtaatatgagtttaaataacacctctcagggtacttcattgatgtctctcttattcacttaaatcaagatttgtacaattgtttatgcacttactttcaaaataaaaggcatgccgctttctattgtcatagaagaattcaatttacactgtagatcttcttaacaaaataaaacaactttaacaaaagagagcccctctagagtggctgaccactctaacaattttttgaaagttgttctttgtggttatgctttctgggacatgaattccctgcaaaatattaaattcttacttccaaacttgtctatttttataaacaataaccactgtctaatctctgatattttaccatgtaatgttgaaattccccccaaaatagaaggcattgagtatttgccactcaggaacatctttagagaagaactgagccacattctcaaagacattctgattgttatcatgtgttaagaagttagaaaactatttctatttcaatgtttttgtagggcacataagaagttttgaaagtttttttgtaaaaaaagtacatgtgtattcttaattatatagtgagtacacaaatttgaagtctttgttcaaaactttagaaaacataaaaaagtcacaccaagtggtgcttattccactattatctccaatcactgatatattactttcactgaaacttttcaatacacaatatgaactcattagtccaatcaaattgcatttttaattgcttttgatttcagaatggcccaggtataataataaagaaggaaaagcaaataatgaaaaaattgactcataaatgaatctagatgatgataaaatcaaccatttttctttcagggaaatttttagatatttcacaagagatatttcataatgatgggactaatgtctctgaaaaaaatttgaaattactcacttaaaatccaagctttgagttaaatctaatgaccaggttaatggtgtcattaagaactgtaagatgtattgcattatccagcaaactactcattatactcttccaacaaacatacttttctagggattgtgatgaacgtttttttcggtaagaactaatcacatttttaatgtatttgctttttaaattgataagcaaaatttatatatatttatggcacaaaacatgatattttaatatttctccacattgtggaatggctaaatcaagctagtttacaaattcactacttcacacacttattttttatgataagaatgcttaaaatctactctcttagtaattttcaagtatacaacatattgttattaactatgggttacatgatatatttcagatttcttgaaattatttctcctacctaactgaaattttgtctcctttgaccaacatatctccagtctccccaccccccggcttctggtgaccaccatttcactgtctacttttataagctgtaaactttttttttttaataagaatttccatataaatgaagtcattcagcatttatgtgtttggtttatttcaattaatacgatgtcctccatgttcatccatgttgtcaaaaataacagaattttctattttattttaagtctgaatagtactacattgtgtatatataccacattttatttacctatttatacattaatggacacttaggtggattctatatcttgactattgtgaaaaatgttgcaacaaatgtaagagtgtagttatctcttcaacatactgatgtatggttcgaaaatatatattccattcataggtagtgtctaaactctttggattatttcccttgctgtgcagaagctttttcatttgatgtaacctcatttgtttatttttgtttttgatacgtatgcctttggggtaatatgcaagaaatcatctcccagaacagtgtcatagagtgtttcccctatgttttattctagtagttttacattttcacatcttacatttcaatcttcaatttttttttttttttttttttggcagagtctccctcttgttgcccaggctggagtgcaatggtgcatctcagctcattgtaacctctgcctcctgggttcaagtgattctcctgcctcagtctcccgagtagctgggattacaggtgcctgccaccatgcagggctaacttttttgtatttttaatagagacagcatttcaccatgtaggccaggctggtcttaaactcctgacctcaggtgatccaccctccttggtctcccaaagtgctgggcttacaggtgagccaccaaacctggcctgatttttgtatactatacgagatgagggtctaatccaatcttctgtgtaggaatatccagttttccccacaccactgattgaagagactgtcgtttttccattgtgtgtttggggtacctttgtcaaaaatcaattgactggaggcagagcaagatgactgactagaagcctccactgatcacctttttcataggaacaccaaattaaacaactattcacacaaaaaaagcgcttttacagtagcctaaaattaagtcagagatcacagtgcctggttttaacttcatatcactgaaaggggcattgaacagggtaaaaaagacagttttgaattgccaaggccaatcccccccatcctccagcagtggccatatggtgatgagagagaatttgtgtactggaggagggagagtacagtgattctgggactttgcactgggactcaatgctgccctgtcacagtggaaatcaacaccaggaagaacttagccagtgcccacagtggaagtgtatagaccagccctggccaagaggaatcagctatcccagtggtcagagcttgagttccagcaagccccaccatcattggctaaagagctttaggagtctaaataaacttgaaaggcagtcacggccacaaggactgcagttcctggacaagtcctggtgctgttctgggcttggagccagcggacccgggtggggcacatgacctagagagacaccagctggggtggccaagggagtgccttcatcatccctccccaacctcaaggagtacaacttgcagctacaaaagagagtccttacttctgcttgaggagaggagaggcaagagtaaagaagcctttgtcttgcaacttggataccagttcagccacaggagaagggggcaccagactgtgccctggggccctattccaggtcacagctcccagatgacatttctggacatactcaggtcctgaagggaaacctgtgtcttgaagggaaggaccaagtcctggaaaaattgatcacctgctgactaaaaagcccttgggccctgaataatcggcagtggtagccaggcaatactcaccatgaaccttgggtcaaactcagagatgtactggcttcaggtgtgacccagaacatttccacctccaatggctacagggagaaactgtttcctcttgagtaaagaagagggaagagtaaaggggactctgtcttgcagtttagataccagctcaatcacagaaggatagatcagtaagaaaggagaaggaagagtaaaggggactttgtcttgtagtttagataccagctcaaccacagaagggtagatcagtaagcaagctcttggcatccctgattccaggatttggctcttggatggcatttctagatctgccctgggccagacgggagttcactgacctaaagagagagtcccaagcctggaaacattcaccaaaagctgactgaagtgcccttgggcctttagtaaatattacaggtagccagcaatacttgccatgggcctgttgtggtggaggtcatggggagaggctcctctgcttgtgaaaaggggaggaaagagtggaagagactttgtctttagacttgggtgccaggtgaactgcagtagaaatagaccaccaagtagattcctgaggtttcagactccaggcactggctctaggatggcatctcagtgttgggggtaaattgctgctctgaagggaaggacactagctaagctggcttcaccttcttctgattgtagtgccctacagccttgagaaaacataggcagtggccagccagtgactactgtgggccttgggagagacccagtgttgtgctggctgcaggtctgtctcagaagtcccagtgctagtgacctcaagggtgcttgtttacccctcctccagcaccaaacagctcagaacagagacacattccatttgtttcagagaaagtaaggaaagcaaatgagagttatctgcatggaaaaccagataattcttgcagatcttatccaagaccaccaaggcagtaccactacaagtctgaaagagccacagtgttactgggcctaagaagctccctattatagagatagctgcagtgaccaaaaacttaggtcacagcacccacgtctttttaaatacctgcaaagccttccccaggaggacaacaagcccaaactgttaggactacaataaatacctaactcttcaatgctcagatgccagtgaacatctacatgcatcaaggcatccaggaaaacatgaatttaccaaatgaaataaataaggtactagtgatcaatcctagagagacagaaataagtgacctttcagacagagaatgcaaaattgttgttttgagaaaactcaatgaaattcaagataacaaagagaaggaattcacgatcctatcacaaacgtttaagaaagagattcaaataaataaaaagaatcaagcagaaattctggagttgataagtgcaattgacatactaaagaatgcatcagagtctcttatcagaaaaattgatagagcagaagaaagaattattgagcatgaagacaggccatttgaaaatacacagtcacaaaagacaaaaaattatggactatgaaagaataaagcatgcctacaagatctagaaaatagcctcaaaagggcaaatctaatggttattggacttaaagaggagatagagggagagagaaagaaagtttaattaaagggataataacagagaactttgaaacctagaaaaagatatcaataaccaagaacaagaaggttacagaaaactaagaagattaacccaaataagactatctcaagatgtagtcaaacactcaaaggtcaaggataaagaaagaattgtataagcagcaagagaaaatgaacaaataacatacaatggaactccaattatgtctggcagcagactttcagtgtaaaccatataggctgtcagagagtggcatgacatatttaaaggccgaaggggaaaaaaaaacatttattctagaataatgtatctggcaaaaaaaatgtccttcaaacttgatggagaaataaagactttctcagacaaacaatagctgacggattttatcagcactagacctgtcctacaagaaatggtgaaggtgcttcttcagtttgaaatagaaagatgttaatgagcataagaaatcatctgaaggtacaaactcactggtgatagtgagtagacagaaaaatagaatattttaatactatgattaccatgtaatctacttatattttgagtatgaagactaaaagatgagcatatcaaaaataataactacaacaacattaaaagtcagagacagtacataagatacaaatagagacaataaaaaaatttaaaagctggggaataaattgtagggttttggtaagcatactccttgcatgtttgttggtttgtttgtgtatgcagtgttaaattgttatcagtttgaaataatgggttttaaggtattatttgtaaggcttatgcttttctcaagtaaaaaaaatacaagagattacacacacacaaaaagcaagaaattaaaacaaagcactagagaaaattactttcactaaaagaaagacaggaaggaaggaaagaagtaagagaagatcacaaaacaaccagaaatcaaacaacaaaatggaaagagtaagtctccttattaatgctggcattgaatgtaaagggactatactcttcaatcaaatgatacagaatggctgattggagaaaaaataataataataattacatgattcaaggatctgttgcctacaagaagcaaatgttacctataaagatctgcataggctgaaaataatgggatggaaaaaggtatttcatgcaaagaaaactaaaaggagcaggagtagctatattcatataagacaaaatagatttcaaaattagaagtataaaaagggacaaagaagaccattatataatgataaaagggaaaattcagcaagagtttatgacaattgtaaatatgtatgctccccaacactggaacacacagatatattaaacaaatattactagagctaaagagagaggtagactccaatacaataataactggagacatcaacaccccactttcagcattagatagattgtccagatagaaaatccacaaagaaacaagttttcttctgcactattgaccaaatggacttaatagatatttacagaatatttcattcaactgctgcagaaaacacattttactccttagcacttggatcattctcaaagattgaccatatgttagaccacaaaacaagtcttaaaacatttaaaaaattgaagtaatatcaaatatctttgaccacaatgaaataaacagatcaatatcaagataaatttggaaaactatacaaacacatagaaattaaacaaaatgctatgaatgatcagtgggttaatgaaggaattatgaaggaaattttgaaatgtcttaaaacaatgataaagaaaaaaaaactacccaaaactatagaatacagtgaaagcaatactaagaggacagtttactgctttaacacctatttcaaaaaacgagaaaaacttcaaataaacaacctaatgatgcatcttatagaattagtaaagcaagaggaaacaaaatccaaaattagtaaaagaaaagaagtaataaagattaaagcagaaataaataaaattgaaatgaagaaaacaatacgaaagatcaatgaaagtaaaagataaaaaatagacaaaactttagccagaatatctaagaaaaaagagagaagacccaaataaataaaatcagagatgaaaaaggagacattacagttaatgctgcagaaattaaaaggatcattagtggctactttgagcaactatattctatgaattggaaaacgtagaagaaatggataaatttttagatacatacaacctaccaaagttgaaccatgaagaaatccaaaacctgaacaggccaatcataagtaactagattgaatctgtaataaaatgtctcctagcatagaaaaacctggaacctggtggcttgaccattgaattttactaaacattcaattaaaaaccaataccgtttctacccaaactattccaaaaatagaggagagaatacttccaaacccactctatgaggctagtgttatactgatacctaaactaaaccagaaaaaggcacatcaaaaaatccacaaaactacaggaaattaaatattattgatgaacattgatgcaaaaaccctcaacaaaatacagtagtggaaaccaaattcaacaacacataaaaaggtaattcatcatgagatttatcctgggaatgcaagaatgcttcaacacctgcaaatcaatcaatgctatacatcatatgaacagaatgaagtacaaaaattatacgatcattttaattgatgctggaaaagcatttgataaaatttagaatttcctcatgataaaaaccttaagaaaacttagtatagaaggaacatacctcaacgcaaggaaatcctgtatgacaaacccatcgttagtttcatactgaatgaagaaaaactgaaaggctttcctctcagatctggagcatggcaaggatgccccctttcacaactgttattcagaatattactggaagtcctaactaaaacaatcagacaagagacagaaataaaggacatccaattggaaaagaagaagtcaaattaacatttgcagatgatcttacctcatctttggaaaaagctaaagactccaccaaaaaactattagaactgataaacaaattcagtaaagtagtaggatacaaaaccaacttacaaaaattagtagtatttctatatgccaacagtaaaaaatctgaaaaagaaatttaaaaataatccaatttataatagctacaaataaaactcaacaccaaggaattaaccaaagaagtgaaaagtctctacaatgacaaccataaatattgttgcaagtaattgaagaggacacaaaaaatgaaaagatattctatgttcatgggttggaagaattaatattggtaaaatgtttatgctaccaaagcaatctacagattcgatacaaactctatcaaaacatcagtgacattcatcccagaaatagaaaaaaaattctaaactttatatgtcaccacgaaaagatagacaaactatcctgagcaaaagaacaaaactggaggaatcacattacctgacttcaaattatactacagagctatagtaactgaaacatcacacagcagtggcataaaaacgtacacatcaacaaatggaacagaatagagaacccagaatcaaattcatgcatctacaataaactcattttttacaatggtgccaaaaaacatatatcggggaaaggatagtcttttcaataaatggtgctggggaaactggaaatccatgtccagaagaatgaaactagacctctactaattgccatatacaaaaatcaaatcaaaatgaattaaatatttaaatacaagacctcaaactatgaaactactaagaggaaagcatcagggaaactgtccaggaaacggaactggtcaaagatttcttgagtgataagccacaagcatattggacaaatgggatcacatcaatttaaaaagcttctgggctgggtccagtggctcacgcctgtaatcccaacacttcgggaggccagggcaggtggatcacctgagtcaggagttcgagaccagcctggccaacatgatgaaaccctgtctctacttaaaaaagaaaaaaaaaatacaaaaattagtcaggcattgtggtggtcacctgtaatcccgctacttaggaggctgaggcaggagaatcacttgaacccgtgaggcggaggttgcagtgaaccaagatcacaccattgaactccagcctgggctacaagagtgaaattcgtctcaaaaaaaaaaaaaaaaaaaaaaaaaaaagcttctgtacagcaaagggaacaatcagctaaatgaagaggcaacccacagaatgagagaaaagtttgctaagtaaatattaccagtaaaaaattataattatgcattctctcacacattgtgaataacatccaattacaaaacatgcacaaaaatatattttgttctgtttaaatgtatttgttaacatactaaataaaatacatgaacaaaatatatttaaatatatatttactaataacatagagatacttaaatgattttatatctattgaaaacaaatttgagtttttttatttaattaaactaatactggtttctttgattatagaaacaatttatgcctttcataaagattcaatgtaacaaaatatatgaggaataattaaaattatttttgtaagctactaattgcctaatttttaatgagtattcttatacatatctttctttgcacacacatacacacatatgcatatgtaaaaatccttgcaattttgtttacaatgggattttaatatgaatattttatattcttttcacctgctgtcgatatgatgtgaaaattgtaccaagttgatatgttcagataaaaactattatttttaacaattgccttgttacctattattttaatgttagtgtttacatataaaacaatctatttaagcagtctacaactgttggacttatggattttccacatcttttcactattattagaacaacaaaaataaatattctaactttgatttcttttctgataactattttagaatatacagctataaaacaaggtatatatagttctgattcattactaagcataagtttttatataaagctttatgttttattttataattttatattacaggtgctcattattccaggagtaattcagtagattgtatgctggctttgaaattattgtatctttgacaattatttgttttcaatttctaattttattatgagatcataaccattccattgccaaataacagactgacttttgtaaattttcatggatataagaactatgtatgttctttaattacaacacacaaaataatataaacttccctttaaataaatttgtcgattatttaaatcctctgtttctttgctcatgtactacattgtcgcttaatccaataattactaaaatagtaaacacacagataaatattttgatgttgtatattacgggggaaaagctaaaactgaattgtgatatatactatgcaaatttatggaggcaaattttaaaggtgtttgtactatatgatcctatttttaattcatatccaaaagtgaataagatagaaaacttacgtacaggctgacaacctggaacatatggaaaatatcacctttcccctgcttctgagtacataacgatttagcagagtattgatgagcacatgcatgtaaggaaacctcctgaggctgagaaaagaccatctgaaagcattagagagaatggtactcagtgttcacacagggctggaaatagtgtctgtttttaccaattagactgacaaacctcgtaattcaagcggtagtagacggagatttcagatgggtctcgccttaattgtggagaataatgagccctttggttccaccaaacacaagaccctgaatgatcacattttccaagttacttaatgtatccagaataaagatcatgaaaaagaaaatcaccaaccaaaaaactgaaatttgcaatatctggaattccatgaaagattaccaggcatgaaagaaggaggaagtatgaccttaagaaaaataaaaatcaatttaatgaatccagcccagagctgatatggatgttataattagtacacaaaaaattccacgtatcttgttatcttttgaacagaagaaatacagaacttccaggtatctctttatcttttaaacagaagaaatacagttgttataactgtaactatataattatgtaatttattctgttcaaaagataaagagatacatggaagtttttttttaagaccaaacccagactactgtagtatgaaaactacagttactaagctgaaaatatactagatgtgattagtagcagattaggcagcagacaaaaggattattgaacttggtaagtgaaccaataatttccacctaggtttacacctctccttttaatatgttcactaaaagacatatacatacatatatgctccgagaagctgtatttatatctcaaaaatggacaaaacccaatgtccataaatattaaagtgaatcaataaatcatggtacatctatacaatggagtaatatgcataaatgaaagttaacaaaaatatccatctatcaaaagaatccaggcccaaaacaatacatactgtatgattctatttacatgacatttaaaacaggtatggtggtagaaatcagggtaatgtgtacctttgggtggagagttgcttagagagggcatacatgagcatctggtgtgctggataaaccatatttcttgataaaattggtggttgcaagagtgtgatcactgtgataattcatggagctgtatgttaatgctgttagtacctctgtgtgcctgtgttataattcaataaaataaatagactggaaaaatcaaaggcagaccagacatacatacacatacacacaaaagatgagcaaagcaaaagacacatgatatcaagacaattgagattataacatggttgggcaatgataagcaattctgatgaagctggattccaggatatttttggagggggaagagaggtagaaaagcctgtgtattagctaaaagtgagaagtaaaagactatgctagcagcaggaattgcaggacctctttaatttctcattgatcttttgtttggattatctagaggacactcaataggtagttctagattttttaatatcatttaaaatttttctcatcctgcagaaatagaaaacttactcctaggctaagcatattgaaacaatctatgacaatcaacttagtgacatttctctaaagtttttatttcaccagtcatatttttatttttgaatcatgttttcatactatgcatcattcatgtctttctgtgcattcatattttacataaaaaattaaataccatgcttcatatcaacattcctatggaagtgtcagtgttatttaaagtcattcagtgtcatatttaatttgctagattaagaaagatgatcgttaacttttgacaggccagaatttttggaaagaaattgtctggctttaagcaactaattaaattaacaactacatcattctacatacattttaggaacatatctgctgtcagcagttttctttgcattgcatttgcccaatttattatagtttccagtgtaatgtaaattgactgacaactctattctctttccaaggctctaataccaatgcttgaccctaaagtttccaacatttcaggctctttgtttgtatcttcagaacctttctggtgagtcttctgctagcctttcctctgtgaaagaagaaattttgagtcattttccttgaacaattattagaagttatacttttctttttttgccccaaaacagaaattaatgttaatgatgttgatgacattgaattgattaatctaattaattccttcaaaggctgcttgccattatttttcaatccattattagtgagcaaatgtcaccacaaattgttattaaagaatgtatttacaacatattattatacatttatcacttaccaccacaacactggcaaacacagtcacaaacatacacaaacactcacacacacacataatttataatagcaccagtttaaatctacacaagaatattctaaaacattctccattagcatgaaatatacctttatattttgtttaaaggagtatttctggagagcataactgtaccttctgtttagataactacacaaaatttttaatgcccaaggtattattttgatactttgtactgggaataaataatgaaaacataaaagaaaaggaactgaatttttatatataactaataatcagcatttattgaatgttcttcgtgttatatataactaatgattagtttctattgaatgtcctttatgttatatatttcatgttacttagggtggcacttctaggaattttgatactgacagcagcttcgaacatgacaaagatgtgactgaggtaccggtacgtcctgtggaattaccgtctgagctggtgttgctatcaaacctgcattgcttaccacggtgatatctctcttctaaaaaagaaaagagagagagaaacagatgaattccccagaaacttctttttagctgtagactaatcacctgcttgatcccaaaatgtgagacgagttccatttcccatcgcttgtcctgcttccctccattaaaaatagtaggtatttgagctaacttctctcagcacatcattttcacaacttctctgtaaaatgggaatgatttccctggtgactttgtaaattgtgttttattgtttatttctatttatgtcaaagaaagataatgtgaaattgtcaaaacttgctaaatgtaatatacaaataaatgttggtaattaa

SEQ ID NO: 70 - DNA, 1286 bp, Homo sapiens
tttagaagagagatatcaccgtggtaagcaatgcaggtttgatagcaacaccagctcagacggtaattccacaggacgtaccggtacctcagtcacatctttgtcatgttcgaagctgctgtcagtatcaaaattcctagaagtgccaccctaagtaacatgaaatatataacataaaggacattcaatagaaactaatcattagttatatataacacgaagaacattcaataaatgctgattattagttatatataaaaattcagttccttttcttttatgttttcattatttattcccagtacaaagtatcaaaataataccttgggcattaaaaattttgtgtagttatctaaacagaaggtacagttatgctctccagaaatactcctttaaacaaaatataaaggtatatttcatgctaatggagaatgttttagaatattcttgtgtagatttaaactggtgctattataaattatgtgtgtgtgtgagtgtttgtgtatgtttgtgactgtgtttgccagtgttgtggtggtaagtgataaatgtataataatatgttgtaaatacattctttaataacaatttgtggtgacatttgctcactaataatggattgaaaaataatggcaagcagcctttgaaggaattaattagattaatcaattcaatgtcatcaacatcattaacattaatttctgttttggggcaaaaaaagaaaagtataacttctaataattgttcaaggaaaatgactcaaaatttcttctttcacagaggaaaggctagcagaagactcaccagaaaggttctgaagatacaaacaaagagcctgaaatgttggaaactttagggtcaagcattggtattagagccttggaaagagaatagagttgtcagtcaatttacattacactggaaactataataaattgggcaaatgcaatgcaaagaaaactgctgacagcagatatgttcctaaaatgtatgtagaatgatgtagttgttaatttaattagttgcttaaagccagacaatttctttccaaaaattctggcctgtcaaaagttaacgatcatctttcttaatctagcaaattaaatatgacactgaatgactttaaataacactgacacttccataggaatgttgatatgaagcatggtatttaattttttatgtaaaatatgaatgcacagaaagacatgaatgatgcatagtatgaaaacatgattcaaaaataaaaatatgactggtgaaataaaaactttagagaaatgtca

SEQ ID NO: 71 - DNA, 27055 bp, Homo sapiens
aaggcactctggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctaattggggtgagtaagagattttgttatgtatataatagctaagaatatagtaataatggcttaaatcatggttatttttaaactactaacatttagaagacaaaataaaaatgctttgaaaagtatagaggttttagtgtaattagcagggaataatgaaatgatttgatagggctactcagttttgtataactttggtgctttaagtctgaatgcagagcatggatgttgtgatccagcctttatatgttttccctgaagaagatttaatttatttggccttttgagaaacacatttggcattgtaatatgttttgcttccaggttctatctccaaggataatttgacaaaatcacacataaatttattttcagggcacacagtttcccttttagggaactcacagaggtagagagtaatacaataatcacatttgaatattcagtaagtgaggtcctcatagatcttatgtgtatgtcaccatgtatataattttgttaatcactagatgtatgagacaagaaatttgaggaaccttaactagagattaaaatagggatttaaatcaaagaaacatttaaatgcctcctttattatttaaatacctgcatggtgaatcattgaaaaaaaaataaaaagcatacaacttgggaatattctaaaccaagaagaatttgttattctggttgatttttttttttcaggctcccacaggcaacttacctttatctctttgtgatttttatttcttgttaaaatatacagaaatagttaagcagattcatagagctgaatgataaaattgtactacgagatgcactgggactcaacgtgaccttatcaagtgaggtgagccattcattaattcagataatggaacttattatcataatcttttgcttatgctattgttgagcttaactacttattcatatttgcatatgcatattgagataatatcatttcattaatttcagtactgaacactaatctcctaagagtaattgtgaaagtttcagattgcactatttttaactatatatctgtatgttatcttcatatatgcttgaataacttataagcaattgaaactttcaattacagtatactattgaagcaaatcaactaatatatacacatatccattagcaatagtagataatttttgtaaatgtccagcacagttcttcatatgtagaggatgttcaaattggctaagttccttttctctcttaattattagtatttttcctactgctctttgtataattattccttcctctttagctccaatccttacaatctattcttaacatagcaactggaagaaagtttttaaacataaaccagatgatgtcactccaccccacaaaacttccactattctctgtcacacatagaaagaaagaaaaaaaatattgaaaacctacaaagacttgctatgatctggtccaggctctccctaaaatttcatgtaatttccagccactaggcctttctggctctccttcaatctcattagccttttcactactacaagttagactgggttttggccgaggtatttctttttttcatattttgcctttgcctagattgctcttccaatagatattcacaattgcatcatcatttctatatacgtgctaaaaggtttccttgtccaaaatagcttcagtgaccacctgatctagaatagtctcgatcaaaagtttcttttccttttcctcaccacttgatatttatatcaaacatttatttgtgtaatttatgtgtttgtttgttttctgtactagcattatgatgaccatactatttgatgccccccaaaaaatactttcgagaatgacagggaaagctaaaataattaaattatataattttgacataggcactattgacaaaaagcaattgatgttatgatagtgttagatctatgaaatagtactatttaaaagtaattctctgaaatacaattttctaaaactaaaagcagcatatgtacatgaaacaccaaaaaacttccttatatttatcactggaagatttaaaatagtataagtagtaacttatttaatatatttttgattatttaattaattttatagtatccaactctaatataatgccagtggtatttgttcaaaatattttaatgttgtctatttatttttaatttgcctaaaaattatcttaaatgaaaatttttggttaataaatttgaaaatactgaaaccctcatctcagtctctgtggatcctaaagtttttagttgagaaaataatttttctctagagaatgaagtagcttgtaagcttggagaaatttctgctaaataaatgatattatcaactctattttcttcaatacgaaatatataaatatttcagctcatatatttttgcaggtgctatgcttttgcttccaatcataatttctgacaaatattttggaagtcaaaacttgtcttctattttgttatttaaaattatatagactacttttgtaaacctttatactatcaaatcataggcaatttcagtttgatttcattctggtgcagaatataagtttatccaagtaaaactggagtcacttcaaaagattcctcccactgactgagatattccaaagccaactttgcaaaatttcagaattaaatattatacttctttgtaccttcattttatttgttcaatttttctttgtgtttgtagaaaattttaatatttttctgttttcaagttttgattttaatttactactttataatttttaaaggtaagttttgtgaggctatattcattatgtgttttgaataaagacatacaattaattttgagaactgcaataaaaattataagactattaaaaatgcagtaagtgtactacacttaggctgctaaaaatgcagtatcagtagactacatttaggctgcttaaagttagttcttctaagtaccatatactttaaaattttagctaatgatggagaacaaagacagaaagactgtgttaccatattctagttggccattttgttttgttttgagagacgtcacatcagccttatcataaaaattatttggttttaccattttgactgtgagcaaaatatacagcataatatacaaaataaaatatatgtacatcttcacaacttcttgtttaggatgcaattatatatatatatatatatatatttattattatactttaagttctagggtacatgtgcaccacgtgcaggtttgttacatatgtatacatgtgccatgttggtgtgctgcacccattaactcgtcatttacattaggtgtatctcctaatgctatccctcccctctctccccaccccacaacaagccccggtgtgtgatgttccccttcctgtgtccatgtgttctcattgttcaattcccacctatgagtgagaacacgcagtgtttgcttttttgtccttgcaatagtttgctgagaatgatggtttccagcttcatccatgtccctacaaaggacatgaactcatcattttttatggctgcatagtattccatggtgtatatgtgccacattttcttaatccagtctgtcattgttgttggacatttgggttgcaattttgagtttcatgtgtagcatgtatagcacaaccaattaagatttctttctttctctctttttttttttttttttttgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggccaacatttcttaacctagtagtttagtttttatagttttattaccgcagtgaacgctacaccaaaaatttcatttgaattattaacataaaaagaaataattttgtattaaacttttaaactgaattttcaatagcattcacaatcatattaaatgtttcaccttttacagaataaacttccatgagctttatttgttaacatttattgatacacacaattaataaagcatgtaagtaataaactgaaattacttaactggttgagaaattttttttttgctaggagaaccaacacattaagagcagtatcttcaattttcatacatgaacaagaaaacttcgaagcaaaaatgaatatatttaatttagaacaatgatttttatttgaaaagtcacattgcacagagtgatatataaatgaattttctgaagatatatgtgttaaatcagggctttcaggcacagtctgcttaaaactttggaaagagatactattttttttcagtgcatttgtatcttctaattttctcatagtaatatcacagggtccccataggtgatgctgaatatgggcaactggttttttttgtttttttttttttacctgttgtcttagcattccctaaaacaggggtcaccaaatcccaggccacctagtggttctggtccatggcctgttaggaacgaggccacacagcaggaggtgaacggcaggtgagcaagaattaccacctgagctccacctcctgtcagatcagtggtgacattagattttcatgagtgtgaatcctactgtgaactgtgcatgtgagagatctaagttacacgttccttatgagaatctaatgcctgatgatctgaggtggaacagtttcatcctgaaaccatccgcctgccctgtccatggaaaaatcgttttccacaaaaccagttccttctgccaaaaaggttggggactgttgccctaaaacacaaaccctaggcaaaatttttacagtaactattttattgattgtgcaacccaagaaattcttgaggttgggaagaggatgagaagttagtaggggaaggagggacaacaaatataaggagtggcattgttagacaggtcagaactttgagacaattgctctgtctagtgagccatcttcaaaggggttgcttctctgactgtttaccttgggagaagcagggagaaaaataatatctaaataatatctaaataacactgaaggcttgtctcatgccttcagtgttcaccccagacagcattaattactgcagcatcttatacttcagcagtattcaggaacccagggaaagaaaaggaaggacttccaatgtaggttgaaagtgaggcacccatagggcatatccagcaaggttttcagtctgttgaaatgagagtgggcacagaatgggaatattaccagccactgagtgccacccaatttagaaagcaaagcaagtgtgcagagatgggtaatgcataatctgaatttggtacaatccattcatagtgcaggtcagatctgctcacactgtactacgatattcaattctcaccttcgattcttccctgagaagaagcataaaaatttaatctttaagtattattgttaactgctgcctccttaaacaaacagcacacagacaactttatattatgttatccaatgaagttacagctggccaccttcagctataattttgggtcttgctgaatggggtgatccagaccttggatttaggggttattattcctaagttactttgagcttctggacatgtgttctatgcggttaacatttttttattatcactgaatacaaaagcaccaagacatatcccagtgaatctactgggttccagacatatttctttttgccctcactatgtagtagcaactatagcttctcatgattatcaagatcgatgactcccactagtacattccatctgcaccaggattaggagctcaaggtagttcatacatttcttctccacttggaaaataacatctctaaactagcaaagtctaaggcagggtggaaagcactatattttgagcatgggaatatgttaaaaataactgggaataatggcaagcaggggatcccacttctactccttacctcccagacctatgcttcagtgcatatagtgtacactagaagacaacaccctgggattttttctctgagctggctccttaactgagtcttcattctatcagtgtagtagaatactagtagtaagccccacgaatcttgtgattacctatgcatcaacatacctcctttgtgataaagcaggctccttgttctaaagcaatcccacatgaaatgctctgttgagatatcaggcattttttaagcccttaaatgatggtgttgattgaaaaactgtgcaaaaaaaggcaaactcatatccagaatgtgcatttgttctgataaggacaatccttattccctttctggtggaaggggtcttatttcatagctctgtcaccaagaggctgcttaaactcccgaaaagtagtgtcacatggaagactctgcaatggatatgcactgctctcagactggacattcagcaatggtagcaatagatcagccttggtgaagacgaatacatgaatacatgtcattagcctcatgcatagccttaatccttctgctatgaccaccctggtcatgtgctcattgtgcaagcattgcaatagtcatcctgtctaccttgttgaagagatgctccctggagatgggttctctctggtagaaattaatactagttacacttatctgcatgtgttgtgcccactcctataggatcttccatatacttccttcccagagttctttagccccgacttattagtctttttcatttgaggactctgaccattgagtctggccactgccacaacccaggaatcaacatattatctgtaccttttgtcatctcccatttcatgcaaaatgaatgactgagttgactgcttaaaactctgctcaccaggagaagttccctttgttgctgtctctaaggccaaccctgagtggggctgaaatgtggtagtggtctacttcaagtttgcaccaacattttgggctgtctcttctgttaatcagatcagtttcttcccttctttgatgttgcacacgaggaacttcctgttgcacattttgccttctatgattgaatgtcatttactaatttataatatttattgcttttcccttctatgattgtatgtcatttgcttatttataatatttattgcttttccctttaaaacataatgtaagctctatgagggttactttttcaattttttattaactgataggtcttgcttgcctaaaaggacctggcatatagtgctgcatacattcaataaatgtttggtaaaagaaagaataaatgaactctctctatctcctttccctgcttcaattttgttcatagtatgattcactatgcaacattatacattataatatgtttttttttcagtctttccctcctccactaaaatataaaacacacaagaggttgtctgctttgtttaaagcattatccccaacacctatagaagagcctgctttgacaaatactttttgcattaattagcaaatagacaaggtttttctcattccctgtcaccaggtaacacctaatgccctgtaggttatataacaggcgctcagtgaaaaagttgtgatacaaaataaatgcaccaaaattttgcctctggcccagaggtggcctctctcaatactactctgatctttcagaagtagaattgacaagaactaacaagataactttgcctccttaaacttgttcctcaggaagtttcaaaggaaaattcaaataatttatcaaccaaaaaagactagaaattctcattttttttacacacatagcttttattttgaatcctgtcgatttatagtgtaaggcttccgtgattcctattaccttatttcattgggaaaaagaaacaaaacaaaacagaaaaaactggaagccaatatcttctgaagtgatgtgggaagctaggaggctcctttgttacctttacttcacctcacatgtataaagaattccattcttaaaggacatcacattttttaaaacactgttgtattttattatatgcatatctggaatagaaaatctgacaagagggcagccctgaacaattttccctatcattacgtagaagatgaatatggagttaattttcacttttgacacattatattgagattttaaaattcattctgtctaagttgggtttggaagaagtctaatctcacagtttcatttgaggacagctctatgaatatttgtgaaaaatgaatattttatttgccttgaaaactatgattcaatttgatgaaatgaaaaaaatttatggataatgtttaatcacgactgtcatataagagctaagctgtcagcaggatgctatgacacctagagttagttacttccagctgagagaggatccacacagcctctaatagcttaggaagctgtgacttgatattctggctcatttaatagattcattgtgcttcatgttctatatgaaattctgtttgaaaccagcctaaatatgttttaatgtttaatgtcattatattctttatacatctactttttaaaatgaatgcagaaatatttttccaaaatttaaaaaggcattaattgacatgaacatcatttttatcatgaagcttaaagagatggtttgttaagttaatcaatatgtgatcactatgataatgttatatactcagtcttttgctgggaactatagagttatcaacaatatatggttcatgtcctctactcctgaggaattcctaagtggagagagaaaaactatgtaaccctacagtgtaatgtatggaacatacttacttgtgaatgtatgtggcaaagactaggaacagtagcactgattttaagtacaataattaaataaaagtgattattttgcttttttttctccttaatgtctaggaacttttggtattcttcccttccatttattaagctacatgctcattatttccttgtttcttagcaatagccagactttaatccaattggtcatttactactttcaattcaatgtgattcttttactcttctcctactcaatatttttcaatattttgacaaaaatttagacaatatgcctattaactttgtagatgctacaaaacacagtaatttttacattttataacaaaaatcaaatttaaaaatgaacaagcagtttgcagagatttaaatagcaaatgcacatttaacaagtataagagtaagtttggtacttggttacaaaataccaatttcacatgtaaataaaggattttttaacaatagcattgtgaaaaagaattgaacctgagacctcatattcagtttaagactatgtgatattttgtccaagaaaaaaataaatatgttatgcaaatggaaactgagtgtttagaataccgaggaagataattctgttctactatagactgcatacgttatacctgaattcttatgtttggatatggactccctactttcaaaacacaggaatatagtattattcatttagaggctcgatattattattataaaatgcatggttgaagaaaatataagtatacaggttgaaaaagaaaattagaaaacactctaagcactgaactacaattttagacctgaataaggaaaacttttttcaagagccagaaatattcaaaaactgagttggctactggaagaaaatactaatgtagtggtcttggggttttcaaacatgcaccagaaaaccaaatactagatctgtattgtagaagagatttgggcaatgtttagttagttgaaataaatgtccttaagtatgaaattcagtgagtctatcatatcttttatacatatacatatgtatcttttaattgcccccaaccaacaataaatatgtcagttctcatatcaaaactgcaatcacttcttcatctatttgctttttattatttttgcataacatttttaaactgtggttttcaaaactatagttacagggtagaacactaatacacttctctcttccaaaaccccctttgtaatttattatgtgaagtttgttttccttataatacacagtctttgaaacttagtttccacacttatttatttatattaacacttgagtcatgctaactctctaatcactggtattcaaacccaaaatttaaattgttgcttttcttagcctatttcacctccccaagtcctctgtctctatattcaaccacccttcaagacctatcttcaattgtataatttccagaaagactttggggatactgacactaaatttttttctcatttttgaatctctaccatgcttaataaaacattattaccacgctatttactttcatgtgcagatccttgagtaaaaaattatccctgaacttcatgtccagagacctgggttctacttatgactgtacttccatttagctgtgtagcctcaataaagcattgaaactttctgtatgacaggaactttatccatacaatgcagatatatttcaattataataaatattgaatgaatctttttgcctcaggatcattcttatattgttgacttgtttaattattataatataaattcatcatgagaagagtggtcttccattgccttgtttccccataatacttatcatttaactattcacaaaatgtccacttgcatactttcaataagcacaaggtcaaataaatttaaaactaacaagtattttatagtttcattcactctttttatttgctgacactttgatatattttcattcctcaaaataatttcagtatcttgacttttaaatattttttcaggatattaatgagatgtctcaatcttaaatattgttttccttataaatgctgtgtaaagaatatattttatgcatcttaaaattatccttacagtataaacaaaggtttatttccctaaacttatgaccaaactgagcaaataagagaaatgcaatgcactattttgctcattgatcacatgaattgtctccagctttgaatctctgtcctcatttattttttatttttacttatttacttttgagacagggtctgtgggtcttgctgtcacccaggatggagtgcagtggcacgatcatagctcactgcagcctcaaattcctgggttcaagtgatccttctgccttggcctcagagtagctggcacatgggaccacagacacacaccaccactccctgctgattttttttttatttgtttgatttttagtaagagacaagttctcactatgttgatcaggctgatctcaaacccattagctgaagcaatcctcctgcctcagcctccaggtgctgggattacaggcatgagccactgcacccagcctggccttactttttaattcagaaattaaatacaccactttgaaacaagataatatatcaacctctagtaacagatttcttctgaaaaggtgttcctaacaaaacctggaaatgaccataccctggcacctgctgaggggctctgcctgtcaatggcatggcttcaactggaagtcaatgataacagatatgtcattatccctatgtgatatccaggatctaaccctgtccattctagttgcttctgatgttccaccttagaataattgaattctaatggataatgaccaattacttttcactcattagtttgagaagtggtgtcctcactcacatgaaacggagagcttgcatgcttatgttcaataaactaacaggcatggctaccagtcaccactactaaggaggagtctttgtcaaattagaagtactatttcagggatttgtgcatgtagattcactgttgaaagaaaatgatctattgtcattccagacatcccatcttgcttctgcataatattttcagactacagaaaagaataaagagaagatagatctctttagtgtgttgttcttttacagctgcccaatgctaaagcagatttcaaaagttgcaggctatccttttttttcccaaacataattagagcacttagccaaacatgtatgcatattgtagctgttgactattgccgaaaacacaaaatttcagaggcacaaaatttcattggcatacaaaataaacatttgctttttatccatccatggtcaactgggacagctcattcaaatcccactcttggaatggtgccacaattccactggatggctctactttcaggtctgagtccacctgagcttggttagggaggcttggcttcacgtaagttcattattcctgaagggatagcagctaccccagggtatcttttctcacaacgataacagagcaagagggaagaatgagatgtctttgaaggcttagactaaaaactggtgcactttcacttccagcaatattttttgtttaaaaagaaatcaaatcaaacagcagtgaagtaaagggacaggaacatgtactccaactttagtgggaggaagttaaagtgtgtgtatatggtgtttcttaaagtttaaagatccttttgataaaaacaacaaatcataaaaacactctagtagatgaaagacagaattcttttactgacaactccaaatttttcaggcagggccacctagggagttgcatccagagaaagggtaacagcaagctgaagctatggtggggcaatttatataacaagtagagtggattcaactagcttcccaggatccttgtgcattggctaacttgaacaatttctcaggctccagggcttagggagtgtgtctagttgcctgatacctggccctggggcaactgaggagcctacatagtggccaagagtttgaaagctcaataaggggagtgattggcttggggagtggacttaatcagctgccaagaagggaaactgactaccctctagcctgggcctcaaaactgggtccagacagtgattaaacaacagcagaaactgttacaatctaccgcttaaagtcttgacatcagttttgagcttatttggcatatttcaatggccaaatagtagcaaagactttcacagagtagagtataaattgtccaaagagcatagaagacattttattatgggagtaaataggagaaaaacatatagaagaataaagagtccttgtaggccagtccatcaccaagatctccattttatggcattactaagaaaacagagctggaatttctggggtccctaacaagatcttggtggagttgtaaaatgttttaaaagtaccaattatgtggttttatgataataatatcttgatgtatccttgggtcaaggtggtagttccagtagttaccttgtagagggtatacagttagtaaagcatatgtaaaggttagtgatatttgtttgaaaccaagtgaagaggtggttgtggtcatgttcagaaatgcagagtgggaggtcgtggtggtgagttgaagtgggaagagtagggagaaggcactgggaaatgggaagttcactccccaagggagtcaatgggtggactgatatgaggtagtttcctttctggggaaagtagtaatcttctttaatgtttagaaaggcacagatgctagtaactgctacaagttcttccttaaggcataggagtttaggagtgtatgtttttacagagagccatgagtacacacagaggtcagatatatgtaactttcaaaatagccaagggaattgggaacaatatttaaaattagtgttacatatgttgggccttgaattaaaaaattaaattatggggcaagatacagatgcatttaggaattcatttgtcattttgtaacttatataggagttctttgataggcccatttaggtctcccaattaaattagctgtctgggacctatcccagagagaaaagttccattgaatgccttttgtaagagcccactattgtgtattctgaaatgtgaaatgtgtggcttagtcactgtcagtaatgtctgacacgtcaaagggaataagaagtatcccaggaagactctgtattgtggccttagtataaatagcaacatgtgtaaccttgatatatattttggatacttgtgaagcaagagattctcaaagttctttactctgaaggggacaactctcaggcaatgtttcaaaagtttgcaaaaatgtggagatggagccatttgctgactatgatatctagtgttaagatgactacctagtttgggcaagcgacatgacccttgggtttcattctttatctggaacattctgggtaaaaaatggaaagcagcaatatttccctgtgctccatcatgtatgacagtgacaatgctattgtacactctacaaactcccactgctgttcactcagttaatcataagtggctctcagatatctaaagggcttggaagaggggtaaacttctccaacaccatggcatctggcaagcgactgaggacattggaggccatcccctcttgcaagtggaatatgccagagggctgagatttactccattctacatcgagaagtcctttgtagctgtgcccaacttgtctggttctgcttctgtgactcaaaacataattggcagcttgatatgaagagtcacagacttaaggtctgtaaaagcctctatttccaggagataccagtatgtggccagcatgttcctctctaatggagactagcacaagaatgagtaggattggccaatttgcataatttcattggctcagggacataaaggctgtcactaattgtctgatagctggccctagagtgatttaggcaggtgcttactggtctcaagtgtgaaaatacagtaaggcaaatacttagctgttcgaaagggggaactgaccagcctctagtcaaaaccacaaaactgggtcaagatagcgtttcaaataaactacataggggtatgagtgaacatttggagccaaaaaatcaatctgttatacataggcactactacaaagattcttcagtatccaaattattataatttaagctgaagagtgtgttggggatggtggtagaataaactcaccaaataactaataactaatggctactaggtaacagaaactatgtgaaacactgagctgaaaatgactgctgcttaacaatgagatctttcctgtttttcatagcccctttgaaaatattttattgctaaatcttgtatactataccgacaattaacaggctttaaatatacataattatagccacttttaaagtaatagcttaattgatagcagtaatatgtttccaaaatctatctaaactatgctttcttggccccttttttttttctattttgactttttaaaacttctgtattcagtccctcaatctaaacaactattacctcagtagacttgcaaccaggtctttatgttcttgtaatttgaaacttttaaattttaacaactatttggaaaatcatcatctcctttatttgtttatgatgagttacttaatataaatttgtttatattttatcataatcacatatcaaaatgactttgttttattctccttttcacttaataatgtttatttcatttttttcccttactaaattaattgaaaattctaggcttttatttactgagcatagtttgatgattatatcattacatgtatccatgtttatttgtattatgaaaaattacacgaagtctgtagcatgtgtttacttttgaagtaggaagtatgggaaatgacaagtctttgcttgctttataacatgttatattaccatgtgtctaaggacatatcttcctttcgttctatcagagacagatctttctttaattctacaggcttagtcaaatgtcataacttccagtaattctggtaagtacaccaacctatccaccagttcttgatagttcacccaattttctatttttaaataaaatgatgagttaaatatatttccaaacaaataaagcatttatatatttcagtttaaacaaagcatttatttgtggtgaaaaagaaagatgatgatgtatctggaattctagctgttcttaacaacgtgggacgaaggaaactttcagtacatgggtttaattgtcgatacaaagatgggctgctcagtccttcaaggagggacttacaaaccagcttgaaactcctgcagggtctgcctcaaccacagacaacctattagaggtcacacatgtgtcagggcagctccatctggtgaatgaatgagacagagaacaaaggcctttgccattttgaccttaagagggtcacttccgcaggcaatactccataactcgttgctagcttttctgatgttttgtcaaatctgcatttttgtttgactcttccttagcctgatactgatttctgacatctctcttcacatgtagtgagtcctaataaacatcctgtaccccatactttgcttctatttccagagaacacaattggtgacatatcaaagtaggaacattctggactctatgattatagtcctaattcatatcttgaatttcaagcattagcaacttcaggaaacccaagtggttcagcatattttcactataaatcaaatatgtaaagtcgatgtacaatcactggcccttgttggaattatttagaaagtccaaagtctcttagaaagcagaaaatatatctatggatttctgcttattaatgcattcatttaaatatctgagcattattcattcactcactcactcattctttcaaacaaattttattcccagctgtatgctggctgtcttgttaagtgcagggatacagagataaatacatgatctctgtcattaaggcacctaatgatgacagagataaatataatacataatttcgaaagcacgtgtattagaattagttttagtgttttatccatttttgtttctgtttttgtttggctgctgtaacaaattaccacaagaatagtggcttaagacaacacaaatttattgcttgcaattctggagggatggaagtccaaattcattctcacccggctaaagttaacaattttgtggggctggttctttctagaggccttgagagaatctgttttcttgtcttttccaatattcagtagctgtctgcattcgttagtcaatagcctcttcctcttattcctccagtctttctttcacttcacgtctcttattacttaccctgaccctcttgccttctgctcatatggactcttgtgactacattgggcctacctagataaccaggatgatctccaaaacccaagagccttaatttaagcacagctgcaatgtcccctttaccatgaaaggcaaaacttatagattctgaagattagaacattaaccttgggggccattattcagcctaccacactacttaactatgtgggtagagacaagggcaggtacgaagtcagaatattgctgctaagagcatcctaaggtattgaggaaggtgctgaatagtaggtcagtaaactttgccaaaacatagcttttaagtagagtgttgaaagataactaaatgtttgttagtgaagggtacagcagaggtgaagtgtaccttctaggatgagagagtagcttctgccaaggcatggaaatgacaggaaatataagtattcatggaattctagctgtcagccacaagacacatacttttcttacactttatttctgaaaaatagcatgtttcttacaattaatgagtatatttaatatagtcattaattattcctaaatattttatgttttctattaaaatatgaatataatgtaatttaataaacttggtttatatgatgctaagaaaatactgagagatgagaccaaagaacaaaatatgtgtcaaactcattacaggttgtaaccatgataaggaacttttaaaccatactggcgatcacacaaagtttttgattttcttgaagaagttatttcacatagtttgattttagttttagagaaatcacattgactgcatggaagaaaagtatgggagaggagcaatagtatagacagagaaaagagatgtttgccataatctggcaaatattgaaccctgaaggaagaaggtggtaggctgttgattgagaggcggtgagacatagaatgaccaattttggtaaatgatttgttgtaggtagtgggaagataagaaaaggtacagtaatttcaacggctccctgatttgggcaattaggagaatgattgtactttttgttgagaaaagaattgagggacagatgttttttcagagaggaatgggtgaataacaatatgtatgcattgtatttagtttttgaggcatgtgtgaaatatataagtttaaatattcatcagtatttgtatataagtgtatgaagcccaggaatgggtttttagatgaagatacagattgagcaatcattcagtggtaagttaaatctaaaatgaaaagcaaacaaacaaaaactcttctatgtactgtcaacattttgacaccaaatatgtgggttttccaaccaaccaattatgacattgggtgctcagagttaacacagatcccataggttaggggctcagacccccaagactgccaacccccccatacacaattcagatgccaactgaaatttcagggtgtcatctgtgcttctgaccaactatctctaaatcaagcgtttccatgacctcctccttgggttgaataatttcataaaacaactcacagaaatcaggataaaagcttacttgctagcttatcagtttattacaaaaggatacaactcaggaatagtcggatggaagaaaatcatacggcaaggtgtccaggagaggtgtggagcttccatgccttctcccagcacctccacaggtttgccaacccggaagctctctaaattctctgaaccctgtgcttttgggtatttacagagccttaattcttagacaatattgattaaaaccattgacctttggtgaataggttcccatagtctctcttccctcccagaaggtcaggggttggggctaaaatttccaaccctttaatcacaagattggttctcctggcaaccagtcaccatcctgaggctatcctggaaccctcagctactagtcatctcattagcatacaataaaacacttattattttggagagtccaaggattttaggtattttgtgtcagataatggagacaaagaccaaatatatatacttcttaatatatcacaaaatcacaaaaccttaagcagtgacgacacaatatgaaagaatggcatgaacatttcactttgcttatttgggctgttctggggtcagctttctctcattttggaggactgtccaattttgtgtattaatatgagatgcagtgttctgcttctcaccatggtagtataacttggactaacttttagttctctgcccactgatgacctaagttttgggaatgtgacttgggctcagccaatcagttgctcccacacaaaactttaatctggagttagaggcacaaagaagaagggttagggctcatttataagaaatttgttgtgttcagtgagagcagcaccaggaccgtagtgtgagatttctaccgtggtaggggcagagtcctaaccagactgttaaatacttatttcctgacctacttttaattttttacctcttttcaaagtctgatcgtatagttggtcattaattctcaaattcttaacattattctcataaaaaccctttactgcctcatctagctatagttgacttttcttcttacaatcatgattcataaagaagacgtatagaatgaaaaaagaaataggaggagaaattagaaaaaaaaattgatggttacagataatacgaagaacctcatatttgatggttactatcagtctgagcctttatgttttccagtaagaatcttttacttttaacctaacaattgtgaattgccatacttccttcaaacaaaacagcttcacatgcaaaaaacaagcaatgatagtcttggaattttccaagctggtttgatgaaaaagtataactggcactactgattttattgcttaggaatggattaatctctttataagtttgctttcactgcccatgcatatattgacaaaagggggtgttttattcagtttaataaagaattttatatgtgcttctgtgtgtatataagtacaaaaaggcttacttaatgtatttatatttttccaattctgaaagacctttatggactataaatattgattaaagtgatattttttctcagaaaaagattgcttaactatacccataaaatggcaatttgacggagtgtatggatcttctgcaaatactgctacacaggattaattttaaaatgtaatccagctcatatatcattaaaactttttcttcaatagtaaaaaggtcccattttcacattacaaagatcaaaacacataattttcatattgttttaaatggaaatgaaagatttcctagataaaatataaagaatacaaaattggaatatgaattatttcatgtttatgaaagcatcaaaacataatatgaattttctagtttagtagatcatgttgagatttttgcccacaaataaacttttgggttatttaatacaagtatatgaacatctaatcattcctttattcacttctgccaattttattttgtgccttccatgtggcagtaactgcattaagtatagaatgatacatatatagagatttttctagtgaagggctcaaggtttgagttgatggtagaaattgattcagttataaataggtataaggcaaaatagagaatgaatgtatagtcagaaaattttaaaaaatagagtaagaaactgtaatataaaacttaaatagttaaatggattttattagtctataaagtcaaggatttgtctatttagaaaaggagcaggctataccatttatcaatattttcctactttaatttcaaaataattcacatttattagagtggatataatatattcgcacaaaggaaacttaacatgaggagaactccttaagaattataaagtattattcaatcacaaacctaaatgacctaaaacgtaaagtgcagagaaagcaaaaggcaggtgacctagaaggtaataatacttaagggaaatattctgtcagtttctaggtgcccttgaatgctcacactcttatgtttttgccgtgagcaataagctggagactctattttttgttctttctatcaaaataagactgattttctacgttataattcccattgccttagaatttcattacttgagttatagtagttaagcaagtcttttaattatagcataaaatgctctagttacaatagtttagggaatatattaatcactcactgacatttacatatttaaatgtcttgtgctccacatacaattctaaaaagagaaaagaggttttttaacatttcttaactgagttactttaaataaggtgattttaagagcagtatctgtttatatcaagcatcaaacattttggtggtgacaagttatatgaatgtatttagaataaaggttaaatgccaatttcatttttcagatttaataagtagatttcaagtataaaaaattattattgaataaagccacatattttaaaagtctacttaatatctccactgagagtctatatttaagtggagaactaaatacttagatttcacaataaacaaacaatgctttacatttgattcttaattctaatatagttaaaattaaatgtaatataaaagctgtataaatatttttaagtttacataatgaggcaaatgaaattgagtattgtgtatgcatgtaaatgtacacgtgttttggttgctgtttattttttgtttttcttcaaaatcaatagacaaatatcaaagctttcagattcattgatgtgataacatttgatatttcacttcaatgtgtaaataatttgactgcaaatttatacgtgtgttttattcaagggttttctgatttttaaaaaaatcttgctgggccacaaatattgccaggctttgtcacaattttttgtttgtttgttttgttttttgtttttgagacggagtcttgctctgttgccagactgaagtgcagtggcgtgatcttggcttactgcaacctccacctcccgggttcaagcgattctcctgcctcagccatccgagtagctgggactataggcgtgcaccaccatgcccagctaatttttgtatttttagtagagacggggtttcaccacggtggccaggatggtctcaatttcttgacctcatgattcacccgccttggcctcccaaagtgctgggattacaggtgtgaaccaccaagcccggcctgtcacaagtttttagtgttctattttaatacagaaattagataaatccaaagagaaagacatttcatatgtggtagagttgtcggaagaaatgagagtcttataaataactttaaaaattgtgaagaaataaagacaaaatagtcctatgcagtttgatttaaatatattcttaataagagctacttttgtgaaaaccagaatattgaaacatgtagatatggatcttcattagtgactgacataatatattgttattgttactattttattgtatcagccaactaatattgagtgctttgtgtatcctaagcactatgctaaacactgtaccagtattacctgatataatcatattaatatttattatttcacttttcatatgaaaaaattgaagcacagattaagacactccgaaatcatacctctattgattatcagcaccaggatttgaattgaggcactctgatccagagaagcttttgtttccatgaagcttatgttggggaaaaataatcaaattgcctgtactcagttgtataaatataggttggttgtagatgattctggctgattcaacagaaaagaaatttattcaaaggatatcacacagttttcataacagttaagaatacagaggaaacagggcaccagggtaagtacagaccaaagtccaaaaccactgccaaagttgcagcaaggagaacagcacaaatttgcttgctgtcacccgccactagatgcttttgtttggagccttgaacttgacttacactgccactgacatcagcaccagtgctctctgtgtactaggaggtggaccttgtgaccgttgctgaactcaaaagtcagatgtttctgctgtgaaatagatacctaatacagaacctgcttcctcattcattccctcccaaatcatatgcttgtagtgtggctagagtttctgtttctccttggtccaggcagaatttatgaagcttgctatttatcgccttaaagattagaagaatattcataaggtattagattgccataaggttgaacaaatcaacattcaacttcaaggattcaacattgttttgttttcttttgggatacctctgcagcagttcaaatcttatttctgcccttggacaaccaggtttataaatattgcagattctccactgactgctttgatcctatcttctatatttatgtatactaattagcatataataaaagattatgttacagaatctcaaaattagtaattatgaattgagatggtgttatacagtacactaacatccagagacttgtttattccaaggaaaatatttagagatattaaatgatatttctatcctttagacatatacattttttagcttacagcctgctttaggcaagcaacagactctcaggatctgctcctaccagggtctgaacatttcctcccagtttttaaagaaacaaattcaaataacattgtaacctccagaggaaagttcaagctcttttatagtattgtttaaacagtacagctgaggaaactaaagacagagaagttaaatgccttggcacttagtctagatttacaataaactcctctctacttaggacccactaacaggggctgcatttacaccaaaaccatgaaggtggcccaagtcatcactgagaagtagtacaagcaccgagggaatgacttcaacaggaacaagaaagcgtggaaggagatcctagcaggaagctccacaagaagatagcatgttacgtcttgcattggatgaagcaggttcagagagacctagtgacagctatctccgtcaaggtgcagaaggagagatcattgaagtagattttcatgcaaaaaaaaaaatgttgaagtctttggacttcgggagtctgtccaaactgcaggtcactcagcctacagttgggatgaatttcaaaacaccagttggagccggttgaatctttctgctatgctgtaatattttcagtaaacccagaacaacaacaacaacaaaacacaatggaggagaagcagccaagtctcttggtttacagagtagctcctaataccccttgctgtctgtctcagtgcccaatgggaagatagtcaaaacaatattcacacctgtgattcatctctctacatgcagtgtgtgtgaatctttatatactgcatattaaggatctgtctttacagataaaaactaaagcattgaaggaactccttgttttgacttatcaaagtccttaagaaaatactagaaaattatagccattgtttcaaattttagctttatattatcacttgaaatgtgatgaaatgtggctgatagataataattcactgataacctacagacaattcccatcttaaaatggaccattggattgaagaattaaataaaattgagggttttccttacatgttttgtctaaagagcgaagtagaaacaactgttcatagatcttcattgaggattcgcatgtgaagtaagtactcctaaacataaacagtgacttatcaaccagttccataaatcatgaacaaaatatttgtcccagagagactatttttccaccacatctcttgtaataaacacagagccagttcagttaaaatagtttaagggtggacggttcagggcttgctgagtggcactcagtaagaaaacccagcagaacatttacttctctctttattccagagcatcaatggccaaggctggaagatcccagaacactgaacagacatttggtctcttatggcctgccaattttcacagtgggttccaacgctttgggtcaaaccaaaatagacctgttagaaaaatgtcggttggaatacgctaacaataagacagaataaatgtgattatttggcctcatttttataggacttgagtaattttattataacattcttgagggctggaaaatctgaatgttaggacaccaaatatctccagaaaacaagttttatatttctaatcctgcataataaacctggggccactgcaggcctcattaataaaaacctaatggtataacaataatgaggaggaaatgccaatgccgcacaaatctgttgagactaaaatatttctcaccccagcaggcttggtgcatttgacacttcatgatatcagccaaagtggaactaaaaacagctcctggaagaggactatgacatcatcaggttgggagtctccagggacagcggaccctttggaaaaggactagaaagtgtgaaatctattagtcttcgatatgaaattctctgtctctgtaaaagcatttcatatttacaagacacaggcctactcctagggcagcaaaaagtggcaacaggcaagcagagggaaaagagatcatgaggcatttcagagtgcactgtcttttcatatatttctcaatgccgtatgtttggttttattttggccaagcataacaatctgctcaagaaaaaaaaatctggagaaaacaaaggtgcctttgccaatgttatgtttctttttgacaagccctgagatttctgaggggaattcacataaatgggatcaggtcattcatttacgttgtgtgcaaatatgatttaaagatacaacctttgcagagagcatgctttcctaagggtaggcacgtggaggactaagggtaaagcattcttcaagatcagttaatcaagaaaggtgctctttgcattctgaaatgcccttgttgcaaatattggttatattgattaaatttacacttaatggaaacaacctttaacttacagatgaacaaacccacaaaagcaaaaaatcaaaagccctacctatgatttcatattttctgtgtaactggattaaaggattcctgcttgcttttgggcataaatgataatggaatatttccaggtattgtttaaaatgagggcccatctacaaattcttagcaatactttggataattctaaaattcagctggacattgtctaattgttttttatatacatctttgctagaatttcaaattttaagtatgtgaatttagttaattagctgtgctgatcaattcaaaaacattactttcctaaattttagactatgaaggtcataaattcaacaaatatatctacacatacaattatagattgtttttcattataatgtcttcatcttaacagaattgtctttgtgattgtttttagaaaactgagagttttaattcataattacttgatcaaaaaattgtgggaacaatccagcattaattgtatgtgattgtttttatgtacataaggagtcttaagcttggtgccttgaagtcttttgtacttagtcccatgtttaaaattactactttatatctaaagcatttatgtttttcaattcaatttacatgatgctaattatggcaattataacaaatattaaagatttcgaaatagaa

SEQ ID NO: 72 - DNA, 231 bp, Homo sapiens
atggctcgtggacagcagaaaattcagtctcagcagaataatgccaaaaagcaagctggacaaaagaagaaacaaggacatgaccaaaaggctgctgccaaagctgccttaatatatacctgcactgtctgtaggacacgaatgccagaccctaagaccttcaagcagcactttgagagcaagcatcctaagacttcacttcctccagaattagctgatgttcaggcataa

SEQ ID NO: 73 - DNA, 4533 bp, Homo sapiens
gttttctgagactgcatccactttgatagtttctactgagtccaaattagaacatcccagctggtgggctgtctcccaggaagccctcggagaggagcggtgcatagggggcacctggacacagcccacctcccccgagtagcgtcaggtaggcttgtctatctacatcctttcgccctttctcaggaaactatcagatgatgtgctcccccagatgaagaagtagtgccaggaaaaaggagacacgggatacagggatcctgaagccggcggaggacaagggagctcctgggaggacagctgtgctccggcctagcaatagcgagcagctggtccagactgccgccgtgactcagaagatagacatgcggagggttatgatcacagagcaacgatggtccttgtacatgaagataaaaatgctcaggtgtgcccaggttgaagaagatgaaaggccctgcctcccagagcgcccggggacactggtgatctcttccaggtctgtttccacccactgcagctgtggtgagtctagaggcagaaaattcatagcagcccatgccctttgaccatgtttctgctggtcagcctgcacctcactcacactacgccctgtgacacaaccccagacagactctggagaactcaaggggacgtggaagccaggctctgcccggaagctccactcaggtcatcttcagggagccgtgggagcatcattgccctcccctttcaaagctaggtctgtgcttactgctcagtttttttccaaactaaacaatgtttttgagagattcacagagagataaaagcaattaggaataaatgccagggggtggttaacacaaaggtggggatattggttacctctggagaggaaaggggatggaatggcagagtgctcaagggtctctggaggtgctcctgtctccagtgtagtcacgtgaggttcactttattctttaatctgtacatacactttttttttttttctgagatggagtcccactctgtcgcccaggctggagtgcaatggtgtgatctccgctcactgcaacctccacctcccagattcaagcgattctcctgcctcagcctcctgagtagctgggactacagatgtgtgccaccacgcctggctaatttttgtatttttagtagagacagggtttcaccatgttggccaggctggtctcaaactcctgacctcaagtgatccgcctgcctcggcctcccaaagtgctgggattacaggcgtgagccactgtgcctggcctgtacatacacattctctataaaatattttgaaataagcacttttaattaattaaggattgttctggaaaagaaaaaaactttctactgaaataattggctgagatagaagtaattatgtcttaaatgatctagataattttatgactggctgaagcctcagcatcagaagcaagggctgaacattttggcttcctgccaaccttgactcactgagcaaatgaatttaccttcaacaatatgtacagtccagatgtgcatttgtgcctgtctcattctcaatatgaaatatgttttgagaattgtttggggtaaaaacaacaaatgatctcttttgtccacatacttttcaccgttccttcctcggcagccaagtcgactcagctggctctttgggacctggcacattaaaactaaaatgtgctccagtggacttcactgtgtttttttctttctttaaccagcacaggagctgcagaagggcattttgaagtctggaggtaatgccagttggcctgggcagggaacaatgtgtgattaagcagtgaaggggataagggacaaattccgggagccctgcttatctctgctggaattactgtactgcaggtctcaaatcctgaaggatcctgtatttgttttcacctggaacctggaccacattcaggtggcagattaaaattaagccaagttcattccaggccatcctaatgattttttaattagcatcagtgcacagtgtagtaatttgcagttcatagtccacttgtaagttgaaattagaaactgcaaggacagtaatataagtgggaggagagatttcattaatcccgtcaacaaatatttattgactgcagctgtgctagtgggtaatgataatacagctaagagccaaaacaaagttcctcccctatgggcctttctttccagtgggaagagggtacagggtacagtcaataaatccaaatatatatatttatgtatgcacacagatatatatataaaacaagtggaatgtgctgtgaagaagaagcagggtaaggctctggaaagggccaagggtgtgcgtgagtggggtggttactgtatagagattggccacgccgggtgcagtggctcacgcctgtaatcccagcactttgggaggccgaggtgggcggatcacctgaggtctggagttcgagaccagcctgaccaacatggagaaaccccatctctactaaaaatacaaaattagccaagcgtggtggcgcatgcctgtaattccagctactcgggaggctgaggcaggagaatggcttgaacccgggaggcagaggttgctgtgagctgagatcgtgccattgcactccagcctgggcaataagagtgaaactccctctcaaaaaaaaaaaaaaaaaaaaaaagagagattggccaggaaaggcctctggcaagatgatctctgaaggaagtgagagtaagtggtgcagcttttgggaggaagatagtgctgggcagagggaagagcaaaggctacgtctctgcattccaagattacaaatagagggtaacattcaccctccacccctcaacgcctctttcctgtgaccttcgggagctgcagaacttcagtgtccatcagtcagaggcaatgcccctgacccagacgcctctagttgagagatagacagagctggatttatagcaccacagacctgacctggaatgagacttgcaagtatgtcagggagctgcacgctaacctaggaagaggctggccaggtaccattttctgtatggttatgatgaagcagctggtacaaatgttaggggacagtggcacatggtgggggaaaagcccagcgctcagcttctggtctggcttttctaccttaggaccttttactgtggtctgtgggtcttggggtctgtgggtcttggggtctgtgattggataaatgaaggtaagtagactgggaaggacagaacagggaacacagatctgctttggccgggcatgggtggctcaagcctgtaaccccagcactcataatgacttacaaaagcattcattcataacttacaaaagcattcataatggtggcctttgagagctgggattatggacaacttatatacctttttgctacttttatgtgaatttctacaaattacttttttttctttttgagacagggtctggctctgtcgcccaggctggagtacaggggcatgatctcagttcactgaaccctcctgggttcaagcaatcctcctgccttagcctcccaagtatctgggacgacaggtgtgctccaccacgcctggctaatttttctatttttagtagagatggggtttcgctatgttggccaggctggtcttgaactcccgactgcaagtgatccacctgcctcggcctcccaaagtgctgggataacaggcatgagccactgtacctggcctacaaattactttagcaacagaaaaagaaggtgagcaaagttatgcacaagtgtattaacaaactgctctcctgtacctaaatcagtcattcctttttttgagacagagtttcactcttgttgcccaggctggagtgcaatggcatgatctctgctcaccacaacttccgcctcctgggttcaagtgattctcctgccatgcccggctaattttgtatttttagtagagacggggtttctccatgttggtcaggctggtctcaaactcccaatctcaggtgatgcgcccgcctcagcctcccaaagtgctgggattacaggcgcgagccactgcacccggccactaaatcagtcattctatccagttccttgcatttactcctttcttgtgctaacccacagccagtacttaagagtatttaagtcctctctcctttcatgagtcactcctttttgtcttgtgactatacttggaaaaattttattattcattcatttatttatttatttatttatttatttatttatttatttatttatttttagatggaatcttgctctgttgcccaggctagaatgcagtggcgtgatcttggctcaccaaaaattctgcctcctgggttcaagtgcctccacacccagctaattttgtatttttagtagagacgagatttcaccatgttggccaggctagtcttgaactcctgacattgtgatccacccacctcagcctcccaaagtgctaagattacaggtgtgagccaccatgcccggcctacctggagcattattaaaaccttaaacctttaaa

SEQ ID NO: 74 - DNA, 8431 bp, Homo sapiens
gaacaaaggggatggatttcagaaacgtttctaaatcataaatgactgaaccagaagaactgaagctgatgtcagatttctcgcttgggtgatgaggaacaaggcaggaagagcagcaatgaggatagaggtggaagggcagctcaggaatttccctggagttttcccatcttgagacttcggtcttggaagacagaatggctgtgacataatgtggactttttacttccacctctaggaaagcgttctttggaacacctttgctgagtctctctctcctccgctcaagggtaaggcttacttggtagtggggccagattgcacagtgtcaacatgctttctaaggaaaatcccagaaggcggcattcgtccagataaccttgctggctgcatacatatttgaagcttatgtgcacaaatggagttcttccagaaagagagaatggcatttgtggagggtgaatcaattaattcagctactgctttttccaacctcagtttctcaccgtaaacagacagaacagcatgagcaaagtatctggtgttttagggtaaaaagagggaggaaagggcggctaacttatccaccaggcatactaaagtatatgtggttctttacttttaagcaacccacatattcaacattgatatccctattgttttttattttcataatatgtatttatagcacttcttcagaatcagatgaagaatcatgatatacagtttttttttttttcctaaggcggacagagtctcactctgtcgcccaggctggagtgaagtggtgcgatctcggctcactgcaacctccgcctcccgggttcacgccattctcctgccttggcctcccaagtagttgggactacaggtgcccgacaccacgcctggctaatttttgtatttttagtggagacggggtttcaccatgttagccaggatggtctcaatctcctgacctcgtgatctgcccgcctcagcctcccaaagtgctgggattacaggcatgagccaccgtgcctggctgtatatacaaatttttaccttaagtttgttaactttttttttttttttttttgagacagagttttgctctgttgcccagggtggagtgcagtggcatgatcttggctcatggcaacctctgcctcccaggttcaagccattctcctgcctcagtctccctagtagctggggttacaggcacatgtcaccactcctggctgatttttgtatttttagtagagacagggtcttgccatgttgcccaggttggtctccaactcctgagctcaagcaatcctccttcctcagcctcccaaagtgctgggattacaggcatgtgccaccgagcctggctaactttgttaactttttaacataagtaaacatacttgcagaaaagagcccagataggcatatagcatgatggatcttcacaaaggaaacatgaccatgtaagcatcacccggatcaaggagggcatggttggcacaccaggggcagccctaatgcatgctccctgccagccaccaccccccctaagtagcagcctactaatggaatcaattggctttgtctttgaactttatatatattaatcagtagaatcacacaagaactggcttctttcaatcaacatctatgagagtcacccatgttgtcgtagccagtttgtcattgctgggtcgtactacgttctagtgtgagaaaacaccacatttatctgttctgctgatgaacatttggtttgtttctagttttgatctattatgaattatgctgctattttggtgaacatatgtatgcatattcatttatatgtgtgtaggagtggaacgttgagctattcacatgtctctctcttttttttttttttgagacggagtctcgctgtgttgcccaggctggagtgcagtggcaccatctcggctcactgcaacttccacctcccaagttcaagtgattctcctgcctcagcctcccgagtagctgggattacagatgcgcaacaccacacccggctaatttttgtacttttagtagagacgaggtttcaccatgttggtcaggctggtctcaaactcctgaccttgtgatccgcccacatcagcctcccaaagtgctgggatttcaggtgtgagccactgcacctggccagccaccgcgcccggccgacatgtctctttatcgtttttatttttttgggtcttgctttgtcacccaggctggagtgcagtggcacaaacatggctcactgcagcctcaaccttctgtgctcaagtgatcctcccacctcagcctcccaagtagctgggactacaggcagtcacaaccacacccagctaatttttgcattttttgtagaaacggggttttttcaccatgttgcccaggctagtctggaattcctgagctcacgtgatccacctgccttggctcccaaagtgttgggattacaggcatgagccactgcacccaggtctttatcatttttcatatgacaaaatcaaacttctttttatttttgagacagagtttcgctattgttgcccaggctagagtgcaatggcatgatctcagctcacagcaacctctgcctcctgggttcaagcaatccttctgcctcagcctcctgagtagctgggattacaggcacacaccaccatgcttggctaatttttgtatttgtagtaggtatggggattcatgttgaccaggctagtctcaaactcctgacctcaggtgatttgcctgcctcggcctcccaaagcattgggattacaggcatgagccactgtgtctggttcatatgacaaagtcaaacttctattacctggtgagcaaacattaaaaattctcacctggaggagctgtgccccagcagtctaatttggacaaacatgttgttgaagaacagttcattcacttcactttattcaatgcttcctgcatgccagaatccgggctgggtgctacagagacactgactgacagaatccttgcccttggccaggcacaggtgctcacgcctgtaatcccagcactttgagaggctgaggtgggtggatcacttaagtccaggagttcaagatctgcctggtcaacatggtgaaacctcgtctctactaaaaatacaaaaatcagccgggtgtggtggcacgcggctgcaatcctagctactcgggaggctgaggcaggagaatcccttgaacctgggaggcagaggttgcagtgtgccgagatcatgccactacactccagcctgggcaacagagggagactccgtcaccaaaaaaaaagaaagaaaaagaaaaacaaatgctgataatagtgataagcgtaagtctcataatccaaagcaaaagtgataaggttagagtctgaatcatgagcaataccatctcacccaaatctatttggcttctcagctttggaaggtgagtagtgcaatttcaaatagtgagggatttgtccaaaaaatgtatccaaatctgttcagttcctgagttcaaacagtgagatctagaatagtgacagatacaaagtatagaatactatacttttacctaagttatatctacttatactttttagggtaataaggcattttacaacatttttaccttttggaaataagatcttccagtaaatactacttggacatgttttcagcaataacctacatacaaacatgagagaccacctgcttcttcccactgacaccagcccctcccttatccaggcctttgttctctgctcaggtcatttacctccttccttcatcttctttgccttcaggattccgctgacacattgcattcttgggagaaccttccaattccaattatggactagctgctcctaccctgtgctcttcgcttggtgactattcttatcccttttcagcccttctcacactgttttgtgactgtctctttatctgtattaagttggatatgaatttggctcctttcacacagaccaaaatataaatagcttaagcaatataaagatcacacacacaagtgaggcaaatgaccatctgagggttgaggaaactctgctgcaagggttgcccacgatcctggtttcttgtgttttattactttgtcattccctaggatgttgtctccatttacaaggccaaaacaggttcatcatcagctcatcactctctagtcccgggaagggcagcatggagttaaaatgacaggtagcaccttcttttttaaacaagttatgacttttcaaggacatagccagggtctttgcttctgggagaaggtgtgttgagttcaatgtaggctgccctgagttaatgatgggttaatgcaacccaagtcacttccttataaggatgtaaccagaagctgttcccatcgcttctgtttatattatactagccagatgtttgttagtcactttcctggcagcaagagcccttcttactaaaaggtagaagaaaagaatggacattatagggcgataagctctctgccacacacaccacactgggcattaagttctgagtttgttcaccattatgttagtaatgctcagtacaaagtgtttaatgaaatggctaaatctttgacagtgctagaacagaggacataattccgggagtttctgaacagaggactggatctttttcacaagagaaagaaaagttagaccgctgtagaccagaattcagactgttccgcgagtccccttgaacaggctctgaaccttgttctttttgatgatatggggataactctatttgatccctagtatgagttgggagcgttaagataacatttggcagtgtgtagtacacagatcatgctgaaaaatatgatcttcccttccatttgcagaagtgctggcaacatccactgtcacactacctgtcgcagtatctgcctgctgttcaacatgtaccatacctgactggcaaagccaacgaacacgcagccagtctgctctcttatgcgttctacattttatgtcgaggttaagctaaactaccagcaagttggatacttagacctaacatttaatagtcaagaagatttttgctttttctcataacccacatctatgatatacctgactgtgtttctcaggattgggtggatgtcaagcagagttgaatctgctcctcaaatttaagaccttctggtgcatattccaattttcccttcattcttttttttttttttttgagacagagtctcactctgtcaccaggttggagtgcagtggcacgatctcggctcactgcaacctctgcctcctgagttcaagcaattctcttgcctcagcctcccgagtagctgggactacaggccatgccaccacacccagctaatttttgtatttttagtagagacggggtttcaccatattgatcaggatggtcttgatctcttgacctcgtgatccgcccgccttggcttcccaaaatgttggaattacaggcgtgagccaccgcacccggcttcccttcattcttaatcacctacctttagtatgtgatcctgatttgcctttttttttcttttttggtgttccctcttctggtgtcctaaggtaccctcttcttcatgccctttcactgggcatggtcatactctgctgagatgtctgaatccttctgcgaactcctcagaaaaacgactgtgttggctgggcacagtgactcacgcctgtaatcccagcactttgggaggccaaggtggaaggataacaaggtcaggagatcgagaccatcctggctaacacggtgaaaccccgtctctactaaaaatacaaaaaattagccgggcgtggtggcaggcacctgtagtcccagctacttgggaggctgaggcaggagaatggcaggaacccgggaggtggaggttgcagtgagccgagattgcaccactgcactccagcctgggcaacacagcaagactccgtctcaaaaaaagaaaaaaaaaaagactgttttattgacctttgtaaccctgatttgcttttagtaacattttttcaccacattctttttgtaaattttttttttttttgagacagagtctcactctgttgcctaggctggagtgcagtggtgcgatcttggctcactgcaacctccgcctccgggttcatgcgattctcctgcctcagcttcctgagtagctgggattacaggtgcctgccaccacgcccggctaattttcatatttttagtagagacggggtttcaccatgttggccaggttggtcaagaactcccgacctcaggcgatctgcccgccttggcctagtgctgggattacaggcataagccaccacgcctggccttgtaacatttttttttctttttgtagagatgtggggggtctcactatgttgcccaggctgctctcgaactcctgaactcaagtgatcctcccacttaggcctcccaaacatgctaggattacaggcatgtgccactgtgactggtccacattcttaaaagtagcctaaaaatttttgtagaatgaggtgaagtaaaaatttaagaagaaagaaaagtaggtaacccgacccatctatatataacttccggatatattgtgagcaacactgtaaattatgagttgaacacaacaaaaatcaagcccttcacaaagtattgcctagggactcatcaaacatatagaggccaaaggagagtcaaatctgggacagtttgaatatcataatgataataatggataatatattaaaaatagtaatacttgactttgatgaggaatggactttatagagtttcaaagtaacttcccataaaatacacatacattacaaagtgaaaaaaaaagagtaaagagtaactttgtagtgtgagaaacctggaagaactacctcaagtgatcacagtgaacatcatgagtaacaggacaaactgaaatcgcatgccacatgacaagcgcacagtgtcactttgtaatctgccaaagatgcataacttgagtctaatcacaaggaaaacatcagacacatccacactcaaggaattttacaaagtaactggcctgaaaccttcacaagtgtcaaaagtcaaacctgaagaaatgttccacgcttaaaagagattaaagaatgtagcaactaactgcagtggcctccttttaaagcagtggtccccaaccttttaggctcaggcactggtttcgtggaagataatttttccacagacagggtcaggggaggtggtttcaggaagaaactgttccacctcagatcatcaggcatcagattctcataaggagggtacaacctaggtccctcaagtgcacagttcacaacagggttcacgcttctatgaaagtctaatgctgccactgatctaacaggaggtggagctaaggcagtaatgctcgctcgcccaccactaacctcccactgtgcgtcctggttcctaacaggagacagataggtacctgtctccaacctgggggttagggacctgttttaaaggacattatcaggacaactagaggaacgtgaatggaggaggattagatggcagtgatgtatcaatgtattaattccctgactttgatggtgggttatgtaggagaatatcttcaagtgtagaaaatacacatgacagtatttgggagtgatagggcatcaggttggcacttattcctagatggttgtggaaggcgggggaggagatctctgtaacttttctgtatagtcaaaatagttcaaagtaaaagttttatttgaaaaatgtaacagtcattttatttcagcagtttaaaaattgtcctttttcttaaagaggaagaaggcattttcacacaaggctggccagatgggaagaatcttcagcttcagcttcagcttggcctcattcatttgaaaataaaatgtttacatgaggccgcgcctgtgtccagctgaaagtgggtccttcagagcgtgtgggggattctctgccggcttgatgggctagctcctctaagccggctgctggagacatcaccggctgagggactcctgcaaacgttcatacatgatttgatcctgaaaggagggagaacacagaatacagagaccgtcactgcttgttttgggctgaatggtgccccccaaaattcacatgctgcagtccgcacccgcaggacctcagaatgtgattgtaactggagagagggtctttatagaggagactggattaaaatgaggtcatacaggtagactcttatccaatatgactgctctccttacaaaaagaggggattagggcacaggagggaagagcatgtgcgcagagggaaaagcacatgcaggcgctgggagaagacagccatcagtgaggacaaaggctccagaagaaccaatcctgcccaacactctccagaactgtgagaaaataaattttccactttttaagcca

SEQ ID NO: 75 - DNA, 2496 bp, Homo sapiens
acgctcaacagaataaacacacttgagacatcaaagaaatatcatattaagagaactgttcagaaaagtaggatacatttattgtgttgttcctatcgtgatacgcatactgaaattgttgttgttgttgtttcacatagtttgcagactgtaattacagaattataggctgtcttactcaggatggatgtctaatctcaacataaacagatcacacacagcttgtcccatcttttggccccctttaatatcaattacaatggctgttgctttgacacaattttgaaacaaaaaattataagattatatcttgttatatatcacccatggaagaaaaatttaatatttcttagctctattataatagttttttcccatctgccttcaacatttaaagccttctagggaaacgacgcatcaaagtgctaaggttctattagggcagactacaataaaacataggtgcatatcttaatgtataaattcctcatctgttaggtacatttaagattctttattataaacaaactcacacaaagctaaaccaaaaggcaattgtttagtgtaacaatatactgagtgtgggagctaaaagttaaaaaaaaaattaaactcaaggagacaaagagtgactttgcattttgccataaaattcgtgcctaggaccccaaaggaaaattggaggctttaaattttccccattctaataagattaccccaatttttagtgaaagctaaacgtgagatctctggaaagcagactccaagatagagtttatctttcttttttctttatttgagacagagtctcactctgtcacccaggctggagtgcagtggcgccacctcggctcactgcaagctccgcctcccgggttcacgccattctcctgcctcagcctccgagtagctgggactacaggcgcccgccaccacgcccggctaattttttgtatattttttagtagagacggggtttcactgtgttggccaggatggtctcgatctcctgacctcgtgatccacccgcctcggcctcccaaagtgctgggattacaggcatgagccactgcgcccagctgatagagtttataatacaagatgtttataagggagcactagttgtttcagcaggtgtggatgggaagggaaggaagcagaagtgcacagaggaaaaggtcaaactgcagtgcaggtctgacagcctcaccagaccgcaaaaatcacctgaagctaaaatggcccctcagagttgtcctgcttttgaacaaaacaaatgggcctttacacccctacctgtatcagtcagtagatgtaaaatgaccctggaagaacatgcttttagctgaaaacagttgtgcagtggagacaataacgcaacaagctgacagctgaaagctatttgctgcagcacctgaggcaacaacttatttcttgaagggagatctcggtggttcatattcctatccatatagaccccttcacaccactgagaaccacgtctgcatgtatgttcatagaactgcatcttcaggaatttagcctcacatcctgggagatatgtaagaggaaggttagtagtagatagagactgctgattgatctatcattgataatgatttttcacattcctccaccactaatctagattcccctgactctcagctactacatctgctggtctcaggtgctatttagtggcatgacccgaactcttagaccagacgaaactgggcccaagtcagcatgccattcttaggctggagttgctgtaactgatcatttacagtaataattgggcaacaggagtacattagtctgcttgggctgtgtcttagtctaatttgtactgtataacacaatacctgagacagggtaatttataaaggacaaaaatatattggctcctggctctgaaggctgggaagtccaagattgaaagcatgcatctagtgagggccttcttactgcatcataacatggtgagagagagaaagaggggaatgaaccctcttttaaaacaacccactcttgtgataacaacattaatccattcatgagagcagagcctcataacctaatccctttatataaagttcccacctctcaacattgttgcacggggggttaagtttccaacacctgaactttgggggtcatattcataccacagcaggctgtcataatagaatactacagactgggtggcttaaacaacagaaatttattttctcacagtggtgaagactggcagtccaaaatcaaggttggtgtatggtgaagcctcttctcctggctttcagatctccagcttctgtgcccttgcatggctttctttggtgtgaatgccacgaaaagagcgagtctggtatctctttctcttcttataaaaacaccagtcttatcagattagggctccctaattactggaacttataaatgttaccttctaaggaaaaagagtctttgcagatataattaaattaaagatcttta

SEQ ID NO: 76 - DNA, 558 bp, Homo sapiens
caggtccctctaagcacccagtcatcaggggcaggcccccatggagagaacaggcttgtttcagggaggaattcccagaagctggagctccagacagaggtgagggacagtggtcagcgcaaggcacactggacagagctgacttcagtcctatctggtgggttcataactcatgaatcatgggaaactgaggggaaagcccaggggaaaattgaaataattttcaaaatggttcaagaccactttctaattgagggtagcaaaagatgcagcttctactgttgggaaggtttggcagggagctgtggaaagaggtgacagaaactaagtctcttgtttctctgcaggagtttctccaagaagcttcttcctagaagctcatcatccctactcactttggggtgaaaatagctttgcaaaacctgctcagatgagtcagcaggccagacctccagagcggtggatgtagtccacacgaaattgcctttagtgaactgagcattgatgttataccatttgattgcattgatttggtttataagaaccagcacatcccta

SEQ ID NO: 77 - DNA, 2172 bp, Homo sapiens
gatgatcaaaaaaggaaaaaaattaatcactaaggttggagaatatgtttatttaaacctagtgtctcccttaaattttataactagatttttgaccctcactcatctggctttccttgctatagacatgctttgcatacccagcttctagccacatcttccctaagaaaatttcacctggaatcagttccaaaagaaaatcttaagagatagagtatggatctgcatgttgtcagctacctaaagcagcaaaaattcctagatgagaataaaatcagggaaccttgcagtttaaggcacaccttaaatattaaatttttaatccttcaatgcatccagccaaaacaagaaattgcaaatagctaccatccatcaatgcaaggtttttttggtttgtttttcataataagattggttttaattaaagcacttataaagatggagttatattttgaactttgtccttttacttaaagcagttagagtcttacacatcataactgccacggctaaccattaaaattttccagctccttaaatgatccatcataaacttgtgcttgctgagttaactggactagaggatagctggagggaaaatgaggcattgcaaaagttacagtaataaaaagtgaatggcttcaaaataaggcagaggacataatggctcattttataataaaagctttcagtataaaattcatacatttcccttacttatatagatcttcctactttccagacatgtgtattattgtatattacatttgtcaatagctcatggcaacagatacacatagtttgggataacccttttatacctcatatgagcagtgttcaaaggtttaaaagcacaactccaaagggcacagcttgaaatggagcgggaggatgctagcaaagccaccccaataaacacaaaatcttagtaaaagcactatgtttaccaggcaatgcaacttcaaaacaaattccttagcaaccccaacctcttcaagcccgcttctaatcacattattactcctaagcctccttatatacaaaatcttaggctggccaagcccaaacacacagacacattaataatgagcatctctgtccttaaaaaatttcaaacataaaaaacctccaaatgatatgttcccactggaagaggccaaattcttttcttgtagattacccttttctatttttcattcctacctcccatgcagtattcctagattctcacaccatttgatcatttctctattttgatatttatctataagaattaatgatttttttcaagtcaaatctacaaaaccgtggatttgcttgcctctaagctatttatctcagtgagtcaggcccactgcttccatttttctggattagctttgaagaagaatcatcagcacttaataacctacctaaatccgactgaagatgctttcttgatcctatctctggtcctcctactttggcagtgggaagagctaccctataactcctcagagtcatgcacagagctgtaaaaccagcatgcagctgattttgtgcacttctctgaaggacccaagcagcaggatgggtaccttttgttcacccacccatagacaccacaggacactttttgttcacctgctcacttctgcattgaccaaacttaaagatacagattcaacagtatgtaggggaagtttccagtaaagtatattctgttttctacattggttaaatattgtaatttcatgcgggaactgggaggctaagtagttgttaccattaagaagagcaactgtgatcttacttccagcctattttggaaggtgggataaaaaatatttgtgccacaaatctcaaatcttgtctcctatcttacaaccttgaaatacatagttaattctgcagggtctcagacatcctactgagttgccaaatattgaacaccaagctgggcttgtcaacactcagggctacaaagaggagatctcaaaactaccatggcctcaggattctgaatgtgggtctgaaatccctacttcttactttggattaaaagctcacctgagctacacacatctgttgtcctagaatggatatttttatttagatatcaaccaattcaacttcactcctttattgagtcagtcaagaaatcaataaaattgacttcaaaaattgaaatca

SEQ ID NO: 78 - DNA, 1576 bp, Homo sapiens
cactgcggcgccccggcccggcagtgccagcagcaggtcggcaccgccagcgccacgcttctcgggggccctggtgttccatggggtaccaatccaaagggttcggctcaactggtaagggcgagcagaggacctgggggagacggggctgacagaggaatgcaagctgaagctgtagcgccactcagacccctccacaggatttctgcgggaaactgcgcgccagcaccgcgtccccatgaagaaaacggagggtgacctgcgcgccacagggaacaaaagatgcgacagggagggaaaggggagtgggtgctgccacgatggggtaaatgggagagacagaatggtggcaggaaggggaaggatgagtaaagggggaaaaaagggaaatacagggtcgcctggagggggtcgaaagaagtgcagcgtgaggtgacgggtgcgcgcgctaaaggacaggaagcaatgcggaagggctgccgtttgggcgaagggaaagaagcagaggtaggtggaccacggggtggaccacctccggaatcttgcggcccgcgggcgggcaagaggcgcgcacgctccctgctcctcgccgcctgcccgcgtggtgctgcgcgcgctgcacccaacggccgcgtggtggggaagatgggaggggatgggggtaggccgccgagcatctcctgccccagaatctggcacgctgacggggacctagggacagacgaccgcacaacacgccacgttgcaggcgctgccaggccgggtgcctcacctagctccttcatgtattcatcaaagcctttgctgtccaccaggcgccatcttccttccagctgctgaactgtggccatggtgggtgcgggcgggctggcgtgcagagaggggtctgcgtcggcgtggcagcgtgctgtgaggcacccggcgccggcggctgctttataacggcggcccgcgctgggcggcgctatgcggccaatgggaggcgggcctcgcccggtccccgccccgcccgccgggcgccccctgggccttctcggggtcgggaggtgctaaccagctcctcttgccagggtacgcgacggcctctcgggcgcctcctgcaagcagggactcgcccggcgcgccccacgcctcatggacgccggcgcctgcacgtttcggcgcctctgcaggcccaggaagccagaggggtcacctggaggcctggccccgcctctcctgcacccctccgtttgacaacatatccaccgccgtttttcctttcaaaatacccggaccaatcgattagccctcgccggactcggactgcaggaagtgattgatcggctgtttggtttattgattcattaactacggtgcctccctgaccttctgctcctcgccagcgcacaagctcacaatccacaccctcctaagagaacctgctctcgccatccgcaggtctccctggcccaatagtggggatatacctgagttgagctagaggattttatccctgttgggatgggggacgtctcgggaagtgtggtttctaaactaaaagactgcaggaagtgtcaactttagtgactgtcat

SEQ ID NO: 79 - DNA, 4805 bp, Homo sapiens
ctaggaaggctgacacatgatgagaagagtcagtggtcctgaggtacagtacttaagataaccctgtgaaggctgagattgatatttgaaattcacaactgatcttggagcctggtacagcagtcatggtaagctggacatacatacacacacacacacacacacacacacacacacacacacatatatatatatattttttttttgagacagagttgccctctgttgcccaggctggagtgcagtggcgcaatctcagctcactgcaacctctgcttcctgagttcaagcaattcccttgcttcagcctcacaagtagctgggattccaggcatgagccaccgcacccggctagtttttgtatttttagtagagacagggtttcaccatgttggccaggctggtctcaaactcctgaccccaggtgatccacctgccttggcctcccaaagtgttgggattaacaggtgttagccactgcaccaggcctggaccaatacttttattcattcttttactcactgagtgcgtgctctgtgctaggtcttggagatacaaagatgacaatgtcttggcacttgtactagcagtttaatacacattaagaagtagttacaacaccatacaataagtttgaacaatgattccattgaggggaaaagcgtataccctctaaaagatttaaagtaatagaagcagagccacaaaggcaattctccacgaatgcacttcttctgtgttatcttgtttgctttcgcctacaatcccttaaaaatgacataagccagtttcactggagattcatttactatctcttaaggatactcggtctctgagagttgtggggtggacactttcaacagaccagggtttggcagaggtttgtcatgcctttttgccaagggctcaccctggcagatggcaacagctgtttgtgattgtcaagaaagtgcaggaggagccctgcaaaaatgtcctttttattacaccattgacttctttcctgagagtggtttttcactgtatcagtgcataattgattttgctaacgcatttactctaatcatacaaaaacctaattactctatgtaatgaatcattaacaatttccttaaattcatttcagtgtttgcatgctggtattcaatttatgctaataaacccaaaatattcatgtctttaagtcagagattgcagactatgctaaaaaatttgttttactaaatgtacattttaaatctgtattttataaaatactgaggtgtaaagtctgcaagattattctgaaatacacagcattcaaattttctatttactttttaagcagagttctttttatctccttcacactccgaattcacttagctacaacaaaatgacacgtggtcatgtttaacttaagagcattaattggtgtttggtaatgaaagatcaaaagtgactgatgtcaaactttttcactttgatttattcacattgagattcagcctttgattcatttgctgaaatagatattaggaataagtaccttatttttattactaatgagtaccttattttattattttaatcaaagaagaggaaattaaaccttgaattctagccataaaaatatatcactataaaatcagatttttttacagtactgccattattattattaccttattattaaacacatactatgcacttaagtgtccatttactctgataagtgcttaatgttcaccaattcatttaatcatcttctaaacctatgaggtcagtactattattatactcattttatagacaagaaacagatttagagggctgggcaccgtggctcacacctgtaatcccagcactttgagaggccaaggtgggcggatcacctgaggtcaggagttcgagaccagctggccaacatggtgaaaccctgtctctactaaaaatacaaaaattagccaggtgtggtggttcacgcctgtcatcccagctacttgggaggctgaggtaggagaatagcttgaacccaggaggcagaggttgcagtgagccgagatggcaccactgcactccagcctgggcaacagaacaagagtccatctcaaaaaaaaaaaaaaaaagaaaaaaaagaaaaaagaaaaaaaaaagaacagatttagagaagtgaagcaacttgcccaaggttacacagtgttgcacagtggttctcaactgggtgtgatttttgcctccctagggacacttgaccatgtctagagatattttttcttgtcacaactggacagggggcagctggcatgtagtcagtaaagtccaggggtgctggttaacatcctacaaggcacatgccagtccccatgacaaataattatctagtccaaaatgtcagtagtgttgtggtagagaaaccttggtgtagcagctgtgtgtgatgcccatgtcacagcttcttgggctactgatttctgagcagctgtggtgggcagctgtgatggacagctgtggtgacagtggcatgcaattactagtgtctcacttcaagcacatgtggtagttgctctttgcttttctgccttagggctttctctgaaacacctgtgcaggtgtaacttgggattgtgctggtgttatcatctgggggaaaccttcaaccagggttcaacttccctgttatttgatgggaccattccaagggcattcttcacaattcctctgtgtgtccccagagggattgagtctcaattgcctacagtggtaactggctggtacagcaggcccttattcaccctgccttctcccactggttgagggttgcctagagttcttaacacctctgaaatttcaggctgtgttgttaactgagctttaaagaaagctttgtggcagagaaacagaaacatcatcacgtgagcttgaggtgggattccggtaactacactgcagactttgaactgtcagcaatagttggctgaaatcaataacacacatcagtttttatcacttccttgtcttactcctcatattctttttcctagcctagcctcccttataaaccacctgtacccaagcccttattttaagctgtgctttcaagggaactcaaaccaagacattaagctagtaagtctgctatattatattgcaaatccaatgaaacagaaccaaaggctgagtttcagtccattctcatcctttggctgaggattccctctacagcgtgaattccatactcaacgatttcatattgatttttcaggactctaaattctctcacctctgtatctttttccaaacccaattgtgcatctttaatgatcaaatcattcttttttttttttcttatgcaggagccatattggattgtgaaaggaactcagttgacctggcctattgcagatttattctgagaatttcaattcagtctttgctgctgtttggaaatctttcatgaatcttttaataacttccttacatacatcttgttccattaaagccccaaatttggctttgtcagctctctttcttcataatctttaggtaacatttgatatcttcatcatgaatttttttttcaacttccatgattatatcacatttactactcctttgatctctctctgacagctctttttctttaatctcctaacatctgattttcctcctccctccaatctgaggctaagactcatcatgggtcctttttctataaccactccctggggagctcattcacttccatatggatgacatctaaatttctctttccagctctgagatatcccttagggctcagggtcattcttcactgcctattcaattactaataaggaagccacagtatctttgagtagcattttgcagtttaatataatctctctaaaaatggagtttaaattcatctctgaccctcaaactagtctctcttacctgtcataccactgaatagctagaaacgaggaatcatcttaaattctgttctcttcttcattgcattgttggctgtacacccagcatcccttacccctttcctcttctcttaaactccagttttggtacagtatccaaatcctcccctaggcagcccatgtggctcagaagtcaaactctctcccaagcccaggaaggcactagaatggtccaaggagaatcctctttcttcatgccacattgctttagtaattggcatacaaaccagttaatgtccctgagattcaagaaaagatttattagtgattctcgggaaattctttattgcatttctgaaaaagctttcaggagtaattctttctctatgttttttcttgctttttctcaggatttgttcatgtgtggatgtgatggaactgaagtcgctaggttcatgctacctggaacatgagactgacaaatagaggagcactgagtcaaatgaatctcggagaaatggagctggaagaaaactggagtaagcctgtccctgaaagggcactacatttggatatccagcagtgggactcaatattttttcttgttgtttaatctcatttctgttacttgcagccaaaggctcttaatgagaaaatggctctacctagttttctgaaattgcctcagtctctccactcttccctattacaaaggtcatctctttaattcacatccaataactgatagtctcttgactaatctacatcctctcattctctcctaattcacctttcatactgttgccaggtgacttttcctaaaagacaactttcatgatgtcactctacttcataaattcttataatggtttctttttgcttttagtccaaactcctcaggttcgttttcaa

SEQ ID NO: 80 - DNA, 19162 bp, Homo sapiens
agaacagagacctggaaggaagtggcctcccaacacaggacagcctacctcttaacttctcttacatgcaacaaaaataacctgctgtattgttgaagccactgctttttcttgtcaactgaagaacaacgaagttacaaatttggaaaggagagctttatttctcataaagcgttgcagcctgcaggcagccattctgataagctggcaagcgtcacctccagtcagaagccagaaataggctcttgagagtgggaagaataagacagagatatacgctgagcagggtggccaaatatatatatttgacagttataggaggagctatgaatattcacaaaggggaggcatgggcatgtgtagaggactaacatgaatacaacatgtgtcccatgttcactttggggtggaaacctaatgtttaaatgtattacaattaggccctatacatccaagggtgaaacagagcacacaaaggccctctgcacagcatccatagatggccagaaccactttgtggttggcggtctcttatcaggaaagaatgctgatcatttgttgtgtcaaaaccacaaaagggaggttggttgaatttagcagtggaacaagtccttccaaagggctggtttttgtttaatgcttaagaaagaaagcctaatagtggttaatgagggagggggtataacaaggcatgtccaaccttctgtaccatcatggccagtttttaaggtttttctggggtccccttggccaagtggggaaggatccagtcagttggtatggcatttaggattttatttttatttatcaatctcattttgtttttccattaaatgcagccaaacctaatttgaacgatatacttaacgaagaagaagagagcagaactcagggttttcttgacttatagtcaagaaaaacaatgtggctcagtcgatacttcttatttctaccaaacaagtgttcatttttattatgaacattttataatacctattttactctcctaaaatgaaaatcacagacactattgcctataggtataaataattgtaaataattgaacacacacaaacacattgctttaacaataggaaagaggataaataaaaggaaagtaagtcagcataaaatgacatataatttaacatgtaaatactggagtatgagcatcccaggagacttaaagaagttgtcaggagctagcactttcatatcgtgaataggcttgcatttaagggaagtaagaaagcacatttaagaatgtcaggtaggacacacaaagaatgtggagtgggaaactggactgtctcacatattacaggacatatggcattgctgtccattaagtgccagtagaacctcccaatcactgtcacaacaaaaattgccccacagatttccagactgaagccagtagcccgtcttatttgaagcctctggtctaagtgggctagaaacacctgggctctctccttggcacagagccttgagggtggccccttccttcctgaggccaaggcccggcctgcctgtcttaacagctcttagttttctctctttctgctctaatctccacttaggaatgccagatttagcaataaaattcgagaattcctggttaaatttgaatttcagattaaactatgaataatcgtttaagtaagtcccaaatcttgcatgagacctacactaaaaaaaaaaagaaaaaaaattgatttaactgaaatttgaatttagctggaacaccctgtattttacttgacaaccttactcccagtacacattgttcccctcagaacctcaagaaaacctatcttaagggtatcaattcagccgggagactttaagacctacgggcataatgtagaatttcccaaaatgggttccacggagtacttccatgaagtgctcagtaggaaaaaagagacagcctaccttaactcctcttagagattcgtaatactgtacatatctcctaggaaagcttaagcaggtcctgcccttacatttaatacttaacctggtatttcccaaaccatttcatctagcacctgctaactgtcccagacaccagtggtccagggaacacaccgtaggaggcaggtttgaggaaactatttctggagccccaaactaatcccacatggccacactcctgctgtggttactatgactctctaggcctcagtttctcatcagcagaagggtggagtcgaatgcaattagcttgaaggtccctggagtttatgaaatctggagattccactttcatacactgcctttcctcagagctctgtcccattattaccaagagccacctcaagccaaactcaaaagttggggcaaaccaaaggttcaaagctcacacagtgcatgaactgtctccaggagcctgaattctccatcctatttttagctctgacccatctcaggcccagcagatgccatagtgatgatcactgtaatttcatgggaaagatacaggaaacccaacaataacagcaataattcagcagcctagcagatgccagatctcatttgtgcttcacccttagcatgactgatgatacacactatcagagcaaaagaatgttcatctgtggcaaaagacctttagcacatttcctgtaacctccaatttgcaacaagttgagttccagttggtgggtaagttagcttgtgtcttctcataacacatttcccacagaaatgttcgacatagtctagacttcccggaaggccccttcctcaaggcccatttaatccattataaaactgtagttcaaggactactcctcaaagactcaacatgggaaggcatccattttgtccccttctctcccattttttctcccttgctttacagcccctcttatcctccaggcctcctacccatcagttgctttactagtgcaccaaagaaagaattttctaccaccaaatataataatttttgcagtaagagggagaagaccacacaaatgatcattcttcagcatttaagggaccccccacctctacccccagaatggtgttggtcagtaattcatacctaaggaacgtgcaagtgtgaagttctggagtcaaaacctacattgcctgaatgcaaacagcaaatctctgctttaaacgcataacatgggagagtcaatgtgttttcatctatgatggcaatggaggtaccagattgaacataaatggggccctctgtgaagatgcacgtgactgggtgtgtctctgttgaggggcaggacctcccagacaactggtggatcagaggccctggggcagcatagtgcttgtccagaacagtggttctcaaaatatggtccctagagcagtagtaccagcatcatctggggattatttcgaaatgtaaaatcttaaaccccaccccagagttactaaatcaaaaagcctggataacacccagaaatcagtgttttaatgaaaccttcaggtgactctaatgcatgctgaagtttgagaaccactggtgtagaatgtggatcctcctaccttaattttttatctgcactgcatagaaagaaggagctacaggcagaaggtggaggatatgttctcacagggttttgcatgacctagcagcatgatcatggctacccaggaggcaaatgtgacggaataggggaaacagtgttgcttcagcctggtgagaactccagaaagtacagctgttccttggtaccctgcaggttgctgatgtggccactagaaaaaggtgacccctccattccttggcatggacatttagactctcaagaataccactgaagccatgcagaggtgaggtgagtgcacagccaccctcagatggcatcttgatccccagctatgaaacccttatcaggagagcataaaagaactgttcctgaggtcacacgagatcccactagagagtatccaacactgggtgagactttgatggagctggagcttctgggccatgcattggtggtaaggggtggggggtgtgcaggggtgggggctctgatattttggctattcccattaatataatcctgttagactggggaagcttgagttacaggtgaaatagaaattcatccttactgtagggtttagcacaccgaaaacttcacctctctctgctgactctggcatatacaccaaagagagaaaaattggatttaaaagcaaagagagatagaccatccttactcctcagctttctctttcactctctctctctctcacacacacacatacacacagtatgtatgcacactcatacgcacaggtctgcatggcacactgcagtaagtaattcccaagtgcttcctggctgacaatgaaagcctacttgcccgaacagcaatcaaatccacagcctgccctgataattaccccgtcaactttagccccagtaaaataaatgagccattcaaagatttctggaaacttcagtcccagcaacgcctcctcagatacagtggtttggcagtttggggtctccttgtgctctcacagaaaggatatcaaatttctgaccactctccttgtggttgaactatttctcctcctttgaagatcataatttctgaaacattggcgtctcccttttctttcctacttgtttatcctcttgtaacttgaaggctctgaaggccaagtcatagaaattgttaattgcactcttggattttgttaaacaaaagaactggtgatgactctcactggggctgccagaaaatactgcttatttggctgggcatggctggagcccacactaaatgtcagctcctctatggagctatctccttctcacgatgtcagcttaactctcattacttttaagctactgagtatctgggcatttcattcttcagaaagtttttccagaaaattaacttgtgggggaaatcatgtgctgtattaattcaccccagacactatccgtttcaaagtgaaatctccaggctttagtcaatactggctctttgtaagtgtttcacatctcccagggcatcaagagatcagacgcagtgagacaaggatgtaaaattcttgtcagtgtttcagtgcccactatttcttgtctcctgtggctttgtgccactggatcatgtaatacaagccttgtcttgcctgctatctttcctcactgaatttcctataccaggtatcaggaaagtcagagaacacaaatattttctaatgccagcatctgcttagagccctgttcacaagacctgtcagagaacccaaagcaaaaaaaatctccttcctgtcatctgcctttcagtcatttggtgaggagtccttaatgctggaaaagtaactcaatgaaatggagccagagggagagagcaagtgagccacgttcactgtagagttcacaaacttcaggtatgaacctgaagaccccagagttgtcgtaagcagcaaagaccccctgcagatgcaacctacaccatctcccaaccatgtgactggtaggacatgtgtgtgttccaggtccctttatgtcaggtcagactgctttagtcctgccatggaaataaatccctaaactaggatcaggtgtctcctgtcaaaaccaaaatacaaagttagtaacaatggctcctttggtgttctggaaaggaaaggctgttggcacagctcacccatctccttttgtgagggacattgctccatcttccctgtttccccttctttcctccccttgtactgcatgataaacaaaccaagtggtatcttccatttcaccttgaatgagctctcttatccccatgtattgatatcactgacatttgattctgaggtactgcaataggtgataaacagccataccttttatagaggatctaaaaagaaaggacagtaagaataagtaggctcattgttgataaggtctgcaggtgcctcctggcaaggtggcctgttcaccaggatactttgcttcccttacaaatggacttgccaatctggcatggcacagtgacagaggtgggggaggtggggtaggtggggttttcatgtttgagagactttaatttaaaattggctaacatggtgttcctcaattgaaaagttttctggcctggtatcaatagcagtaaagttaagtaatgagctgggttctctttctatgtttatctttataatcaatcttaattatattttgtttattcatgatctcatgtaaccaaggggtaagatatacaaatcctttgctttcagcccaataatggaaatagttctcaaataatgaatatttataattacgactttcctggccccattttgtagaaactagtctagatcatttcctgtagcagaaagcttaacctcataagtaaagaagtgagccctgagccccaaatatgccatgatttctaccattaaactgtttggctggaaggccttgtagagtcataggaaggacctggacttcagagttagatctgctggatttgaatcccagctctacgactcactgactttgtgagtttgggcatgctgtttgacctctgtaaaagccagtttccctatccataaaatgggggcagtgatacctatcttgtgagaatttaattatctagtttatgttaaattccagacattctctcatcaactattgcacttcttgtacctcaattctattctatacttttctgtgttctatattttaatttgttttgtcaatgaacattgaacaggtaggacactatatgcttagaaacattttccatataaccccttaagttaaaagagaagaggcttgaagatacctaacccttcctaattttaataggttcctaaacataataattctgttcccttccatttgctgtcagttgactcttgaatctatatgcccaaaccagacctctcctctaaatgccagactcagtatatccaatgatctctttaacatctcaattggatgtataattggcacctcacacttaaatattcaaaaagaaacttctgctcttcctttttagaccacagtcctccccatctcaactaatagcaacttcatccctctgctgctcaggcctaaaacattagatttcttctgaatgcctctctttctctcataccctacatgtaatccaccaacaagtcctgttggctcaactttcagcagaatctaaagccatctcacaccttcactgccatcctaatttaagccaccattattctgtcactcaataattctgtcactgaataattctgtcctaacagatctttctgcttccatactctgttcccaatctcttcccaacaccacactcaaagaaatccctttaaagcttaatcatatcatggccttctaaatggctttccatcttactcaagtgaaagccaaagtcattacatacagctttcaatgtcctatttgatctgcaccctctgacataccccccagtatggctcattctgctctagctgatgctgggtttctagccactttctccaaactcaccaagtatattcctaactcaggctcttgtacatactgttccatctacctgaaacatcttcctcagatatgtgcatgcctcagtttctcactttatttcagatctttactcaaatactccatttccaatcagaacttccctgtccactctatttataattataccctattcaccatctctggagtccatttcatatctcttgcttgcttcctttatttttttcccatagccctcatcactatgtgaagattatgtgtttgacttgtttgctttgttattagtctcctctcattagaatgttagctctacgaggacaagggtatttttttttctatgcccccatcacatattaggtgttcagtaaacatttttaacaaattgaactggtgaatgaaatcctcagggtttcttcctggttcactccatacatattttacttgttcctttatacttcccccccagactttttcttctagccaaattagaataacagagaactaatttatacttacatcttataattatggtcaccaaagatatcaagttataatccctgaacttgtaaatgagaatttatttgggaaagaggtatttgtagatgtaattaagttgaggattttgagatgaagagattaccctggattatctgggtagacccttaatggaattataagtgtccttccaggatagaggcaaagggagataacacaaacactcagaggaaaagatgatgtgaaaacagaggcagagattaaagtgcagtgacctcaagtccaagagtgccgaaaaagccaccagaagctggaagaggtaagtactggattatctgccatttcctttggaggaaatgtggctctgctaacatcttgattttagatttttggcctcaatggctgtgagaaaatatatttctgttgttttaagccattcagtttgtggtaatttgttatagtggcactaggaaacagactcttttaaaataacttaacaaggtcctagaacaagttcaaaaacatataaagaaatatgaaatatccagcactcataaaaaggtaaaatctacactgtttgtcatccaatcaaaaattacaaggcatgcaaaaaatcagaattaaaactcataatgaggagaaaaatcagtgacttgaaactgacccagaaattatatagatgatagaattagcacatgaggaaattaaaatagttaatactatattttatgtgttcacagagtaagggaaagcatgagcacaagtaggagagatatgaaagatatctaactttggaaatgatgaatacaatacttaatatgaaacatataacatataaaaacagactagacactgtagagtaaaagatcaataaacttgaagacaataatagaaactatctaaaacaaaacaaggtaagaaaaaagaccaaacaaaatgaacaataacaacaacctcaagaaccttaatatacatgcaactggagttggctcagaagggtacaagtttggggggtgagggtggacagaaaaaatagttgagaaaagaaacaaatttgacaaaaagcataaactgatagatccaagacactcaacaaactgaaaacacaaagaacataaagaaaactacactaaggcacattagaatcaaattgattgatacaattgggaaagagaaaaccttagaagcagccaaagaaaaaaagacacattatgtacagatagccaaagagagggatgatggtagatttctctttagaaacaatggaagctcaaaggcattgaaacattttctttaaagtattgaaaggaaaaaaaaatcctttcaagtagaatactatatccagtgactagatcttcccaaaacagagggaaaataaagactttttaaatttataaatcctaaaagaaatcattagcagcagatctgctctacaataaatattagaggattgcaggcaaaaggaaaataatgccatatggaaatgtggatctatgtaacagaataaagagtactagataataaactcatgggtaaaatataaaatactttttccttatttaaaaaatctcttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacctgggaggcggagcttgcagtgagccgagatcccgccactgcactccagcctgggcgacagagcgagactccgtctcaaaaaaaaaaaaaaaaaaaaaaaaaaaaaatatcttggccaggtgcagtggctcccgcctgtaattccagcactttgggaagtcaaggcgggcagatcacaaggtcaagagatggagaccatcctggccaatatggtgaaaccctgtctctaccaaaaatacaagaattagcttggtgtggtggcatgtgcctgtaatcccagctactcaggaggctgaggcaggagaatcacttgaaccagggagtcggaggctgcagtgagccaagactgtgccacagcactccagcttggcaatagagagagactctgtctcaaaaaataaaaaaataaaaaataaaaacacacctctttgaaaagttggttgactgtttaacagcattcaagaaaaccagtgcactaaacacaactacaaccaaggaccctcacagagtccactttactgtggactgtaaagctgtctcttccagagcaagtgctggtgtccatgactgcaagacctgaagatggattacatcccaggactctttgcagacactccccagtatcctcctggagcctggtagctctgatgggtggctaaacccagaagagcaataacaatcactgtagtctgactctcaggaagctccatccctagagaaagggaagagcaccacaccaacagagcatgctgtgggacaaaagaatctgaacagcagccattaagccccaatctttcctctgacatagtctacccaaatgagaaggaaccagaaaaacaattctggtaatatgacaaaacaaggttatttaactcccccaaaagatcacagtagctcacaagcaatggatccaaaccaagaagaaatctctaaaatgccagaaaaagaattcagaggtcaattattaagctactcaaagaggcaacagagaaaggtagaaactaacttaaagaaattttgtaaaaagtacaggatatggacaaaaaattatccagaaaaatagcataaataaaaaacaaccacaacttctggagatgaaagacacacttagagaaatgtaaaatacactagaaagtttcaacaatagaagcaaacaagtagaaggaagaacttcagaactcaaagacaaggctttcaaattaacccgacaaagacaaagaaaaaatatttttttaaaaaaaatgaacaaagcctccaagaagtatgggattatgttaaacaaccaaacctaagaataacttgtgttcccaaagaagaagagaaatctaaaagtttagaaaacatatttaagggaataattgaggaaaacttccctggctttgctaaagggctagacatccaaatacaagaagctcaaagaacacctgggaaatgcattgcaaaaagtttataacctaggtacatagtcttcaggttatccaaagtcaagaggaaggaaagaatcttaagagttgtgaggtaaaagcatcaggtaacctataagggaaaacctatcagattaacagtagatttctcagcagaaaccccacaagccagaagggattggagttttatttttagcttccttaaacaagacaattatcagtcaagaattttgtaaccagcaaaactaagctttataaatgaaagagggaaagtcttttctggacaaaaaaaagtgctgagagaattcaccactaccaagccagcactacagaaactgctaaaaggagttgtaaaacttgaaacgaaacctcgagatacaccaaaatagaaccccctgaaaacataaatctaacagggcctataaaacaataacacaatgaaaaaaaaaaccacaagatattcaggcaacaactagcatgatgactagaatagtatctcacatctcaatactaatgttgaatgtaaatggcctcaatgctgggtcaacaatgaaagcaagatggaaattaaaaaattatttgaactaaatgataatagtgacacaacctatcaaaacttctgggatacagcaaaagcagtgctaagaggaaagtccatagcttaaaatgcctacatcaaaaaagctgaagagcacaaatagacaatctaaggtcacacctcaaggaactagagaaacaagaacaaacaaaacccaaacctagcagaagaaaagaaattacagtgatcagagcagaactaaatgaaatggaaacaacaacaaaaaaaacatacaaaagataaatgaaacaaaaagctggtttttttaaagataaacactgatccaccattagcgagattaaccaagaaaagaagagagatataaataagttcaattagaaatgaaacagaaagtattacaaccgataccacagaaatacaaaagatcattcaaggctactgtgaacacctttacacacacaaactagaaaacctagaggagatagataaattcctggaaatatacaaccctcctagattaaaccaggaagaaatagaaactctgaacagaccaataacaatcagtgagattgaaatggtaattcaaaaattgccaacaaaaaagagtccaggaacagatggattcccacatgaagtctatcagacattcaaaaaaacctggtaccaattatattgacactattccaaaagatagggaaggaggaaatcctccttaaatcattctatgaagccctaataccaaaacaaggaaaggacataacaaaaaaagtaaactacagactgatatctctgatgaacatagatgcaaaaatcctcaacacaatactagctaactgaatccaatagcatatcaaagagataatccaccatgatcaagtgggtttcataccagggaagcagggataggttaacatatgcaagtcaatacatgtgatacattacataaacagaattaaaaataagtacaatgtgatcatctcaatagatgcagaaaaaacattttataaagtccagcatccctttatgattaaaaccctcagcaaaaacaaattcgaagggacataccttaaggtaataaaagctatctataacaaacccacaaccagcattatatgtaacagggacaagttgaaagcattccccttgagagctggaaaaagacaaggatacccactttcaccacttctattcaacattgtactggaagtcctagccagagcaattagacaagagaaagaagtaaagggcacccaaatcagtaaagagaaagtcaaactgtctctgtttactgatgatatgatcatatacctagaaaaccctaaagactcctctaaaaagatcctagaacagttaaatcaattcagtcaaatttcaagatacaaaattaatgtacacaaatcagtagccctgctatacaccaaccatgaccaagctgagaatcaaatcaggaactcaacatctcttacaatagctacaaaaaccttaaaatatttaggaatatacctaaccaaggaggtgaaagacatctacaaggaaaactacaaaatattgctgaaagaaatcatagatgacacaaacaaatggaaacataccctatgctcatagatggatagaatcaatattgtgaaaataccatactgccaaaagcaatatacaaattcaatgcaattccatcaaaataccaccataattcttcacagaactaaaaaaaaaatcccaaaattgtatggaacaaaaaggagcccacatatccaaagcaagactaagcaaaaagaacaaatctaaaggcatcacattacccaacttcaaactatattgtaaggccatagtcaccaaaacagtacaggactggtataaaaataggcacacaaaccagtggaacagaatacagaacctacaaataaagccaaatacttacagtcaactgatcttctgacaaaacaaataagatgtaaagtgggaaaaggacacctattcaacaaatggtgctggaacaatcggcaagccatatgtagaagaatgaaactggatcctcatctctcaccttatacaaaaatcaactcaagatggatcaaagacttaaatctaagacctgaaatcataaaagttctagaagataacattggaaaaatccttctagatattggcttaggcaaagacttcatgaccaagaacccaaaagcaaatgcaagaaaaacaaagataaatagatgggacttaattaaactaaaaagcttctgcaccacaaaagaaataatcggcagagttaacagacaccccatagagggggagaaaatcttcacaatctgtatatctgacaaaggatgaatatctagaatctacaaggatctcaaactaatcagcaagagaaaagcaaacaatcccatcaaaaagtggtctaagggcatgaatagataattctcaaaagaagatatacaaatggacaacaaacaaatgaaaaaatattcaacatcactaatgatcagagaaatgcaaatcaaaaccacaacgtgataccaccttactcctacaagaatggccataataaaaaaattcaaaaaataatagatgttgggatggaacagggaacactactacactgctggtgggaacgtaaactagtacaaccactatggaaaagagtatggacattccttaaagaactaaaagtagatgtacaatttgattcagcaatcccacttctgcgtatcgatacaaaggaaaagaagtcatacaaaaaaagacacttgcacatgcatgtttatagcagcacaatgtgctactgcaaaaatatggaaccagcccaaatgcccatcaatcaatgagtggataaagcaaatgtggtatatatacatagtgtatatatacacatacacaccatggaatactacgcagccataaaagggaacaaaataaaggcctttgcagcgacctgaatggagctggagaccattattccaagcgaagtaactcaggaatggaaaaccaaacatcatatgttctcaatgatatatgggagctaagctatgaggatgcaaaggcataagaataatactatggactttggggactcagagggaatggtgggagggaggtgaggagtaaaatactacatactagatacagtgtacactgctccagggatgggtgcaccgaaacctcaaaaatcgccagtaaagaacttatccatgtaaacaaacaccacctgttcccccaaaactcattgaaattaattaaaaataaataaatatgctggatgcagtggctcatgcctgtaatcccagcactttgggaggccaaggcaggtggatcacttgaggccaggagttggagatcagcctggcccacattgcgaaaccacgtctctataaaaaatttaaaaaaggccgggcacggtggcttcacgcctgtaatcccagcactttgggaggctgaggcaggtggatcacgaggtcaggagatcaagaccatcctggctaacacagtgaaaccccgtctctactaaaaatgcaaacaattagccaggcgtggtggcaggcgcctgtagtcccaggtaatcgggaggctgaggcaagagaatggtgtgaacccgggaggcggagcttgcggtgagccaagatcgcgccactgcactccagcctgggcaacagagcaagactgtctcaaaaaaaaaaaaaaaaaaaaaaaaaaaattaaccaggagtggaggtgctcgcctgtaatcccagctacttgggaggccaaggcaggagaacagcatgaacccaggaggcagaggttgcagtgagccaagatcgtgccactgcactccagcctgagcaacagagcaagactccatctcaaaaataaataaataagtaaataaataaatatcggttgactgtttaaatgaaagataacaatgtattgagaggtatataacatgtaagcattaaattatgacaatagcacaaaggcagagaaagagaaattatacatgaaggaatatgttacttgaagctaggttatgataaattaaagttatatggtttaaaacctaaagcaaacactaaaacaaaaccaacaacaaaaacctatatgacaataaaaaccacagagctaagaagccaccaaaggagataaaatggaataatttaaaaaatgcaatcaatctaaaagaaggcagataagagaaagggaagcaaagaacaaatgagaaaaatagaaaacaaatataacaaaatggtagatagaagttctactatgtcaacaatctcaataaatttaaattgcctgcacaccttcattaaggcctgaggacatgtaagtcacgtgcatttgcagcatttgtgtctttagagcagtttccagatttaccgccttgacttctttcattcaggtttggtaataggctatttcaggttatgtagagctgagacacacttgaatatattgtaaagatatgaagagaagtaagcgaggcaggaaatggtcataactcccacattggctgctttaaggaaaacctcaatatcttttagaacaaagtggaaattgcaaaattgaaagtcacagagaacacaattgccattcaggagacaatgcagatctgaacttctggggatcttctaatgctcttctattctctgcctcagcaattactgctatgctaattttctatctcaggttcagactcaggagagaggtcccaacttgtataatacaagtcactgtcttacgtgaagtactatataagttaggcttagcaggagccacacaacccatgtcacatggtacaatatagtatattgaatatggacaattaattatggacctgtgggaagacccgaaaaggcaaacagcaagggacaataaggcaatccagagagccaatatcttgcctagggctgaagagactcaaaggaaaaagagttgttactagagcccagaagcccaggctgcctagaaagctcagaatatgtagtttgcaaaggtcagtcccatgttactgagaacagagaaagagaaaagacactagatctgagagtaaacgcaaataggcaaatgactagcctagttgctttactgggcagagtcttaacactaaccaattaaatgtggatcacatgcctatcactggtctcttggtctggaagactttgaaaatcatgactttgacatggaaatttccatattcaaactaatctcagatatgaaaatcggtctacatttggtttaaaatcctaccttctctctttatgtaaggaattctattgggatttctggaaagttttttttgtttgtttgtttttgttttttgtttttttgtttttaacaattctcagcaatgctcactgctaaaattgtattttccatcctatcctgccatgaggcacattatcaattgctcaattatagctcaatagctttctcttgattctatacctaaggcaatacttgtgggttttgttttcgtgcctcagtatttcaaagactgggagactgatagaattctgactgtgacattctgcaggatgctactatggatcatgtaatatctgacacactcagctccttttgtagagtgattttatggtgtgaaggtgatgactctgagtgctttgccatgtagctaggcatttgtgtgcaagggctggattgcttcccaatgttggtctgacaaatcattttacataatcacgctgaaagagcaccttttttgttttgtttttgtttggacagttcttggttaaaaagaaaccagttcttaatttagccttttcatagattgcgaatctcatttaacttagatttgtgtttaattttggcaatttttaaaaagggaagaccagggatttcttcctgtagaatatgttcttggttaatgtgttcataaagactttcattgatttgttcctttaactgaaggaaagaagtttaaaatctctagtgtgaaatactgctggcttaggggtcactaaagtcttctcatctgtgctttactcttctccaccagaatataaatttcctaagggcagggatattgtgttatgcactgccatatcgccactagctagaataatttttgacacagagtgagttatcttatttgttgactgaattaagtgattagcatcatttaacttaaagaaataaaccctgtatagtgactgggacatgagcatcaaaaaatacaatgtgtaatacggtagcttctttaagaagatggcacagtgtattagtccactaaggctgtcctaacaaaataccataggctgagtagctgaaacaacaaaaattaattttcttatagttcgggaggcaggaagtccaaaatcaaggtgctggaaaatcatagtgcttggtgtctggagaggcctttctttttggctggcagatgcaaccttctccctctgtcctcacatggcctttcttctgtggggtcaaagcggtgggatgcggaagctctggttagagctcctcttcttcttataaggacactaatcctgtcagattaggatcccactcttatgacctcatttaaccttaattatctctgtacaagccctatctccaaacacagtcacatttggggttagggcttcaacgtatacattttaagagggcacgagtataacatacagatttgtttgttttcttcctaggaaatgtgtaaaccagtgtgagtcaaatctatatatagcactttggaaaaatggaacatttaactgctaaaattattttctctaattgaatgttctctttatttaagcattgtagagactgaggttcaaaggttattttctcaaagttacagcagcctctgaggtggtggagggtggcagcaggacagtgagctgacggccaacccctgtgcccaagtgtgctgctccgctcaactccatgtgcaccagggaacagccattctctgcaggctgatttgatctggaaccacaattgagtctagttctggaatctcagacacatggagaactacaccttgtctccagttgctacaagtcaagtccacctgcatgcagacagctacaattgtcttgtaaaattagaaaacagaacagggacaacagtattatctatattgactatagattaattattcatttgcattctttgtcttttgtacttataaatatgaaatttgtatataaacgtgtgttttacaacataagatacagatctatatatatgtacctttgaaagattattctctctgctctttggcctaaatttccaaatggaatcatcctgtgtacagtaacctgtgtctgaaaatttctgtccacttagagtaatgaaggcatggggtcataatgagagcaacaaaaaagttacactttatactgtgaaagaccgtcaccttattgttcatttacttaagtttttcattttgtttttatattttgaaatgttgaataaaaaactcaaggcac

SEQ ID NO: 81 - DNA, 651 bp, Homo sapiens
gtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccaaaaacaataagaccctcagaggcaaggaactcatcttggtttttgtcccttacacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggtttcccccatattgttctcgtggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacctttcctatataaatta

SEQ ID NO: 82 - DNA, 7898 bp, Homo sapiens
ttttacagagggagagacgtaaggcagaagaagattacatgtacgagttgacagcataattcactggcagaattccaaaaagatgctatcagtccaaaagaaaatgattctggggagccatctgttctccagctgcagagatgtttctctaaagtgcaataagtattgttgaaaccatctttactgtagcggaagtcaatcacagtctggattcagatgggagctggtttaagcattcagatgaagagatacttcgtcatttctaccagtgagtcaactttatgacctatctacaactttggcatttgcaaactcaggttaagcagggatggttagagagtttatttgatcttttaaattataaaacttatgcaatgagtccaaaaaagatggattaccttgagtaggtaaaatagttatatttgttaaattgaccaaggataaataaaaacatagcaaaccagatccaattctcaaatattttgatctggctcatatctaggcaaccagagttgggcactcgtctaatgatgatgcagttgagcttagatgggagagtggtggggcatgggtagagaggtacacgtgctggagatgagacacgaatggcagaatgtagagaactgttaaaactgggtgatgggtatgtgagggttcattgtattattctatttactttaaatatgtttgacattttccagaataagaaatggcttaatacagcaagttgctaaccaacttttaaaaaggcatattatctgccttctatgacttgttatcattgggtgattccattgttaggataataataaagccttctaccctattgtcttttttttttttttttttttttttgagacagagtcttgctctgtcacccaggctggagtgcagtggcaccatctcggctcactgcaagctccgcctcccgggttcacgccattctcctgcctcagcctcccaagtagctgggactacaggcgcccaccaccacaccctgctaatttttttgtatttttagtagagatggggtttcaccatgttagccaggatggtctcgatctcctgacctcatgatccaccagtctcggcctcccaaagtgctgggattacaggcgtgagccaccgcacccggccaaatactctttttttttttttttttttgaggagtcttgctctgtcgcccaggctggagtgcagtggcgtgatctcggcttactgcaagctccgcctcctgggttcacaccattctcctgcctcagcctcctgggtagctgggactacaggtgcctgccaccacacccagccaatttctttttcgatttttagtggagacagggtttcaccgtgttagccaggatggtctcgatctgacctcgtgatccactcgccttggcctcccaaagtgctaggattacaggcgtgagccactgcgcctggcctgttgtcttttaagtacacatcatgttgaaaaagattattcagtaacttacaaaaatttaattattattattttttgaaacagggtctcactttctcactcaagtaggaatgcagtggtgcaaacacggttaactgcagtctcaacctccagagctcaggtgatcctccaacctgagtctctggagtagctgggactacaggctcctgtcaccatgcccagttaattttttgtgttttttgtagagcccaggctgatctcgaactcctcggctcaagttacctgcctgccttggcctctcaagtcatgagttacagacatgagccactgcacctggacttattagttttttttgagacaaggtcttgttttatcgtccaggttggagtgcggtgacacaatcacggctcactgcagtctcacattcctgggctcaagtaatcctcctgtctcagcctcctgagtagctgggaccacagccgtgcaccaccacacctggctaattttttattttttgtagagacagggtttcactatgttgcccaggctggtgtccaactcctgggctcaagctgttaccgaatggaaagtcttgattgtgagttgtccaggttcttggcacgttgaacaaagaattgaacaaaatgcacaaagcaacaaaagaatgaagcaacaaaagcacagatttattgaaatgaaagtacactccacagagtgggagcggactcaagcaagcagctcaagagccccagctgcaatgttgtttagggtttttattaaactaaaagaattttgcaacatccctaggtaccctttagaggcttccaattgcttacatcctatgccaatgaaggatttgcccacaaccaatcaaaggctgaagtgaaggcttggccctctaccaattagaggcatttactgtttgtgacctaagggagaggggattttgtagagggaggagcctctggccccttatcacttgggcatggagaggtggggttttccttctggtccagttccaagaagtctgctgcaggttggccttaggctccctgtctccagaccctgttctcctgcctgaaagtggtggtcccacttcggcctcccaaagtgctgggattataggtgtgagagaccgtgcccaacctaattgtgtatttgagatagggtcttactctgtcacctaggctggagtgcagtgacacaatcatggctcactatagccgtgacctcccaggcccacatgatcctcccacctcagcctcccaagtagctgggaccacaggtgcgtgccaccatacccagctaatttttgtgtgtgtgttttgcagagatggggtctccctatgttgcctaggctggtctcagactcctgggctcggcgaaccccctactgggcctctcaaggtgctgggattacaggagtgagctaccatgccaggcctcaaaaatttagatagtggaacttttgcttcttcttgacattgagagaggtttgaaattatttgactttcagcacattgtgaattcaataaaataattttttgaggtgctaaaaagaaacaactcagaaaatggccccactacatcctaaggatccaatgcatcctcaattgcattgagttgcaataaattatcccatgtgtcttggcattcctactttttgtctctgaaatacaaagtattaggttgttatgatcataacttaacagacaaaaatttcctgaaccacaattgatacaattagtacacaattgaaagaggagggtcattggccgggcatgctggctcacgcctgtaatcccaggactctgggaggctgagactggcggatcacgaggtcaggagatcgagaccatcctggctaacacagtgaaaccctgtctctactaaaaatacaaaaaattagcctggcgtggtggtgggcgcctgtagtcccagctacccaggaggctgaggcaggagaatggcgtgaaccccggaggtggagcttgcagtgagctgagattgcatcactgcactccagcctgggcgacagagcaagactccatctcaaaaaaaaaaaaaaaaaaaaaaaaagagggtcattatataaaatttgaaacaaagaaaaaactatgatcacaaaatgcatctctttcattgaaaaaagagtgatatttaagcacaaatctctctcaacttcagaaggtcccaacttcaggtaggtaggcattgtaaactcatgtgtaacctatttactcccttatgttttttttttttaaatcattttccttctccaccttccagaaaaaaaagtattcactcaaacttttattgatgggtgggtgtggtggctcatgcctgtaatcccaacactttgggaggctgaggcagggggatctcttgaggctaggacttggagaccagcctgggcaaaatggtgaaacccctctactaaaaatacaaaaattagctgggcatggtggtgcacacctgtaaccccagctactactcgggaggctgagtcatgagaatcacttgaacctgggaggtagaggttgcaatgagccaagatcgcgtcactgcactctagcctaggcgacagagcgagactccgtctcaaaaaaaaaaaaaaaaatacaattcagctgggcacggtggctcacgcctgtaatcccaacactttgggaggccaaagtgggcagatcacttgaggtcaggagtttgagaccagcctggccaacatggtgaaacctcatctctcctaaaaataaaaaagttacccggatgtgtggcatgcacctgtcatcccagatactcgggaggctgaggtagaagaatcacttgaacctgagaggcagagcttgcagtgagcagagattgtaccaccgcactccagcctgggtgacagagggagactctctcaaaaacaacagcaacaacaaaaaaccaaacacaatttactgggagcttgcttatgctaggtacagatctgtgtgctggggacaaaataagacaagtcttcccaagtattgcactgttttaaattttcccctgatacttaagtttctccctagcctttgttgttttcattgtccttctgtggccactttccagctgcattaactcttctttttgtgttcctcaatattaacagctttattgagatataattcacataccatataatacacccgtttaaattatacaatttagtagtttttagtatactcacagagctgtacaaccattcacatagctaattttagaacgttttcttttcctttttttttttttttttttgagcagggtctcgctttgtcacccaggctggagtacagtggctcactgcagcctcgacctcctgggcacaagtgatcctcctacctcagcctcccgagtagctgggactacaggtgtgcaccacgatacccagttaatttttgtttttatgttttgtagagatgggatctccttatgttgcccaggctggtctcgaactcccgggttcaggtgatcctcccgtctcagcctcccaaagtgctcagattacagccatgagcaatcacacccggcctagaatgttttgttttgttttgttttgttttttgagacagagtcttgctctgtcacccaggctggagtgcagtggcgtgatctcggctcactacaaactctgcctcccgggttcacgccattctcctgcctcagcctcccaagtagctgggactacaggcgcccgccaccgcgcccggctaattttttgtattttttagtagagatggggcttcaccgttgtctggatctcctgacctcgtgatccgcccgccttggcctcccaaagtgctgggattacaggcgtgagccaccgcgcccagcctcctagaatgttttcattaccccaaaagaaacctgtgtctagtagcagtcactccatttcccccctcctccttcagagaccttaatcactactctactttctatctctatggattggcttattttggacatttcctgtaaatggaatcatacaatatataatctttttgtatctagcttttttcacttagcattattattttctttttcttttcttttcttttctttttttttttttttttgagacagggccttgctctgtcgctcaggctggagtgcagtggcgcaattttggctcaccgcagcctcaacctcctgggttcaagagattctcccacctctggctcccgagtagctgggattacaggcgtgcgtcgccacatccggctatttttttttttttttttttttgtatttttagtagagatagggtttcaccacgttggccaggctggtctcgaacacctgacctcatgtgatccgcccgcctccgcctcctgaagccttaggactacaggagtgagtcactgtactcagccagccgcatgatgttttcaaggttcatccatgttgcagtatgtatcagtacttcattccttttttggtctaataatattccactgcatagagagaccacatttcctttaaccatttctcagataatggacatttgggttgtttttactttttgactattatgaataatgctgctaagaaccattagcatgtacgtttttctgtggacctaggttttcatttctctcgggtatacacctaggagtggaatttctgggtcttatggtaactctgtatgttttaacatttttgggccgggcgcggtggctcacgcctgtaatcccagcactttgggaggccgaggtgggcggatcacgaggtcaggagatcgagaccatcctggctaacacggtgaaacccgtctctactaaaaatacaaaaaactagccgggcgcggtggcgggcgcctgtagtcccagctacttgggaggctgaggcaggagaatggcgtgaacccaggagacggagcttgcagtgagcagaaatcgcgccattgcactccagcctgggcgacagagcgagactccgtctcaaaaaaaaaaaaatttttttttttaagaattgtcaggcattttcatagcagctgcatcattttacattcccaccattcatgtatgaagattccaaattctccacatcctcaccatctattttctttctttttaatgttacccatccttgcaggcgcacagcggtatccatggatttgatgtgcatttccttgatagttaatgatgttgagcatctttcatgtgcttattaactctggaggtagacctgccaggccttttctaatgagggacaaccatggctttgtaccccaagaacatttttattgagttgctttgtgtctagatcattaggagaattaattaatactttctcttccaatgaagctcagctgcgtcctacatcgtgaatgaaaggctttctgtacatttttccaaaaaaaacctaggactattatggataagaagtgacattatctgagcagcacttgaagcaagagaaatacatactctgatgcattatttcagtctaaggaagtggcctgccacgcactctctctctctccgtgtgttttaatctaatatagcacaacttgtcgaagcaaatctataatgtatataaataacagaacagtcttaggtcctcatgaagagcgaactgacttttttatgtttaaaatcttaaatactggttaagttagaggtgagattaaaaagtgtaggaaaatcggctgggcccggtggctaatctcagcactttggaaggccgaggtgggcggctcacctgaggccaggagttctagaccagcctggccaacacagtgaaaaccagtctctactaaaaatagaaaaaattagccgggtgtggggcgggcgcacgaagtcccagctactagggaggctgaggcaggagaatcctttgaacccgggagacggaggttgcagtgagccgagatcacactattgcactccagcctgggcaagagcaagaccttgtcaaaaataaaaaaaaggtgtaggaaaataaactgtcatccagtacagctgaagaaatcgataccttaatttacaacctcagtttctctgtccaaaggcaattccaagactcgagcaaattcttttattatgctacgattttggttattttgaatacagcttttcaaagagcccttgggatttgagagcccttggttttctaagtgttttcaataagtcttgtttttaaaggccgcgtcctagcgagtgcagctgccgctccttaccggacccacgagtgaggagccccgaggtcatcaccgagcatgaacgcgggaacgtctgggaaggaaatctgaggccctgctctgacggtcataacaaaggccttcgagccaaccggcgtgttcaaattcaccacggcccttcccgcgctcccctccccggaaacttgaccacctagcccagaaagccgcagcagcttcctcagggacgctatctcccatttcaaacacccaaccgagaaagcagcgccg

SEQ ID NO: 83 - DNA, 4182 bp, Homo sapiens
cgaaaggctcagagctgccaggcataacagggcgcactcacctactgagtgtacagctccagagacactgaggagtttatggaaaatgacagcatcccactacaccacagaaaacatacccaatccattctactgaaacaggtacagtcatgtgtcgctcagcaacagggatacattctgagaaatgtgttgctagccaattttgtcactgtgttaacatcatagagggtacttacacaaacctagatggtataaccacacacccagactatatggtataacctattgctcctaggctacaaaacctgtacagcacgttaccatactgaatactgcaggcaaactgtgacacaatggtaagtgtatctaaacatgtctaaacacagaaaaggacactaggagaccaggtgacaggaatttttcaggtccattagaatcttatgggaccaccatcgtatatgtggtctattgttgactgaaggtcattaagtgacagatgattgtttcaccaatacccaaacagtaaaacagccaaagtcttttggagttttctgcaatattcattttattccatgtaaaagaatgattttggcttagaagtaaaattataagacactgttttgttaagagtgagttacctggattccaagaaaactgttccatgtttcttagacacactatcagtaaaagcacataatttgtgaatcgttccttaatatctaaaagaaaaaaaatcaacataagtactgtagtgtatataaacaacataataaagtacatatataattattttagccagaacatgatgaaattattagacgatgtataaatgtctataaatatacaactttatatatatatatatgtgtgtgtgtgtgtgtgtgtgtgtatatataggctggtgctaccatggtaagccattgacttcttttgccaacataattctagtatggaaattccagttttctataaacttcaaaaagtattcaaaccatcaaactgctcagatgaggtcattaggttcctccaatgggctttggggacatatgacaactgtttccattttacggaagaaaaaatagaagcaaagagtaaaatgaaagactttgggtaacaaaatccttgtataaaatcccagactatttccaatctggtaaatagtacacaattactgaactgatgagtcctttagctgagagaatcctgctactacaatagcatttccgggggtgtatgtagaacttgaggtaaaataaccccaaattgggcttcataatatttaccataaactaataactgtgtgctgagattaggtggaaggaatttaataaaagcaaatcactgaattcttgctaaaggccagtgtacacatttcactttttaagctgttaactttctcatagtctaagataccgtgtaaccaagaaatgggacaaaataaatttgtctgcagttaagagtggcacacccatgtatgtgtgccgatgcaatagtgggggctgtgactagaaacaatcactcatataacaacccatctcaaaagcttttttacagtctgctgtcatttccctactttcccactgcctcagtaaatgcaagcctcacccatatcattcagccatggcgcacctcctgtaagcgctctgaatttcaatttcatcctgatgtacttcatgggactgtctttgcttctctttttttacttccacctttccccattattctctagcaacatgatacaaacttttattccacagcaaaaccttattctctgtaagcgagttggcctttattctctgtaccttccctacatccttaagctcttccagtcagttgctggtaccttctttttcagggtagctcacctccttattagtgatgggtctgagctgtgccttcactccctcaaagcccagtgggcactactcacttcctatttccaaagctgaagcactatttattatgagtgtgagctcagggcacagtgagtctcaaggtaccaagcactgagatgcctctttaggaggcagggcacctccggagcaaggccatgtggattttcaggtgcacctgttttgatttgtctagatcacatgtttaatttattctgtgacttcaaaagaggatacaggttaaaggaaactaagaaaagtctgccctagaataagttccatcaaagtctgacacaaaatatattctttgttactacagctaactgtggatcttaattcatggggttaaatttaccaatgtatctttaattggaattctgtagaattattcaccaagctgtacctatatgtgtgctaagtcctttctaatttccataaatgaatttaacaatgaaatgtatttatttttgatacttcccaaacatgtataatatagacttgcttcattacagaattatctgaaaataaatggccttgagaaatttaaaacactatctgaaatgagccaaagtaacttttgtaaactctaacaaagcaaaactaccatcgaatttaaattaattgtatttgatttttggacatatggcagctgcaagtatagagaaaatctgcaataatttcatttctaaggatactgatgaaagggggaaaaacttatctcattaaaggtgtatttaaggcaaaacagattttattttttaagatttttttatttttttgagacaagagtcttgctttgtctcccaggctggatgcagcctccacctcccgggttcaagcaattctcctgtctcagcctccggagtagctgggattacaggcatgtgccaccatgcccggctaatttttatatttttagcagagacagggtttcaccatgttggccaagctggtctccaactcctgatctcaggtgatccgcccatcttggcctcccaaagtgttgggattacaggcgtgagccactgtgcctggcccaaaacaaattttagaaaagcagactatttcaaaatatgatagagattaataaaaatggataaatttggtaaatgaatgcgattttataagatgaaggatgtgaaggatggcaagcttaaagattaaaaagtgacaccataaaaattaactctatctttatttgataagataaagatacaaaactatatctaactataaaaatgaggctgttatgtgaagattttttggaagttttattcttacactttcacaacttttacatttaaatgttttacatagacattataaaatcaagatttgacttttaaaatttgagttaaaaaatacccaaattttaagtttctccaaagtaagatataaaaagaaataaaatttttatgagaataacagagtctgatactgataatcaaacatatattagataaataatgcaatcagcaacatatttataccatctcatcttcagaatagtcagggttcggattagaactgaactcttacattgattaaaaattaaaatttctaggaatgttttctcctaacctttattaagaagcttaaaaacattggtattaatgcttttaaaatatttctgacattcaggttattaagctttttccttgctatattaccactaacagggatatactttaacatacttgcagtcacattttaaatataaaatgagtgactatttccaacaaacatccacatttattgcagatatgcaggcttctaagagtgctaagtgagctataagcttactccagacaacctaactcctgaaggacctttctaaatgcacagttcacattaccaatgcgtaaaaaactacctaaaattcttcatctcaagaatgcaaaccagaaaggctggggttccacattcagctaacgcttatgttaaaatgaagtgaagaaaaggataatttgttaaaaatctggttttggtaactaaactacttttcacatgtcctcaggcaattcctccaaagaaaatatacagtgagctaccactgaaaggggtaaagttactctcagatttctccatgaagtcttctatattaaaccagcatgaaggactgaaccttacactacgtatctggcaactcaaattctgatggagaaaaaattcataggaaaattcataagaaaaaaatagccgatatgagtatccctcctgactggctctcattaagtagctactactgaagcatatgaagaaggcaacatattcatataaagagtaaaaa

SEQ ID NO: 84 - DNA, 111758 bp, Homo sapiens
atgaggttcttgctatgttgcctaggctggtcttgaacttctggcctcaagaaatcctcctcctgatcctcctacctcagccttccaaagtgttgggattacaggtatgagccaccacacctggcatcatctgtatcatttgtaatatactttacaataaataggtaaacgtgtaagctatttctctgagttctgtgagtccctctaggaaatttgagatggatgctcgctctgtttcccaggctggagtgcaatggcacaatctcagctcactgcaaccttcgcctcccaggttcaatcaattctgctgcctcagcctcccgagtagctgggatcacaggcacccaccaccacacctggctaatttttgtatttttagcagagacgggggtttcaccatattggttaggctggtcttgaactcctgacctcagacaatccactcgcctcggcctcccaaagtgttggaattataggcgtgagccaccacacccagcctgatatttttagtacctagacaaatctgaggcaaaggtttcctgaggcaaggcagggcatgaacagaagtgggtatcagagagcagtgagcctctgtgcatcttatccctggatctgtttcaacatcaagcttcttgttttatggattaaaaaaatatgtatgtgacaaaggactttaggaccgatacaacaggtataaattactctaagttttgagggggagaaggtgtcacatttctagatttgtctaaatcacgtaaaccctggctccgggtctctgctcaccaaggtccctgagaagcccaatgacagccacatgactggcctgctttgcaatcccggggcttccacacactataataatatagggagagaggaggctgcgaggcatctgtccccactgatcacaccactctgctacaaatgcagaggtcaggtcctgttccttcaatgtcctttctggcatctctgcttccagtgacaccagagacatgcctcacaacacatctttccctcacttggatcagcactgtgtcccaaggcccctcccttggccccctgaagtcactgaatttagtgtccaggctctccgtagtcgcccccacacaacctctccaaggtcctgtggtcctggagtgatgtctgagagtagactgcagcctccatccctgctgcagcctaaagcctttgccctcgccttgcagcatgggatccagccccctggtaacaggtcagtccttctcctttgccctcagaggacaaatgcctccattctctttcccactaaacgcgctgtccgatagggtgaccatgagtgccatgcgactattcctggagcagctgacatgtatctagttcaaattgcaacatgctgcaagtgtgagatttacaccatattctggggacttggtacaaaggaaacgtaaaatatttcaataatagtttttatatcacaaacatgttgaaataatatttttaaactattgggttgaataaatatattatgaaaattaatttcacctatttcattttactctttcaagtgcttactagaaaatttaaagttcacacgtggttcacattatatttattttggacagcagcactctctgcccagtgcctttctccccacctcagaatgaaaagctaggggaacaggagggagcatgtgcagggaagccccctcccatcaggcctgaagtgcaagtaggcctgtccctgttcctgcctcactcttcctggaaagcctggatctctgcatctgagcaccttgctgccctggtctgttgcgagcatgtcaaggaggtaaacagggttactacattgtgagccaatgtcttggtcttatttattgttaatgttctctctggttttacagatgagggggccaaagcccagagaggacaagcgacttatttcttttttttaatttttttattttattttatttttttattttattattattatactttaagttttagggtaatgtgcacaatgtgcaggtttgttacatgtctatacctgtgccatgttggtgtgctgcacccattaactcgtcatttagcattaggtatatctcctaatgctatccctcccccctcccccctccccacaccccacaacagtccctggagtgtgatgttccccttcctgcgtccatgtgttctcattgttcaattcccacctgtgagtgagaacatgcggtgtttggttttttctccttgcgatagtttgctgagaatgatggtttccaatttcatccatgtccctacaaaggacatgaactcttcattttttatggctgcatagtattccatggtgtatatgtgccacatttgcttaatccagtctatcattgctggacatttgggttggttccaagtctttgctattgtgaatagtgccccaataaacatacgtgtgcatgtgtctttatagcagcatgatttataatcctttgggtatatacccagtaatgggatggctgggtcaaatggtatttctagttctagatccctgagtaatggccacactgacttccacaatggttgaactagtttacagtcccaccaacagtgtaaaagtgttcctatttgtccacatcctctccagcacctggtggtttcctgactttttaatgattgccattctaactgatgtgagatggtatctcattgtggtattgatgtgcatttctctgatggccagtgatgatgagcattttttcatgtgttttttggctgcataaatgtcttcttttgagaagtgtctgttcatatcctttgcccacttattgatggggttgtttgtttttttcttgtaaatttgtttgagttcattgtagattctggatattagccctttgtcagatgagtaggttgcgaaaattttctcccattctgtagcttgcgtgttaatgctgatggtagtttcttttgctgtgcagaagctctttagtttaattagatcccatttgtcaatattgtcttttgttgccactgcttttggtgttttagacatgaagtccttgcccatgcctatgtcctgaatggtattgcctaggttttcttctagggtttttatggttttaggtctaacatgtacgtctttaatccatcttgaattaatttttgtataaggtgtaaggaagggatccagtttcagctttctacatatggctagccagttttcctagcaccatttattaaatagggaatcctttccccattgcttgtttttctcaggtttgtcaaagatcaaatggttgtagatatgtggcattatttctgagggctctgttctgttccattgatctatatctctgttttggtactagtaccatgctgttttggttactgtagccttgcagtatagtttgaagtcaggtagcctgatgcctccagctttgttcttttggcttaggattgacttggcgatgcaggctcttttttggttccatatgaaatttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttctggttctccttgaagaggtccttcacatcccttataagttggattcctagatattttattctctttgtagcaattgtgaatgggagttcactcatgatttggctctctgtttgtctgttattggtgtataagaatgcttgtgatttttgtacattgattttgtatcctgagactttgctgaagttgcttatcagcttaaggagattttaggctgagacaatggggttttctagatatacaatcatgtcatctgcaaacagggacaatttgacttcctcttttcctaattgaatgccctttatttccttctcctgcctaattgccctggccagaacttccaatactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaagttattgagagtttttagcatgaagggttgttgaattttgtcaaaggccttttctgcatctattgagataatcatgtggtttttgtctttggttctgtttatatgctggactacatttattgatttgcgtatattgaaccagccttgcatcccagggatgaagcccacttgatcatggtggataagctttttgatgtgctgctggattcggtttgccagtattttattggggatttttgcatcaatgttcatcaaggatattggtctaaaattctcttttttggttttgtctctgccaggctttggtatcgggatgatgctggcctcataaaatgagttagggaggattccctctttttctattgattggactagtttcagaaggaatggtaccagctcctttttgtacctctggtagaattcggctgtgaatccatctggtcctggactttttttggctggtaagctattgattattgccataatttcagagcctgttataggtccattcagagattcaacttcttcctggtttagtcttgggagggtgtatgtgtccaggaatttatccatttcttctagattttctagtttatttgcgtagaggtgtttgtagtattctctgatggtagtttgtgtttctgtgggatcggtggtgatatccccattatcattttttattgcgtctatttgattcttctctcttttcttctttattagtcttgctagcagtctatcgattttcttgatcttttcaaaaaaccagctcctggattcattaattttttgaagggctttttgtgtctctatctccttcagttctgctctgattttagttatttcttgccttctgctagcttttgaatgtgtttgttcttgcttttctagttcttttaattgtgacgttagggtgtcaattttggatctttcctgcttcctcttgtgggcatttagtgctataaatttccctctacacactgctttgaatgtgtcccagagattctggtatgttgtgtctttgttctggttggtttcaaagaacatctttatttctgccttcatttcattatgtacccagtagtcactcaggagcaggttgttcagtttccatgttgttgagcggttttgagtgagtttcttagtcctgagttctagtttgattgcactgtggtctgagagacagtttgttataatttctgttcttttacatttgctcaggagtgctttacttccaactgtgtggtcaattttggaataggtgtggtgtggtgctgaaaaaaatgtatattctgttgatttggggtggagagttctgtagatgtctattaggtccgcttggtgcagaggtgagttcaattcccgggtatccttgttaactttctgtctcgttgatctgtctaatgttgacagtggggtgttaaaatctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacattcaaagttaatattgttatgtgtgtatttggtcctgtctttatgatgttagctggttattttgctcgttagttgatgcagtttcttcctagccttgatggtctttacattttggcatgtttttgcagtggctggtaccggttgttcctttccatgtttagtgctcccttcaggagctcttttagggcaggcctggtggtgacaaaatctctcagcgtttgcttgtctgtaaagtattttatttctccttcacttatgaagcttagtttggctggatatgaaattctgggttgaaaattcttttctttaagaatgttgaatattggccctcactctcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttgttgaggagtatctttgtggcgttctctgtatttcctgaatctgaatgttggcctgccttgctagattggggaagttctcctggataatatcctgcagagtgttttccagcttgtttccattctccccatcgttttcaggtacaccaatcagacgtagatttggtctttccacatagtcccatatttcttggaggctttgttcatttctttttattctttttttctctaaacttcccttctgacttcatttcattcattttgtcttccatcactgataccctttcttccagttgatcacatcagctcctgaggcttctgcattcttcacgtagttctcgagccttgacttttggctccatcagctcctttaaggacttctctgcgttagttattttagttatccattcgtctaattttttttcaaagtttaaaacttctttgccattggtttgaatttcctcctgtagctcggagtactttgattgtctgaagccttcttctctcagctcctcaaagtcattttccgtccagctttgttctgttgctggtgaggagctacgttcctttggaggaggagaggcgttctgctttttagagtttccagtttttctgctctgctttttccccatctttgtggttttatctacttttggtctttgatgatggtgacgtacagaagggtttttggtgtggatgtcctttctctttgttagttttccttctaacagacaggacccttagctgcaggtctgttggagtttgctagaggtccactccagaccctgtttgcctgggtatcagcagcggtgtctgtagaacagtggatcttggtgaaccacaaatgctgctgcctgatcgttcctctggaagttttgtctcagaggagtacccagccgtgcgaggtgtcagtctgcccctactgggggatgcctcccagttaggctgcttaggtgtcaaggatccacttgaggaggcagtctgcccattctcagatctccagctgcgtgctgggagaaccactgctctcttcaaggctgtgagacagggacatttaagtctgcagaggttactgctgtctttttgtttgtctgtgccctgcccctagaggtggagcctacagaggcaggcaggcctccttgagctgtggtgggctccactcagttcgagcttcccagctgctttgtttacctaatcaagcctgggcaatggcaggcgcccctcctccagcctcgctgccaccttgcagtgtgatctcagactgctgtgctagcaatcagcgagattccgcgagcataggaccctccgagccaggtgcgggatataatctcctggcatgctgtttttttaagcccgttggaaaagcacagtattagggtgggagtgacccgattttccaggtgccatctgtcacccctttctttgactaggaaagggaactccctgacgccttgtgcttcccgagtgaggcaatgcctcgccctgcttcggctcgcgcacgttgcgctgcacccactgtcctgcacccactgtctggcactccctagtgagataaacccggtacctcagatggaaatgcagaaatcacctgtcttctgtgactctcacgctgggagctgtagaccagagctgttcctattcggccatcttggctccaccgcgacttacttcaagtcacacagattgagttacaagagggtggcacatccatggctcttgccatcacaccacagtatccactgcagtcccaatggcaagagaaagtggcaggcagagtcagacaggaaagaagtgccgacgacaaggggcgaccacacaaccctgatttttgagaatgctactgggatgactgtaggtatctgtggcccgtgacgtgagtacaccccagctccatcctaatcttgaattctttgtccttcacttacatttttcagaccctcagtatttaagtcttatttctatgaaagatattttggtgatggtagcatgggttttttttgtttattaaatttattatatatatatatgtgtgtgtgagtgtatatatgtatatacatatatttcaagtatatatatatacacatatatatatatcaagtgtctgatcctcatgcacttgcaaatgctttttgtgagctgttttgctgtcattttaactatatatatatatagttgaaaactgcttcaaatcccttgtgagacaaggcagagtaaaaccaaaccagtgcacacaaatttcaataatttctgtgctgtcccctttggtgttgtctcatgaggtgccccagaaagaaggctgaggaaggagtgcagtctctcacacagcacacagcagcacacagccagcgaatggttcttccccagggggttggatacctgtcttttaataaaatgcagaccagcctcagggggcaaggtggtgagagactttggtgggcctgcagagatgtggaaagacacaggatcagttcaaatctctgcaagctcctgttaccacttaagtttcttcccacactttcttcctccttgggggataacattgcttttctgcatcagaaactctaggagaagaggattgtatttcttggtggaatttcacaaagacttgggtctacctttaccctctttcttatctgcatccaacaatagagattttgcaaacagccaaggatgtcttttaagactgtaatggagatccatggaagctcccgcttgcttccttccttcgtcactaccaccacagcacaggacatgcaggaggccatagaccccagacccctctcgtgttcactggagtagagaaccccatcatggaacagtccatgatgtttgattagagagagctggtttttgctgtatttgcccttcattaagaattttccaggacaatgggttgaatggatgttcatggaaggcagataaatgatctaatgaaaacttagttatctcatcttttaaaaggccacagagtcatgctcatgatggccatttttttgagcatctactttgtgccaggaattgggctaagccattgtcttgcatggcagctttctttgttggagtgtgtctttcatgtgtggcttgcctcgctcttctgagaccagatgtcagccagccagggtagacacctcacttgacaggaatgagcatcatgttttgtggaacagctgccctccagggaagccaggtctgcgtcttacataatgggtttgtgtgtgtgaaatttgccaggtgttgattttggaagtcagggatgaaagtcagggatggagagggcaggactgccactcacaagagtgaaagaataattcaaaaatctaaatgtgggaaggaagagggtgagaagggagaaaaaaatagagaagtcaacaagagccttggcagggggtgaagtccgcagtgaaaatcccatggtgccaaaatggccaaaggatgctttaaagacaaaaatgttctaatgtttaatttcaaatggtttgtttttccatgatgcaaacccattcttcatctccctcagtctcccctccaaatattcaatcaagtgtctgatcctcatgtacttgcaaaggctttttgtgagctgttttgctgtcattatcatcatgtgggaattgaagaagggtttgaattccacatctggatctagatgaggcagaaccctgtttcagcagaagcagcaccttagaagtagatttggctgcaatgatgtaattgtcccccagttttgaaaataataatggtggaaagctctggatctttatagatagtgaaatacaggttccaatcttaccaagatttcaagagtctggaagattccagcagacatttctgtctacatgttattaatttaggctttctttttctctctttctctttctctctccctttcccccccccctctcatcttaagcttgtatacaggaatccacatgtaaagctacaggtaggttgagaaagattttataaaaactctctccagggaattttgcccaccaagaggccagggaatgggtggcgtaagacaggagtaggtggcgaacacactgtctgttcctttaataagacaaagggcgaggctggacacggtggctcatgcctgtaatcccagcactttgggaggccaaggtgggcagatcacctgaggtcaggagttcgagaccaggctggccaacatggcgaaaccttgtctctacaaaaatacaaaaattagccgggcgcagtggcgcatgtctgtagtcccagctactccagaggctgaggcaggagaatcacttgaacccaggagggagaggttgcagtgagccgagatcgcaccactgcattccagtctgggcgacagagcaacactccatctcaaaaaaactaaaacaaaacaaatagaacaaacaagacaaacagtgagttttctattacatactcaatttctggtaggaagcccctacaggagatgtagcaacaaataagttagtatgtatgcacaatgtgtatacatactttatctcaaattcacacaaaaaaaattgtattcaaacttaagtagaccataccagcaaagtagttgatattagacttcagctcaggattagtcatgtaagtctttcaacaattccatctattacatctcatgccaagggttattcagtgtcttttactactcatataaattgtctttaccaatatgttcctttgcattcagccctgttaacccctgggttcccatcgcattttactgtgtcccagccttagaaatgcaccgttatctttatgcctgtgttagcatctaatctggccatatatatttcaggctttcctggctatacttgagtgattggtgtgtctaccagaagcttcctgataaaatactgctttctctgctatagcagacttatagtttacttttaaaataactcacttgaaatttaacaggcagttttaaagctacatctgatttaagccccataagttctagcttttaagaacacgcttgacttgccaacctggggttttctgagctgttgagtggaaacacaggcttgccattgtattgtgcattgtggctgtgttcactgtggatataaaaacaaaactaaaaaagcaaacctgggctggcctgttaataaacttggtgacgttggataaacaaccagagaatgcctgaaactagggatgaaatctttcagtttatagatgaggtgtttaagtggtgctctcagtaaagaaggggaagaaaatgcaaatcctttaagatataagcttattatagccagtgatttttttttttttttttgagacggagtcttgccctgttgcctaggcttgtgtgcaatggtgcagtctcggctcactgcaacctctgcctcccaagttcaagcaattctcctgcctcagtctcctgagtagctgggattacaggcatgcgccaccacgcccagctaattttttgtatctttagcagagatggggtttcaccacgttggctaggctggtcttaaagtcctgaccccgtgttcttcccgtctcggcctcctaaagtgctgggattacagatgtaagccaccatgcctgacctatagtcagtgatttttaaaaatcaaagaaataggctggtgcggtggctcatgcctgtgatcccagtactttgggaggccgaggtgggcaggtcacaaggtcaagagatcaagaccatcctggccaacacggtgaaaccccgtctctactaaagatacaaaaaattagctgggcgtggtggcgggtgcctgtagtcccagctacttgggagaccgaggcaggagaattacttgaacctgggaggcggaggttgcagtgagccgcgattgcaccatggcattccagcctggcgacacggtgagactctgtctcaaaaaaaaaaaaaaatcgaagaaatcactggatcaataatatttattgtcttggcaaatcatagcatcctcatggagggaaagaaaaggggctagacaatcttcagcctcacaagcaaagccctgagcaagaaaccttcacgaattctttcccgtgtttcataacaagtctgtgccgaaggcatcaagatctccattttacagatgaggaaactgggacttaggaggcacaggtggagtacgttgcaatccacctaaatccctggatcccaagcccatcctcctgctgtgtggccactcccccacacttgcctggtacttacggtttagtctttgtagactcccgtggacaccccttgcaaactcaggaaacccccaagcagtgcacacacattcctaaaagtgtctcataatttagccttttatcctcatcaggacttgtcaaactcctggtcttaagaaacaaagcaaaactggctttctgctaggtcatttttgcagagcagcatttgttttctatatatcattggttttctagcacttcctggctgctcacagcattctttctgtcattcctctttaagattccactttgatttctcccatggagaaaaatgttgcttttaaaagtcacagaaaaaaaaaccctattctgatatggccttgatttaaaattgaggaataatttgcaaagctcctgttggaaagaggtggatgctctcatgctctccttgtggttctgttccctgatacaactattttgcagaggaatcgtgaaaaacctttaaactttgtcattaattatactttcagaaatctttcttaaaaatgatagtttcaaaggtagaaagaatttcatgagtgaagagactcactactgtgttgtttttggtggaggtgaaaaaaggggaagaatttaactgtctaaaagctagatataatgtatctactaatgaatattatggaactattaaaaatgatttttatggaagttcaactttcatgtgaaaaaccgaatatatatatttacatgtttcttctccaaatctcactaaaatgatagtaaagggatttaaacaagcataagaccatgcattccaagagaataaaggaagagactaaaggagatgagagacggcagcacagcttagaaagctggacagcaagttgactgttggtaatgagttatgtggctgagaaagctgagccctaagtgcccactgggatgaagataagaaggaaacagatccaattcagagagccctggaagacctcagggactcaaggcatcaggcagcatcgaggggaaagaatgtgtggaactgaaaggaaggagtgcgggtgagttttcatggaagcagtaagcctggatattttccccaaataggcaattctcccgaatcacctctgcagaagatcagaggtttactctcagcaaaaattaaaccagacaaattccagatttagggacctgagacataaaataggaacagagaggagcctcgtcagaaagaaaaaaacagagactgagtgggagttaactaacatactgtactgtgaaaatctcagcctcctcttcccaactgtgcgaagaatgctagcaggccagctcatagcgcctgacagtacgctgaagaattctctaggtagcaactaggaagtccctctcttcccccaaatctgcagattttgatgggggaatcgtacataatgaccaggtccaagtcctgtcactgtatggtgaagttcactacttggtaagcctgacccatacgcagaaggcccaaatggttttttaatggcccattctcaaataagaacagatgggtaaggatcacctgacatttgcagaaagcatataatatgaaagttaggcgccaaaacacgctgtcaacaaaaagaaatagaaaacaaacaatgcggcaaatgaagaaataaaaaacgcccccaaattaataatagttacttaggaaggtaaaacaagatattatacttatgaaaaaatttaaaggaatatttataaaattttacaaagaacttctcaaagtcaaaaatatgagagtagaaatattaaaaattcaacaaaagtgttggaaagtaaaattgaagtaatctcccagaaagtagaacaaagagagaaagatgtatgagaaacacaggcaggttccaaaaagaggggacagaaaaaaaaggagggatctatggaaatagggtaagaaaatttcccaggttttaaagggcacactatgaaggttttttaaaatgacctttatcaagtcatatttgaatgaaatttcaaaacactggagataaaggatactgaaatctcccaaagacgaaagcgtgctcaggcagaggattagggatcagaatgacatcagacttctcaatagcaacacttgaagctaggtgacaaaagagtaacttcaaattcagagtggaaatgaatttcattccagaattccgtatctagaaaatacttattaaaacgtggtgctggaataaagacattttcaggtgtgcaagttctcaataatcttacttctcctactccctttctgagaagaaagtgattcacaacaaaaaaggaatacgacaagaagttgggggatgtgaaattctggaaagggtcagttacccagaggagcgatgatatagtttggatatttgtccctgcccaaatttcatgttgaatgtcaaccctgataggggcctggtgggaggtgactggctcatggtggtggatttctcatgaatggtttagcaccatcctctcagtgctgtcctctggatagtgagctcttgtgagatctggccatctaaaagtacgtggcacctgtccccctctctcttgctcctgctctggccgtgtgacatgcctgctcccccttcaccttctgccatggttgtaagctttctgagtcctccctagaagccgagtagatgccagcaccgtgcttcctgtaaagcctgcagaaccataagccaattaaatctcttttatttgcatattatccactctcagatatctcagatatctctttatagcaatgcaagaatggcctaatacaagcagggagaggattcacagggtgatggagaagagacattcagggaggacagttttgcagccaccttggccagctcccagtctagactgagacaaaaggtcagagagctgcagaggagggtcaccaacataaatacaattgacagctgtgtggtattcagagggtttgaaataacatttgtgttgggtgcatagggaattaagcaaattaaatacaaggtaactattaacttgaaggagaataaaaagttacagaaaggagaactaaggagttacaaataacatttatacagaatcagtcagataaacactaatacatagtacaacaagtatctctctgtatctacattggagagatggagggaggggagggtgtgtgtgtgtgtgtgtgtgtgtgtttgtgtgtgtaaagagaatgagagctaaatttctagaaggaaggtaaggtctaaacctgcgaaattaagaagtggcagataagcgttatgagaggctgctgtttgtcctccaatatcagtttccctctgaagatttctcaaatgtgcatctgcaaaggcctggagctccaaactggtgcagaaactgcagaatcttacctattgtggcctcagatgatgaacatatcacaaaagattgaaagaaattttgtgaatgtctgcatagctgaagatctcctgtggattgagggagaaggtgtcccattgatgactacagtgttgagaaatcaacactatgtacagggaattccaagatatatttttatttgatatggcaaaatgagataatgtgatatttcatgaatttcagtattatgatggaaatcagactcactaaaaaaagtaatcacagcactccaactgagagctgtaatagaataaaacaaggagcattgcagaggcaaagaggaagagcccagcccatccttggagtccagtgatttatacacagtactttaagccccagcttggaaaatgctaatcttcacattccagggaatgccattgttatgctgtaaggtaatggggtgaaaataaatagcctcaagagaagttcagataaatgaatgggtggtcatgctagagatgggcattttgagaggatattgaagatgtttagaacaccttttgttgggataggttcacagaagttaaattcctaggtatgttctcctgtcttttaagttaggcagtcaaatggaaaccggtgcttccaaccttccgacaaattagcccttgttgctactatgagttgaaaatacagaatgtcacccactgtgtgccccagaattgtagacttagggttacaagaggccttaggtgttccttccagactggccaggctccaatgagttggtagcttcactttggactaatctaatcatattattatgtgtgtgtgtgtattagtttattctcatgctgctatgaaaaaataaatgagactgggtaatttataaaggaaagaggtttaattgactcacatttccacagggctggggaggccacaggaaacttacaatcagggtgaaaggggaagcaaacacttccttcctcacatggtcgcaggaaggagaaatgcagagcgaggtggggaaaaccccttataaaacaatcagatctcataagaactcactcactatcatgagaacagcatgggagaactgcccccataacctagtcgtctcccacgaggttcatcccaccatatgtgggtattatgggaactacaattcaagatgagatttgggtgtggtacagccaaaccatatcagtgtgtatgtatgtatatataatacatgatattacactacctgtgttatactaaaatatggcattacatatttacactagaagtctctcctgctggaaccccttgtgggcaggaactttcttatcatctggtttattagttccagattgtcaagcagaaacatgaactgtacaaatgggtctttggtaacctcactctgacatactctgctgtctctcctagcccagacatgaggagtctacgtgtttagaaatgcccctctggagaatagatgtattgaaaggaaaagcttcagtaatgaaaataaagctgaagatgagtaaactatatcctgtaaaatggattatctagatccatattactttttgtgtggatatccctttgccataccctggccagtggtgatgtctccttaaggtttctgtttagtatcagctgtgctagggtcatcaagaaaactactgaatgactctgatgaaacctctaacattgccagtaagaaaagtaaggcatagaaggattaagtgtttttcgtggtcacccagaattgacaggaacaaagtctttttcctgcctgttcaatcttcaaattatgaagtttcttatagtttgagataagtagatattttaccatgaagctctagtgcctctgaagctatagtctgagaacattctccatcatagccaattcattcagtcagtggttgccatggttaatactgtagcctatttgattgtcataatttacataaaatatcaaatcaaccaaaaaaacccagatcatttatgttgtggtctagtcacatgcatgaacataaaactcaatctcgtgaccatgaatatgaataaagacaattttccttttggagtggtatcctagcatcagaggatgtccatttgcctggaacacctccaaaagcacctgctgttaaagtaggggttagcaaactatggcccatggaccaaattcatcccactgcctggttttgtaaataaagttttattggaacacaaccactcccacccattcttttacgtatagttcctttcacaaatgacagagttgagtagttacggcagggactaaaatatttattacctggcctttaaagaaggtgtttgtcaaactctgtattagagcatgttttcttgttaggaagcctgggtgcccctctaatgttgactgattttaaattggctacagtctcttttcaatgttacctctctgactacagaaacatcaaggggaaaaaaaccatcatgaacagaagttttcaagtatgactgagcagaattacctggggaacatttacaatagaaatttttggacccattcccagagatcatgattcagtaggtctggagtagggcctgggaaacttactttgatacaaatgattctggtgcacagccaggagcaagaaacttgaggaaagcacatggaagctggaaatgaaacaagcaggaagtgaattctgattcagtcttgctgtgtaaacttgggtgaattgcttcactgagccttagttacctcatctgtaaagtggaaataacaagttttccttcacagggctgttctgaggaccaaagaagacaatagttataaaatgtccagcactgtgtttgcacagagtagacacttggttaatggtcccttctttcctccactggagaatccagtgccttggaaagcacaccagtttgattttcttcattttgtcttgtgtattatgtttccacttctgtttatgttaattttgctcttgtcaaactattccccaatccacaagtccttctccatgtatattaaagctagaggtgtttgattttttttttttttttttttacaaatttgtttctctgggaagcacccagagagctgaatgaccctaaatggcttgttagccatatgactgccaatggtcttgattaattctttaaaacataattaaggccaagtttttaagtacctttagtgattttcttaaaaaccttgatataagatgatagactttatacattcagaagacaatccattggacaaattgagatgaagttttgtgagaatctctttctttagaaatggaaagacttgctattagtttttctttcaatgtctggtagaattaagcagtgaatccatcaagttctgggcttttctttgatgagagactgtttattacacttcagtctcattgctcattattagtttgttgaagttttctgtttcttcatgttcgatcttggagtttgtatgtgtccaggaatttatccatttcttctaggttttccaacttgttggtatatagttgttcctaatagtttctaaggattctttgtgtttcagtagtctcagttgttagtctccttatttatttctaatttcatttaggtctgcgctctgtttttcttaatctacctaatggtttgtcaattttatttatcttttcaaaaaaccaacttttaattttgctgatcttctgtattttttgtctcaatttcatttatttccgctctgatcctttttattttcctttactaattttgagtcagtttgttcttgcttttctagttccttgaggtgcaagattattcagttgaagtctttctacttttttggtatgagtgtttattgctataaattgccctcttagtgctgcttttgctgtatcccacagattttaggatgttacatttagttgtttcagaaatttaaaatttttcttttttaatttctttactgacccattgatcattcaggaacatgttgtttgatttccatgtgtttgtatgttttctggtgttcctcttgttattgatttctagttttattccactgtggtcagaaaagaaattgatatgattttgggatttgttgaggctcgctttgtggcttaagatatggtctgttctggagaatgttccatgtgtggatacaaataatgtgtactgttcagcagttgggtgatttgttctgtaaatgtcagttgggcctatttagtctagtgtatagtttaactcctatgtttctttgttgattttctgtcttggtctctttgtcttaacatcctgactgattgagagtaagccatctataagtaacagacactgtcgacgttttgctcacctgtcctcctgccccctctgaattaactggcagtcctagtagacttctcagcatgctaacatcctcccacttcaagcagcagatcgttcatctgcttcacctgagacctttctcagctccttaggagctttctctccaggagccaaacacaacctggcagtatggggtagtggataataaccccaagtcacctgtctgcagtgggacaatgctgtggggtgttctacttgatgcctcagagggtcaccacaggggttgagtctcagttgcccaacatgtttatctgctctttgacgtactctttactggcttttctttcttccctgtctcagatttctcacttcctcacaggacgtgtgggatcatctcccagatgaactaccagttcctaagtatttgtctgaaggtacgctcttttgaaaatcaaaactaagaccagtttggacccaggacataacagagaccatggtctggctttaaacgggccgctttaaatgattgtatatctagaaaaccccattgtttcagcccaaaatctccttaagctgataagcaacttcagcaaagtctcaggtacaaaatcaatgtacaaaaatcacaagcattcttaatacaccaataacagacaaacagagagccaaatcatgagtgaattcccattcacaattgcttcaaagagaataaaatacctaggaatccaccttacaagggacgtgaaggaactcttcaaggagaactacaaaccactgctcaatgaaataaaagaggatacaaacaaatggaagaacattccatgctcatgtgtaggaagaatcaatatcgtgaaaatggccatactgcccaaggtaatttatagattcaatgccatccctatcaagctaccaatgactttcttcacagaattggaaaaaactactttaaagttcatatggaaccaaaaaagagcccgcatcaccaagtcaatcctaagccaaaagaacaaagctggaggcatcaggctacctgacttcaaactatactgcaaggctacagtaaccaaaacagcatggtactggtaccaaaacagagatatagatcaatggaacagaacagagccctcagaaataatgccacatatctacaaccatctgatctttgacaaacctgagaaaacaagcaatggggaaaggatttcctatttaataaatggtgctgggaaaactggctagccatatgtagaaagctgaaactggatcccttccttacaccttatacaaaaatcaattcaacatggattaaagactttaatgttagacctaaaaccataaaaaccctagaagaaaacctaggcattaccattcaggacataggcatgggcaaggacttcatgtttaaaacaccaaaagcaatggcaacaaaagccaaaattgacaagtgggatctaattaaactaaagagcttctgcacagcaaaggaaaccaccatcagagtgaacaggcaacccacaaaatgggagaaaattttcgcaagctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcaattcctcagggatctagaactagaaacaccatttggcccagccatcccattactgggtatatacccaaaggactataaatcatgctgctataaagacacatgcacacgtatgtttattggggcactattcacaatagcaaagacttggaaccaacccagatgtccaacaatgatagactggattaagaaaatgtggcacatatacaccatggaatactatgcagccatcaaaaatgatgagttcatgtcctttgtagggacatggatgaaattggaaatcatcattctcagtaaactatcacaagaacaaaaaaaccaaacaccgcatattctcactcataggtgggaattgaacaatgagaacacatggacacaggaaggggaacatcacactccagggactgttgtggggtggtgggaggggggagggatagcattgggagatatacctaatgctagatgatgagttagtgggtgcagcgcaccagcatgtcacatgtatacatatgtaactaacctgcacattgtgcacatgtaccctaaaacttaaagtataataataaaaataaaaataaaaataaataaataaatttgcttgtgcatttctagctttagcttcttttttgcaaggggagcttaattattaggatcacagctgaggcccaagatataggaaaaatagcctctgagctccaagttatgtctattctgaatctcttgcactttgttcacaggtgagcatctttaggcctctcttaggacctgctaatctttttctttgcattgatgtaacaaacttgtctaaataattcccaaatttataaatgttaaaagcagcaaattatagaaaattcagaggttgctattagtactgctgcaaatatggttgttactagcctgctggtaaacaagaagacataaattgctcacagtaaaaagcacagtagtttatgaccattaagtgaaggggtgtgtaatcctacatacatacagactccaagggtttttttctattttagcctagtacaataactgattgtcatggttaattttatgtgtcaacctgtctgggtcatggtgcccagatacttggtcaaacattattctagatgtttctctgatgtgtttttgaattacatttaaatcagtagatttcaagtaaagcagatttccctctatgatgtgagtgggcctcatccaatcaattgaagtcctgagtagaaaaaaaaaactgatttcctctgagcaagagagaattctgcagcacatggcctttggtcttgagctatattggctttttttctgggtcttcagcctgctgccctctctgcagattttggacttgctagcctctgtaattgtgtgagcaaattctttaaaataagtatctttctctacatatacgtacacattctattgattctgtttccctggagaaccctaatacactgatatttataataatttacctctttgttcaacacttatttattgagcacttattatgtgccaagtaccattctaggaacttggaatggattattaaacaatacagggtcttacagattaagacccgaccctggtgtgcttttattctagtgggggaagataagtggtaaaaagtaaacatgaagcattaaattatgttctaacatgctagaagtgataagtgctatagaaaacaaaagtaaaaggaagacagtgtgaggagacattgggtcattagagaaggttaaaatacaatcaatatattgggaaagtaggtaactatgaaagactcacaaatgtgcaaattgctttaaattaagcttttaattttgaggtaattataataaatgtgcagttgtaagaaataatataaaaagatcctatgtaccctttatccagttccctactgtggtaacatcttgcaaatctatactaaagatcacaactggctattaacacaaatgcagtcaagatacacaacaggtgcatcactacaggtatttctcctcctgcctttttatgaccacagagcccttcatttctttcttaaccattactataattttgtcattttgaggatgttttataaaagggccttatggtgtgtaagctttcagaattggcttttttcatttggcatagatccttgacaattcattcatgtcattgtgtatatcaataattcattcctttttattgctgagtagtattcatggtattgatataccacagtttgtctcaccattcacccattgaagggcatctgagttgtttcctgtttgggactattatgaatcaatttgctataattttccatgtacacatttttatgtgaacatatgtttttattacttcataatgaatgcctagcgggtgcagttccagggtcctatggtagttacatgtttagttttgtaagaaactgtcaaactcttccagagtagctgtgccatttaaaattcccatcagcaatgtatgagtgattcagttttactgcttcctcgccagcatttggtattataactatttttaatttcaatcattctgataagtgtgtaatgatatctcattgtggttttcatctgtacttgactaatggctaatgatcttccacatcttttcaggtgcttgtttgccacctgtatatcttctgtagtgaaatgtttattcatgtcctttgcccattttctaattagattgtttaggttttttttttttaacttcagagtttggagaaatatctacatatatatatgtgtatatatatatatatatatatatatatatatatatatatatatatatatatatatatattagttctttactagctatgtggtttacaaatattctctcccagtctgtagcttgttttttcatcctttcaacaggatcttttgcagaacaaaagcttttacttttgatggaattcagtttaccaatttttccttttatggttcatgcttttgctgtcaagtgtaagatctccttgcctaaccctaaatcctgaagattcttatcctctgttttttcttataagttttgtagctttatgttttacatttaagtttataattttgaattaatatttgtattaggtgtgaagcttaggtcaagtttcattgtttttcctatggattcaattgcttcaacaccatttgtgaaaagtctccatttcttttgttgaattgcttttgtataactttgtcgaagatcagatggggatatatttgtggaccgatttctggatttttattctcttctattgatctatgtgtctatccctccaccgagaccacacagtcttaactactgtagctatataatatgtcttaaaatcaggaggactgattccttccactttattattttgcaaaatggttttagctattctagttcctttgcttttccatttaaattttagaatgaacctatctatgcctacaaaaaatcttgctggagtttttatgggaatcgcattaaatgtgcatatcaatttgaagagaattgatgtatttattgtgttgcttttttcaaatcatgaactcagcatgtctctccatttattttgatctgtaatttatttcatcagtgttttgtaatttttagcatacaagccctgtgtatgttttgttagatttaaaactaagcatttttatttttcaattgcaagtggtatttattgccttttaattttcagtgtctgttgggacagttttaatttctttatttccattttcacttgcatgtcttttatttccattgttgttgtttgttttcaccttacagcactggctagaacttccatccctgtggtgaataagagtgatgaaagtggacaccatcgtattattgaattgaaggggtgagtgccgccttattactgtcaggtgtgggaagaagttccacttccccactcggcctccattgacatccaatgctgggagggtcctcattactggtgagtaaggtgagagctccagatcttttctgagcttccactgatacctccttggctggaagaggtaggaataccttcttacttctccccacataacccccaccaacatcgtggtggagaggtggagggccagccccactaccactgggttgtattgaaaatcctaactttccactaagcctcctcggacaccaacttagtgtggagtgggaggtgcacccagttacttccatgtggggtgctactactgcccagcaaagatgaaggtcctatttttatattcagcctcctttgatatcctctttctcccagtggggaactggggagcctcattacatctcagttgggatagaaatctaggctttttactggacttttgcagacatgagtggagcacagaattttctgctgggtttggctggagatgagctgctattttctggaagttttctgacttgaaagatggaagcttggttcgcttgttgggttgccctgttcctggttctttggtggaggaagcaggcttctgttgggctttattttgtctgtgcttgctcacatctacgggctgctggcttccttaggaacagtttgggatatatgagggaaggagcttgggccctgagttccctagctggcctatcttcttctctctacttttcatagccttctcatatttattttacctataacatccaaggttttaagtgtgcttaacagaaggaataggaaaaagcacattcactccatcttctccaaagttgaagtccttcataagttttttaaattttctatagctaaaatgactaaatttttagttatctagaaaactttcctatccaaagtgactcatcaaggacaactgtaaaattttgttttaccacctatgttattaaactagagatttcccccagagagtaacatttactttgcttggtattcggttataactatcagatatttaaggctgagtcacctatttctaataaccatggtgattgcaccaaataattacatatacaacatatgaaaggcagtcctccagccgagggatctatggaaccacaggtctgtagaactagagagaaggagaaaatcattaaatccttctgcaccgaggggtggatatctgagttggcagagcaggagttgaaggtgcaggttttgacattttggcatggagttggctgagctcaaatttctaccctgtgtttataagctgggtgactttaggcaacttatttcatcttatttttcctcagtttctattattttaaaatggagattataatcatacatacttcaggggactgaggtatgcattcaataagtgagtgtatatgaaacacttataacaattattggcacatatgaccattcaatgaatattacctaccataattactcatatagtatgatttagagagattaggaagactgctttccacctattttcctgcctatttttcatcagtagctgggtttcaaccactgagtaattacttaggtgaaggtatgggccctattaaatgcaaatttcacaaggcctagtgtattattctgaaggcatctataccttgtattagagagatctaactattgcctcagctgttgatggcagaggcccaaaatgacagtggcttaaagaaagatggaagcttggtttgatctcatctaaaagttcaggtggtctggaagttctggtctgcaaaattgccagggcccaggcagcttctgtctcgttgctctgccatctctaacacgttgtccttgtctacatggtgctagatggctcatcctgtatccatccaccaagcatcaggatggagcagagactaagcaggaaaggatccgccttccttttaagcacatgtctccaaagaagccagcatcactcccactcacatcccattggccagatacacgtcacctggccacatgtagctgcaagtcaggctgggcatggatttcttcaatgcagttgactatgagactatctaaaaatgcagttaatatggaaagagagtttgccccacactgcagggtggattagtgtatcttctactgcctaccttaaaacccgtgaagaatcttcctgattcaagccctgtatcctcactctgtcttcttatttgccttgcatataaacagtacctccttctgctctcatcaaaagccagcattaccagggcaacagggagaaaagtcagttgtctctgttttagggcaaaagatcaccttctctgtcattcttggctaacaatactcacgtaggttttgaaaacctaggttatgctggctttgtgatgttggaataatagctaatctctctaaaccagtggttttcaacgggggtaattttgctccccaggggacatttggcaatgtctataggcgttttcagttgtcccagttgagggagagggctgttttaatgggtagaggccaggaatgtggctaaatatcctacaatgcacagaacagcaccaacttataaaacgttatgtggtctgaaaatattaatagtgtagtggcagataagttctgctttaagctttagtttctttcctgaaaactgggacgaaatagcacctgcttcataggttatacgtgaggagcctctgaaccagcacttgtaaaggatttagccgagtgcctggcccatggtgggttccagacaacctctgtcctcagggactcttaatcttctccttgttttatctgacttctctgcactcatcttcttgcaatgtttattattattatttttaattttagattcagagggtacatgtgcaagtttgccacctgggtatattgcataatgctggtgtttgggcttctgatgatcttgtcgcccaggtagtgaacacagtactcccaattggcagtttttcaatccttttccactccctgcctccctctctttggaatctctagtgcttattttcctatctttgtgtctgtgtgtatccagagtttagctcccacttgtaagtgagaacacatggtatttggttttgtttctgcattacttggcttagtataaatggcctcccctgcatacatgttgctgcaaaggacatgatttcattctttttatggctgcatagtattccatgttgtgtatgtaccacattttctttatccagttgccacttactagcacctagattattccatgtctttgctattgtgatagtgctgggatgaacatgtgagtgcatgtgtctttttggaagaacaatttattttactttgagtaaatacccagtagtggagttgctgggtcaaatggtagttgtatttttagttatttgaaaaatgtccagactgctttccatggtggccgaactaatttgcattttaaccagcagtgtgtaacgtctacttgcaatctttaattaatagtatgtatgtctcttgagaaggggaaatgagggaaattacattttactgtggaactggtggataccagaattttaacataaattactttatgtaaacatctccaaaccatgtgaagttggcattactctccccaacttggaaatgggccagtgaggctcagggagatctcctaacaccctgcgaaaacagagttaatcagtggctgagcagggattcgacgtcatgtatgtttgaccccaatatgtgtgttttggttgcaaattggcttttcccagtcctgtaacttggaaattctacaagggtaaagagggccgggtgtggtggctcatgcctataatcccagcactttgggaggctgaggcaggtggatcacctgaggtcggtggatcaactgaggtcaggagttcgagaccagcctgaccaacatggtgaaaccccatctctactaaaaatacaaaaattagctaggtgggtggtgggtgcctgtaatctcagctactcaggaggctgagtcaggagaatcgcttgaaccctggaggtggaggttgcagtgagccgaggtcatgccgttgcactccagcctgggcgacaagagcaaaactcagtctcaaaaaataataaaataaaacaaaataaaatggcaaagagaatctgaagcaccagaatgctctggaggaagtcagaagagactgttgcagggaacaaggatgcagtcacactttttcctcaggttgggcttgtaaaagcagcacgtacttcaacctgtttaggagccttggccatgttatcttgttcccacaaaatggtaggcagtgttatcttcttttttccttgttgaatcctaggaattgggtttatattagtatcctaaggatgttgtaagaaattaccacaaactgagtgaactaatgcaatagaaatttactctcttacagttctggatgccaaaattctgaaatcaaggtgtcggtggggccatgttccctctagccgctctagagaagaatccttctttgcctcttccagcaattgatgattgctggcaattcttggcatcccttggcttgtggctgcatcactcccatctctgcctttgtcttcactggctttcttccctgtgcatctgcatctctgcatctctgtatctctacgtggacttctcataaggacagcagtcattggatttttgctgattgtaatccagcatgacttcctcttaatttgattacatctgcaaagactatttgcaaatgaaggcacattcactggattcactggtgctgggggttaggacttaataatagctcttggagggacacaattcaacccatgatgggtctaaacaatgttttataattgatataaaagctaaaccatgttttcttaaaacaactagaaacttctaacccagtggcaactttgggtgtgcaagagagctcaaagcaaactctcagtttcctggcaagagaggaggcctccactctgtcaccccatggagactcctccttgatactgacattattgcaatacatgcaaaacacacaaaaaaatcaccttagagtttgggaaggatgaggatatttaatggcagcaatataagtaattttttttgcctctgcatatactcttttttaattaaaaaaataaaaacggaaaaacagattggggttaaaggtctttagtttttagaggtgatatgaaaggagaaaacctgtatggcttctggtctttatacagtgcattggaacagaaagtcttaattataccaatcaaggtgacatccttttccactgaactatgtattatattttcccttcaagacaaagatgaacatttatgcaattaaaataggctgattgaaaaaaatccgtgtcaggcataagctcggatttatacttttgggctcaattgactggggaacattaaaaaaactgcacaactgagcaaaaatggtctcttttcagcacatattttgaacaggaaagaggagtttgctttcccctgcattcagcaacccagctcccctcctcattagtccagtgcagagttggggctgctccctcaggtcctcatcagcttactcaaacatgctgtaaaattgatctgacagcccatgaaagggagtttagaggcagggagggaaggacatgagagagctaagattttggtgacatggaactctgtattttcaaggctatcatcatatttgcctagtattaagggctgtgacattagcaaggccctctgatctttgggctacaaaattgttgtgacaagggccctatgtgtgtctgtgtgtatatgtgtgtgtgttgaggggtatcttttgagtcctgagtttgaaaatacttatttgtaataatgggaaagaaagttctctgtgattgaaggctgaatccttttgacatgaagagcaaagacaattagcatttgttgatcatttgttaaatttcagatgctttcattttttttcttttaatcaccatgataatccttgaggtttgtattattattaccccattatacagattagggcacagagaccaagaaagatatttgacatatttagcaattggaaaaacacaggcagagacgatttggaggtactctggccataggtcctggagttccccaggagcaagttaggatggctggggccatgggaaggtacaccaaggaatcttggggcaacaactatttataatcacaaaaatatttcaactgccaccagagcaaaccaggtaaattggctctgtttggaagaaaagtttgctttccctaagacaagcagttagtcacatggtctgacttggggtttgaactcagctcgttttactgcaaatataatactctttccaatatgccacactctcgtctcctcactctatccttcctgtgaggtcagagcctgcaaatgtgtctggaggaggaacagtggcagatattatcgggggtgaatgaggtcagaggctttcctgtgaatatctttgtcaaggtgatggaaaaagtttccaggaacctttagaatgtgtgtcgtgtatcatgaggattggagactacaaaagaggaaaaggtgttcaaattcagagttggataattaaaaacaaatattgtcaacatcaataattttccccagagttgctcctccttttatggtatggaaagtttcaagacctgtgacctagatggtgttctggggagacggtagatatacatggagaaaatgccaacatattttatggttatgctaagcatattttgaaaacttccgttaagattttggttcagcctggtgcagtggctcatgcctgtaatcccagcactttgggaggctgaggcgggtggatcatctgaggtcaggagtttgagaccagcttggccaacatggtgaaatcctgtctctaataaaaatacaaaaaattagccaggcatggtggcgggcgcctgtaatcccagctactcgggaggctgaagcaggagaatcacttgaacctgggaggtggaggttgcagtgagccaagatggcgccattgcactccagcctgggcaacaagagcaaaactccatctcaaaaaaacaaaaacaaaaacaaaaaacaaaagattttggttcccccacacacaaaaaatagagtttgaaatttagtgaattaattgtattccatggctttttctttacagatagattcaggtctcataaaaaactatgccatctgtacacattctgatatgtacagcaaaatgctgtcattttctttcaactggcaaccccaagctacaaacaaaaacatgctggtggaaattaaaggaaatgccctctctatccaattgaaacagagagatgtgtaaaatcctttcttttcttttcaagtaagggcacaaaacaacattcccttctctaaacacaaatagaaatttactcactggcttggaaaaaacaggccaagaatggacactttttcctctccagagatcagtgcagctcttatctctatttaaaaacctttgaatctgtgcttcctgctgttatcttacattttttaatttcatctatttcactgtgctgttttcctcagtgaactagtaccacctctcccttccttcttgcagattcaaacctcttctgtgataatcatagaactgtagcatcagaaggcaattccctaagtgtggtctgcccacatccctggtggtaagccaaatgatcgtaagtggtagagcggcaattacttttaaaaaatttgacagtcatatatctatttcaatgtatagcaaatatagaattggaacatcaaactatgattttatagatattattgcctaggaccatgctaagtttcagaagtgaatctatttagatcaataaaaatatattaagaaagtagtggcataggtggtgtgtcactctaacagagcataaaccagttgggagacaatcctaccgaggtctgaagtggcattctcacacatggactatgttctcagcagctgggcagctagcttctgctcatgaggagcagaggtaactggagtagcatagtctgcatgaggattgagcagacccaaacacaagttgagagaggctgggcattagaagaacaaatatctccttttaagattgttcaacctgacagtctgttctcaatgtgaactcaagaggctgcttcctctacgtgcccatgcaaagcacaaatctgagatcttactattccaatttgaggaagagccacctgcaccttggaaaaacggaagcgcgtgcaaaagcctgagaaccagctggttgcaggcctgtgccaggcctttgtgcactaggtgtgcctgggtcgggggagaagtccatggggctgagctcaggcaggccagttctccgtgtatgtggtaacaagaaggtaaaggaacaagaaaagctgttgaaccagccataaattggctgtcttccgtggtattcagtgtcctgtttatgactgtaaattgggtatatctttatcacaactgtgcttttggggaaaacaggaagtatttctcctaaggaatgggtttacacagaatatttggtgtattcgttctcacagtgctataaagaactacctgagtctggggaatttatgaagaaaagaggtttaattgactcatagctctgcaggcttaacaggaagcatggctggggaggcctcaggaaacttacaatcatggtggaaggctaaggggaagcaagcatgtcttaccctgacagaataggagaaggggttggggaagtgccacacacttttaaactatcagatctcatgagaactcactcactctcacgagaacagcatggaagaaatccacccccatgatctagtcacctcccaccaggtccctttcccaaaattgggaattacaattcaacatgagatttgggtggggacacagagccaaaccatatcacttggtatgttagtgagggctctcaagataaacagaactaacaggatatatctatatatttatctaacgtaggagattataaggtattggctcactcaattatgaagactgagaaatgtcacaatctgcttgtctgcaagctggagatccagaaaagctggtggtgtagtttaatggactgagagccagtgccatagattcaagtccaagcccgaaggcctgagaaccaggagctccaaggataggaaaagatttacttactagctcatgcagtcagacaacgaacaaactcaaccttcttccaccttttagttctatttaagccttcaacagattggatgatgccccctcacattgtggagggcatctgctttactcagtctaccaattcaaatcctaatctcttctggaaataacctcacagaaatatccagaactaatgtgtaatcagatatctggccatcctgtggcccagtcaaactgacacataaaattaaccatcacacttggtatcctcaacattgtgctaatgaagactgagttatttagactttggaaaagatacagtggactattgtgctcatttgaggatgtccatcaagtcagcctttagtactaaacaaaaaacagatagatatgaagaatggattgtttaggcagattctggcacagaacatggctgatgttagaacctcccctcccccagggtcatgaccttgggaagaagagatggataagtaaacccttagacccatctcaatattacctcctcagtaagttctttcctataataattgtaccttacccttccttgttcttccatcttctatatcactttatctggacaactgttagggtaagcacactgctaattatatttttgtttaatccactttgataacatgttaagtgcccagagtgtacagatctcttcatgattatctctgcactctactcagaatccagttcagtgctttgtggagaataataactcagaacaataaagatggaactgaaggagggggtataagtggggagatgtagccacgctcagcaagacagggccatgtggtcacagaactacccaggagactttgtgcctggccagcgcctagatgacatttgctggacacttggcactgattgctgctagctgagtgaggaagggaaaaaaaaaaaaaaaaaaatcccaaaacatattcagctgttctagatttaaggtttgcctggctgcttcacggtcacaattgaacatgctggttactctgggtaaattaaattagctctaaagatatgcccaattgcaccctaagttccaggtgttgacaagtccttgcctcgaaacaggatcatcggtgacaataaatttcacatatttggcttttgtaaaatctaaaaggtttgttcatatggttataaatggctaaagaaaacaggcaaagcagcaggtgctaagatatgtgttgttcggtggcttagacaggcagataagacccttaaatgttgtagcctttgaacctgggatggggcagagtgatatctgatgccatggtaagcagagtaacaggctggggaagcattgtcgttgcatcaacaggtaggggtttgagttctacctctgctgcttagtgcctgtgtcaccttggacaaggttatgtaatttctctgaggttcggtgtttttctttggaaaacggattttaaaacacttggctcagtgctcaataaatagtaacttttttattattttaatgtaggacctcatttaatccttacaataacttcatgagtgctctatcaatatccccattttatagatgaggaaaccaaggcaatggagacttggagaatgtattactcagggttctgtagagggacagaactaataggatagacatatatataaaggggagtttattaaggagtattgactcacacaattacaaggtaaggttccacaataggccatctgcaagctgaggggcaagaaagccagtccaagtcccaaaacctcaaaagtagggaagcctacagtgcagacttcagtctgtggtcgaaggtccaagagtcccaaagctgaagaacttggagtccaatgttcgagggcaggaagtatccagcatgggagaaagatgtaggccagaatactaaaccagtctagtcttttgatgttcttctgcctgcttttattctggccttgatggctgctgattagatggtgcccacccagattgaggatgggtctgtctttcccagtccactgactcaaatgttaatctcctttggtaacaccctcacaaacacacccaggaacaatactttgtatccttcaatccaatcaaactgacactcagtattaaccatcacagagagcataagcaaattgcccatggcattagaagtagagatgaattttgaatgtgttaccagaccaacagatttgtatgcccactgtgcagtaacataccaatacatcgagacagcaaggtttgcatcagagaaagagttcaattatcacaggatggctgaatgagatgagagggatacttaaattcagctccttgagaagttctgggctggagtttttaaggggattgtggagagtgaggggctgggaaattgaggtcattggctacttgtattaagggggatgaaatcattagaatgtaggaacagcattcttcagtgagtcagcctcttcttagtagtttcactggtatgcaggatctgaaagaacatctccaaatagaaaatttaagcttcacaatgcctaagttgttatctatagagccgttaaggggaattttaatcttgtgacagggtctgcaagattctggggcaacaggtaccaacaactatgaggaagcaggtcagagagccagctcccctcatagttaatgctgaatgtgctgcaagctggatttatttttgtttcttcccctcctttcttcttgacttaaattcagttttcttctcctttacttttataaagtttataggtatggttacaaatccgtgtctccaggccagcgactgatcccactaacccacactggtaacttatagctattagtaatttatattccacaaccagcataaacatgctggatggattcacttgaagttgtcaactctccttttcttccaagatgactcagagacttgcaaactgaatacttgtataagatgcatctctgtcctctttggcaccttggcatactgggtcacaatgtaataattactttcatggtcatccaggaacagacaaatcccttctttcctcatgccttcattgtcttgcctgagaagcaagagggctggagtttgagagatgatctcccagctctcatatgcgtgggaacgtgaaaggcaggcatggtccattggaaaagaaaaaaaaaaacctgtttggatcaataaaaagggacaggcacaggaaaacagtcagagcttgatagatgagggaacatgtcgttatgtaggtggggaataagaggaagacaagggtgtatagaggaaatgggagagatctgtggttcttggggactttatttagaaaattcttcacaattctcagaaagcttaaatagtttttgaagaaataggagtgaaattctttggctagaaagtggacaggagaccactgggtctgtgtgcctgtgtttgtgagagtgtgaaagtagatggataaaatttgcaagcaggaatgagtcagacagccagcttctggtacccttgctataactatccagaagcatgagtccattctggttttaggagtcaggaatataaatggaatttgtattgcaatccaagggtgggtgtgagaactggtgagaatataatagattacttgtgtttatgaggtctgatatgagtagttcaagctgtaaaagcaagatatgagtgagtctcattttctttggttcttccagttgcccctagagagaaaaagtggtgactgggtatactcaatccaataaataaataaacacatacacattttgcaatgattgctttctgccgatgttaaatatacctcccaagttgggaaaatggcttatatgttctactgtccctcctgctttctgtcttcccagcccctctcttccttcaaggctgaaggcttccatagtcagttgagactctgcttcacacattataatgaaggcgcttgctctctaaatgactctctagtcctgattgtgctaaatagggtttctgtggtttcagatgaggaccattttttgtttaaatgctgatggcctcccagacattgtagaatcagtggggtgctgaggagtgagggagaggaagcttctttgccagtctacaaagaattggggtaggaagcagtgaaaagaaccccctgagtttctaaaacctctcaactggagtggaagaggaggggtgtcctttgtaaattatccaaacacatttccataaaagttgagcatttgtactaaaatgggatcttggcttcattttccctgcaaatggccagggagaaggaagcactctctcattgggtgcagagaaggaaaaatatggcaccctgcctagaatggagattttatgttttacagaaatgacttagggaggacatcctgcaagaagctgttgatcagtgaaatgtgtatttgctcaaaacacactttcccagctgagccccaccccttcgttccaagtcttcctggctgggtcctgcacatttggctcccccataaccttgtttaggactgtttctgttgaggatcacactgtgcagagtttcaaagtcattctgctaatgtgagtgcttctcctattttatgcatcagaaggcattcaaaatctgtccacagttgagagcatcagaaaaacaaaacaaaacaaaaaacaggtgtttataaaagctaacttactatatgccagaccaattctaagtgctttacaaatattaactcatttaatactcacaacaaacagttgttgcacttattattgcccatttaaagaagacttaggcataaacatgttagtttgcccaaggtcacaaagctcacgagtgatggagcccgtatttcattccgagctgtctcacagcacagctcacactttaaagcacaatactgtaataaaaataatacctgcttcatggggttgttctgaagatcaaatgagattatcaataaagaaaagctgtaattatccaatgtgggagaagcagaaatatttgggctgtgtttctgttagatgcttctgatagaaaaatcacaattgccaggatccatccttccttcgttccttcgttccttccttccttccttcgttccttccttccttccttccttccttccttcccttccttccatttccattttccattggctgccacaggtgactggatacttgatctaactgagaagaattttgaaatgtggaagggaggaaggaaggaacaaagaaggaaggaagtgagggagggaaggaaatggctcttttctttcctgtttcacttcccattccctcacttctgtgtcctgaactcacacttccaaatcacttcccgtccatgaaccactgtcaccatctgctttcagaaggacccagcctgagattctctctctcttcctcctgcccttcctttctttcttttttcccttagcctttccttttttttgaagtgatattaacttttttcttagattagcggatattttgatcttatttgaatcatctgactggaagacctagttcaaatacagcagatttgggtaggtaaaatgtcagcacttcttaccactctatcccagtgtccaacccagttctggaacatggctagtgttcagtaaatgtctatccaaagattttggaaagtgtgggttaaccattattgcccaatctaccaaaaacacaagtgtaaaatgtatttttacattagcaaagttggaaagttatattttctttttccttgtctttcccagaaaaatcattaacttaggtctgctgttttctgtatttcacttcacatgtggaatttcaatcgttcaagaagacaggaaggggtggagaaacactaaatatatatgtacttacacacacacatatatatatacacatgtatatgtgagagtgtgaaagtagatgggtaatagcactgaaaaaaggaaaaggctcaggaaggaaggaagggtaggaggaaaagagagagaatcttaacctgggtccttctgaaaggagactgtgacaatggttcatggatgggaagtttatttggaagtgtgagttcaggacacagaagtgagggaaggggaagtgaaacaggaaagaaaatacacacacacacgcacacacatatgtatgtgtatatatgtatacatatatacatatgggtgggtcagtcagctattgctgtgtaaaaaaccttaaaaatatcagtggcatatagcatacaaatttatttttcatttatgagtcttaagtgattgtcacactaatgtgtatgtatatatatatatacacatatatgtgtgtatatatgtatacatacatatacttatatacatacatatatgtacatatatacacacacacgtgtgtgtgtgtgtgtgtttctccaccctttcctgtctccttgaactattgagatgataggaaaaagctttaggcatgccaaaatggagatatatttgtgcctttcaagtgacagttttgaggatcactggcccactgatgcttctatctctttaaattcttgattcagaccaactacctagaatgaaccttttccaggagagactgttacccagtggacgaggagatggtaaggcataagtaggtgcagctggcatggtctgacaagcgtgtaccgtaaaatgaaatcatcgcaccagaagattcgaggtgataaagtaaaatatggaaatttgaacaaaaaagcaaagcaactcattggagaattaaaggcaagactaaaagtctggaataaaggggtaatcgtgcttcattttatggcagtggtttgtggttttattgattggttgactgatttgtcatttgttgaatgcctatgtgacagattccctaacaagggcatctgtgtgtgttatcttgatgaactgtaattgagaactgtagtcttgattccttaagtgtatagacttgtcttgtttacttttaatttttttcacctccaacataaccaagtagtgattataaggcatccctgtaaaccttttaagctgcttttctatgtttaaggacattcctatcttatgagtttgcttctttccaaggtgaaagccagaaactcaccttccaactttccttgctctgggtcagacacaatggtgtgagatgtccatgtggaaactagtgtaatggatatccaggtgctaggcagtgacaggcacgtggtccattgctgtgcagaagtagcagtgttggcagaggttctagtggtgcccccagcatcagaggaacaatccatgttatctctgcccagaagtggcagtggttgtgccacttctgaagcagtcctttgttgtaatttgaaagttattcctgaatttgtagtcttcagtcttacttcagtctttccttaaattcctagagcttttgtgatcaaaccagttgaaataatctcataactgattcaatgtcatactcacgtttcaaatttcaaaatgatagcctgagaactatttgaaatatcttccttccacatcaaacacctgagaatgatagaatttttttaaaaaaataataaaatatttattttagaaacaataaataaataagaaaaagtagcttttaaaaattagagaaaatgggctgggcgcagtggctcacacctgtaatctcagcactttgggaggctggggtgggtggatcacctgaggtcaggagttcaagaccagcctggccaacatggcgaaaccccgtctctactaaaaatacaaaaattagccagtcatggtggcaagtgcctgtaatcccaactacttgggaggctgaggcaggagaatcgcttgaacctaggaggcagaggttgcagtgagccaagattgagctattgctctccagcctgggtgacagagtgaaactccgtctcaaaaaaagagagagagagaaaacatttcctggaccataagctgcaaacaattcctaaaagaagggaaggctgtgggtcagtcagctattgctgtgtaacaaaccttaaaaatatcagtggcatatagcatgcaaatttatttttcattcatgagtcttaagtgatatgtgtcacactaatgttgagttttatcagtgaattaatggtcatctcagtagtgacacctgctggtcaggaagtaaactccattagtggctttccattacactctggattaagacccaaatctgtaacattgtctacagggctctgtgtgcactccctcatctctcactacttccggcctggcttattccatggcaattacgctgccttcatttagcccctcaaatcaactggaatatttctagacttgaaaactttgcacaagctgttccttctattcagagcactaacatcactctacttctccaatttgcttggcaaattcctttctcttcagaaatcagtttaacctcatcttacctataccttccctgtctttccaagctagaatagttttccttattatctgctcttatgatggcacctgttgctttctgtttgtgtcacttagtcacaatatagttttctattatatgccatactttgtttaatgtctgtttctccagtgtggctagaagatatttgagggttggaatcatgatgtttttgttcagtgttgtattatgaattattgatccagtgttgggtttttggtaggttttcaagaaatatgaatgaatgcctgtttaaataaactgatacgtcagggtatgcacaactaaattatgaatatataccagtgaattttgtgaatgtaacttttgtggttgactgagtaaaacatgcacctctgtgaaagaaagaactgtagggaatttgctagtgtttggtttcacaaaaatactgaaagttagtttgtctattattctaagattggctcttaggtaatcaacatgtgtcacattaagttgagctttaccaatgaactaatggtcactcagtagtaacacctgctcttcaggaaggacactcttccttctccccattagctataatatttttattgtcctcctcttcacagcttctatcaaaacttgaagtagacaaggacctgatatgcaatggactgaatgtttgtgttaccccaaaattcattcgttaaaatcctaacctctaaagtgatggtattaggaagtgaagactttgggaggagagtagttcctgaagggagagccctcataaatggaattagtgctcatagaaaagaggctccttctaccatgtgaggttataatgagaagacagctggctgtgaggaagagagccctcaccagacactgaatctgctggagccttgatcttggacttcccagtctccagaagtatgagaaataaattcctgttgtttataagccacctagtctatagtattctgttacagcaatcctaatggaccaagatgtttttacaacttgtacatattgttttacaatcttgtacattgtacaacaatgtacaagaagtttttagttgcctacctaaccatcctatgctctttcttgttaattagaaccaattttgttcagacctatcaacttcaagtccaaggattttataagagatgagtccagccctagtcctaggtatgagtcttgattagtttcaaccaactatgatgattatgaatagattttcattaaagaaaattgagaactccaaaaaagtagaaaacatactgatatttcactatgcaaatgcaaccactttccatattttcttgaaattccttccagtcttttttctatgcaccagtgaattgttttagcatatagtattcataacctcatatgctatcataccctacctatttacatataatacattgtgctcctttttctaagtctaattcattctaatttatttttattggctgcatatttctttaagaaattatttctcaactaacataaagatgttactgtttgtattagtttcctagagctgtggtaaccaattaccacaaactgagtggcttaaaacaacagaaatttattctctcacatttctggaggctaaaagtccaaagtcaagatgctagctggccatactgtctgtgaaggctctaggggagaagcttatccaggcctctctcatggcttctggtgttgcaggcagtcccttgccatgtagatgcgttgcttcaatctgtgtctccatcctcatatggcctatccttgtgtgactctgtatgtcttctctttttcttataagaacactagtcatattggattagggtggatcttaacttgaacacatctgcaaagacccaatttccaaataaggtactattcaaaggtgctgggaattaggacttcaacatacctttttggaggatataattcaattcgttataccattcgtctgaagttgaagaattattacaattttttctattatatgtaccacagcatttaacatcttcattcagtgttttctacatctagaattatttacttagaatagatttcccagagaggaattcctgggtaaaagtatgaaaatgagcattttaaagttcttctacaaattgctaggctcctttccaaaattaccaattgctaattgccattagcaatacacaagggtgtctctttcacctcattcttgtgagtatttggattttttagtttaaaaaatacacacacataaaatgatcaggaaaaaatagtatctcgtaatgtgcattgagatcaaacactttcccatatttgatttgctaattgcatttccctttttggtgaattttctgtttctttcctttgttgacttacctataggagtcttcatgcttttcttttctttttttttgaagcctagttcatataatgacctacttttttgattgtcccagcctaaagaacttgccttttctgcacttttttttatgtttaatttttttaaattgtactttaagttctagggtacgtgtgcacaatgtgcaggtttgctacatatgtttacatgtgccatgttggtgtgctgcacccattaactcgtcatttacattaggtgtatctcctaatgctttccctcccacctcccctcaccccatgacaggccccggtgtgtgatattcccctttctgtgtccaagtgttctcattgttcaattcccacctatgagtgagaacatgcagtgcttggttttttgtttttgcgatagtttgctgaagatgatggtttccagcttccatggatgaagctggaaaccgtcttcatggttttcttatctgtttttcaaatgtgttgcattatttttcctagtctgctggttctcattttttttttgttgttttcgtcctgcaaaaattctaattggtatgttcttgcctgcaagagtgattttgaaaatgtaaacaagtatagtgcaaacacaaatccgtcaaaatgggtgctgtctgtgcactgtactaggatctgtctgcccatctttccttttatgaattattttattattcttaaaaacagaaagtctttctcccttcaaaaaagagaattaaattgaatattcttttaatttttgtttatatacattatatttttaattaatcaggatatcttttagtatgtggaataaggtaattatttaaatatattgtgttccaaattgttagctgattgatccaacctcatttattaaataactcgagcttttctgggaattgacttgtgatgaattccttatcatatattagaatatgatagataataggatcattttctgggctgttgtccctggtgctatttttgcacatatgtcacattatttaaatctttatagctttataaaatgcagtgtacttcccctttaacattttcttcaatattcggtttctttttataggtgaatcttagaatcattttgtcaaagtcaggttgggatttttgttaagattgtagcaagccacacattaatttaagaagaatttatactttagcaatatccagcctcaccatatggtatctctctctccttctatgcaagacttcttttatatcttttcgtaaagtctttcagctttctatgtaggtcacgcagttttcattagaattgtctcatgatatattatcatttttgttgttgctggaaataggaatttttaaattattttatacattatttttggtactctttatttgtttatcttgcattcaaattgctaagttacattaaattttgatactttataccacatgcctttggagcttttagactgataagtacatgatctataaggaataatattttctatttaaaatattttttggtcagaatttctcaaacagtgtaaaatatgatgataaaaagaatttgcttttttggctcttgattttgatatgaagtgactgccaactatcagtgtgaaatacattttctttttctggtaagtagctcctcttatattcctacttgaattttaaaaacagactggtcataaattttataaagtgcctttgcaccattttgatataatttttgttggctttgacctattgccgtgatatgtgataataatagctttttatttgcaaaccattattaaaatcctacattatatcctgtatgaccctggtcctggcagacttaaaaaatatatagttgaattacacttaatatttcactttattaattattaacaatgggttttaaaatcattaattgctaataaaacagcaacgataatttgtttttgtcacatagaccttacctcataaaaagaaaagaattttacaacctagagacttggtctagtaccagaacctggggctactccaagataaagatattgttcatttacttattcatccatatgggcattgtttgtctttccactgtaaattctcaaacattttctgagcagcccctgtgctgggaagaggtagaatttccaaggtcagtccctgcggtcaagaagacttaagtttatatcctgactcttgttatttatttactggctatgtgaacttgggcaagttttctaactctgaagtctcaaatttcctcactggcaaaataggcatagtatatagcacctgcttgatagtttatatacaaatagtgtctatcaagctcttaacggcgtctgcatgccgatactcaatccatgttatgatgttattactacgtcccgggatataaagatggataggtctgtgccctgtgctggacagcaggggttatatagtaactgcatatcatctggtccttctcaagcgtccactaaaggtttgagggttttcccgacttgtatattattcagggtccctgggattctagcccatttcccttcatcgttctgaaatccacacatacactcctcatcatccaatcttcatttctacccctatataagggataagaactgctggataagaactagaacagttcaacaattacaggagaaacataagccacataaccaagtcacctgtgccataataactgatgaattcttggtggggtaagacgagttgaatatagtaacggcgggtttctgttaaagctagcatcagtccataaccttgagaactcggacttccaagggtggcctctctttgctttgtcagcatgaatcagtagcctcagctgcagaaaagattcagaacatgcagatggcttcactaccccagtgctgtcctgatctctcctgacacaagctaagtgtcagaggtcttggccttgattgccttttaacaactggcctctggattgaacatgcttcatctgtatcatcaaggttggccgcctgttactttcctggtgattgtgatgatttattttattttgcaaaaatgatttattttcttggtctcccctcctttgaagaaacttagctaacttgtcttgtctctttgccctctgccccggactctacagtaagtctcatttcagaacactgcccctccttcccatgggtaatggggtttctgcaaaggaagcctctttgaaccttttgggctgctgaatcgtgtcagcctggagacaagaagtttgttatgctcattgtgtcagctgcagacataattcatgaaaccatcccagacacaggatgtcaccaagtgatgcttcaattttacagtctcccagagctcctgttggcaaacagtgttggatgaaagctgggaggttttcaaaggccatgggccttcttttcctgccccttggttcccctttactttgcctcctccatctttgcctttctgtatgggtcatgctgtgtgcccctaagatttttaaagccaattagcaggttagagactgtcgaggcatattgacctgtgagatcacagtatttactgtcaccgtaatttctcataatattgaagcttatactggccctctccatggctttgttcaaagcctggtggggagaaggctgtttagatactgtaatcagaattcttgagctgaaccgttttttaattacagctttgatagggagctgtgcagtttgggaaaggagtccagctgggagttagcatctctttgatcacaaggctgaacgattcactttgatcacggagacaacagttcataaaagagcctggtctctttctgaaatttgcaggtaaacagagggatcacttgaatgatccctctgtggaatgagcaattcagatccaagacaatggtcttctttgaactggatttagaggcctattgattagcatagcaaaggggattgatgggtgaaaaaaggtggctttagtccctagacaggtgcatcaagaggtcactggctaggtactctgtggttgggctcccaggtttgggatgaatccctctttcgggactgcatgttgttcaggtaaatctgtatacaaataaacattgcaggtaacctcagagggaaaaccttgatctaaagaaggtggttctaacaataggaagctagcaggctttggagtcagggaaccccgagataagatccttacctctccatttgtttttttaatatgcaggaagaggatctagatgcctaagcccttctgtgcctaaagtcttttatctgtacaaattggacatatttaggttggtgcaaaagtcgttgggcttcaagggttattttaaaggtttaatgatgtgcattttgagaaagaaggcctgctaggtgccagacatgttgggaaagaaaaaaataccaaggtgtcctaaaactactgaaaaattgtcctgcctaggctactgaaaggaagctatactggattttcctgagcaaattgttttaaagtgctatttgatttatattctaatgggatttgtttgaacattttgtatataagaagttccatttggctaaattatagtgcttgagttttggggggttatgggggtactgccacatgccacatgggggaaccatataaccacagttgctgagttttaggaatattagttgggcagggattatttagaatttagttgtgaatgtgacgtgtgtgatttggttggttcctcttgtattaccccatatcactgatcacttgccatctggttgggacatacagataaatcaccaagatctgacagtcactgcaaaaagacattggccctgaataaataagccagtcgctttgaacagaaaacaaaaggcccagggttgtcgatgcctaagacttggctcctaggaaggaaacacaccatctacagaatggctccatcagactttctttcccattcctctcctgtagctgcctacagctctgctattggctacttgcatttctgtgtcatggccagcactcttttatggggagcaagtggggttggagaagggagggaacggtggctttgtgtggagggtccacctaagaattcctgctatgtcttttttttttttttttttttttgagacggagtctcgctcagttgcccaggctggagtgcggtggtgtgttcttggctcactgcaagctccgcctcccagattcacgccattctcctgcctcagcctcccaagtagctgggactacaggcgcccgccaccacgcccggctaattttttttgtatttttagtagagacggggtttcaccatgttagccaggatggtctcgatctcctgacctcgtgatccacctgcctcggcctcccaaagtgctgggattacaggcgtgagccaccgtgcccggccaattcctgctatgtcttaatcaagggatgccgggaaagtgaggtatgggacctcctagtcattaaaaagaccaggtcggcaacactacttcatgccattttaatgagccattgttgaacacctactgtgttgttttgctttggcttccatgacaaagtgccttaaacaggcttaaacaacagggtggcttaaacaacagaaatgtatttgctcacagttctggaggctagaaattcaaaattttaggtgtcaacaggcttggtttcttcttcttcttttttttttttttttgagatggagtctcactctgtcacccaggctgagtgcagtggcacgatctcagcccactgaaacctccatctcctgggttcaagcgattctcctacctcaacctcccaactacatgggattacaggtgtgtgccactacacctggctaatttttccagttttaatagggtttcgccacgttggccaggctggtctcaaattcctgacctcaagtgatcctcccacctctgactctcaaagtgctggggttacaggtgtgagccactgttttcttctaaggcctttctccttgatttgatgatggcccctttcctgctgtgtcttcatctggttcttcctttgtgtgtccacaggtctgtgtacaaatttcgcttcttataaggacaccagtgatactgaatttgggtccatcctaatgacctcattgtactgtaattatctttttgaagattctgtctccaaatacagacacattctgaggcaccagaggttacgacttccaacatacgaactttggatgaaaacgattcagcccgaagcacctggtctccatccccatccctaggaatccttttctctgtttcctagtaactctgtgcctcagtgtcttcatctgtgaaatggcatcgatagaaatattttaaggaatacatgagttgagctcacgaagcagtacctgacacagagtaaacgttcagtaggtattagctattatggtggcaatcatttcaactttctgacaagtgcccttgaaatttccttttcgtctccctacaccaggattgttttcttttttctgtctttttcttttgagacagagtcttactctgttactcaggctggagtgcagtaccacctttgcctcccaggttcaagcgattctcccgcctcagcctcccgagtagctgggattacaggcacccgcccccatgcccagctaatttttgtagttttagtagagacagggttttgccatgttggccaggctggtctcgaactcctgacctcaggtgatctagctgacttggcctcccaaagtgctggaattacagttgtgagcctctgtgcccggtccctacaccaggattgttaaagtgtgatcaggtgaccaccagcatgaaaattctcaatggtgggatgaatctgagatggcctcaggtctaagaagcccagccctggggtgggtgcggcagtttcttaagacaacaacctcctgagaacagggactatgtctgagacatccgtgaatcctggacctctcccacttggggcttggagcccgtgttcatccagtgcttactgcaccagctgacagctggacgttttagatgggagaggagggagacatcatccagggtacggtatgatgaaacaaaatacaaggtacaaatgacgttttggacatttcctaaatgaagaagctgaggaggagagtgctgtcagcttgaccaatttatagttttgaatttgtgcccagaagctgttttcagagaggatatttttagaaatatgaaaataaatacaattaaattagagagatatgtcaagtattttttttcttgttttaagactgtcctctgaccattacagcttaggtagtgacaactctttgaataacagtgccgtattttctaattaaacaatcaaggctctccagtcattacattaacgaagataagggtcaaaaggctagaacctagcaggaaaggaattttaaatggacagaaatggcaataaaaatggaaaaattttttctgacttttttctgtattttattaacactttgtggcctgaatatatttaaatagctccttgccacttaatgtaaaagtcagcctttggagatgagaatacacacacacacacacacacacacacacacacacacacacacacacactttagaatcaggcagacctagggttgcaccctggcttactagctgtatggcctcaagaaggttccttaacctctcagaatctcagtttgctctactgcagaatggggagatttaataccaacaccatagtttggctgtgggaattaaattaaataatacatataaaatgaatatgcatttgacccatcatagtcaagaggtagggaatgttgcttaaattattttttttcctgtgtccatgtgttctcattgttcagttcccacctatgagtgagaacatgcagtgtttggttttttgtccttgtgatagtttgctgagaatgatggtttccagcttcatccatgtccgtacaaaggacgtgaactcatcattttttatggctgcatagtattccatggtgtatatgtgccacattttcttaatccagtctatcattgttggacatgggtgcagcacaccaacgtggcacatgtatacttatgtaacaaacctgcacgttgtgcacatgtaccctaaaacttaaagtataataataattttaaaaaattatttttttctcaaccaaatcaaatgtggctcaactggcagatactagagttggctaaaaaaaacaaaaaaaaattctaacttcttagtgactccttcttagggttgttacaagagttggaagatatttataaggggtttccaaggctgaggacaccattctgaggttttgccttgcctaggaccacatggtgcagagacctgctggtagcatctgcttccctcttttgggtacacttagccacactgctatttgcctcagctcccaaagatctggaaataacagcaaaatctcaggcaactatgcaggtcaggtcaatctgagatttagatactattaatgacaacatctggaatttgcaggcatactttatagatattgcacgttcagtttgtctcaaactacaataacatgaatatcataataaagtaagtcatacaaatgttttatttcccagtgcatataaaagtcatgtttccactatactgtagtctactgagtgtgagacagcagtatgttaacagaaacaatgtacataccttaattttaaaatacttaatagctaaaaaaaaatgctgtcttcttcagtgagtcataatctttttgctgatagaggatcttgcctcagtgttggtgactgctgactgatcttagtggtgattgttaaaggctggggtagctgtgacaatttcttaagacaacaatgatgtttgccacatcgattgactcttcctttcacaaaagatttctatgtagcatatgagactgtttgatagcattttacccacaatataacttctttcacaattggagacaatcctttcaaatcttgctgctgctttctcaagtaagttcatctcatattgtaaatcatttgttgtcattttaacaatgttcacagcgccttcaccagtagtacattccattgtagggaaccactgtctttgctcatccataagaagcaactcctcatctgtgaaagttttatcacaagatcacagaaattcagcacaccttcaggctccgcttctcattctagttctcgtgctattttcaccacatctgtagtgatttcctccaagaagtcttgaactcctcaaagtcatccatgaggattggaataaacttcttccaaattcctgttaatgttgttattttgactcttcccatgaatcaaaaatgttcttaatgatgtttaaaatgatgaatcctttccagaaggttttcaattgaccttgccaagatccagcaaagggatcacaatctatggcagctacagccttaccaaaagtatttcctaagtaataagacttgaaagttaagattactcattgatccatgagctgcagaatggatgctgtgttagcaggcatgaaaacaacattaatttccttgtacatctccatcagggctcttgggtaatgaggcacattgtcaatgagtagtaatattttgaaaggaacctatttttctgagcagtaggtctcagtagtgggcttaaaatattcaattaaccatgatgtaaatggatgtgctgtcatccagggtttgttgttccatttctggagcataggcagagtagatttagcatcattcttaaggttgctaggattttcagaatggtaaatgagcattggcttcaacttaaagtcaccagctgtatcagcccctaacaagagcgtcaacctgtcctttgaaactttgaagccagacattgacttctttcttactgtgaaagacctatatggcatcttcttccaatagaaggctgtttcacctagattgaaaatatgttgcttagtgtagctgactttatcaatgatcttagctaggataacttgctacaacctctccatcagcacttgctgcttcaccttgcacttttatgttatgaagacggcttattttcttaaacctcatgatcctccttctgcaggcttccaacttttcttcagcttcctcacttctctcagtcttcatggaattgaagagaattaggggttctggattacactttaacttcaggaaatgttgtagctggtttgatcttctatccagacccttaatactttttccatatcaatattaagactcttttgctttattagtcatgggttcactggagtaacacttttaatttccttcaagaacttttgctttgcattcacaacttggctaatggtttggcacaggaggtctcgcttttggtctttcttagcttttgacatgccttcctcactgagctaaatcatttccaggttttgctttaaagggagacatgtacgattcttccttttacttgaacacttaagaaccactgagatattattaattggcctaacatcaatattgttgtgtattagagaatagggaggccccaggagaaggagagagacaagggaatggccagtccatggattagtcaaaaaacacaaaatatttatcaattaaatttgctgtcttatatgagcacagtttctggtgacctcaaacaattacaatagtaatattaaaggtcactgattacagatcaccataccagagataataatgaagtttgaaatattgtgaaaattagcaaaatgtgatatagagacactaactgagcacatgctgttggaaaaatgatgtcaacagatttgttcaatgcagggttgtcccaaaccttcaattagtaaaaaaaaatacactaaagctgcaaagcacaataaaggtatgcctgtattaaacatacttcagtacaaaagagtgatggtgtgtttgtgtgtgtgtagttcagctatcatccacatgctacacacattctaatgaggagagcacaattccaatgtgcttcattaacaccaaacaggaagcccacattctgaaggacacaggacaaaggtgaagcagacattcatatttgctatccatattggatcaataactcaggctttcttgaataacctagtgaatgtctgaaatagtttttcagtgatgaaattggcctgttaactaggatgatgccaattagaaatggaccctctgtggatagtgacattaaaggtatatggctgactagaatattttggagtcactttccacaatggcatgattcctgcaaggcctcaggcctgtgctcccagccatgatgccctaggctagcatttgcttactctctgaccttgtttgtgtcaccttctttgcacctctcttccctccctccgtccctccctccctccctccttccttcctctctccctccctcccctccccttctctcccttcccctctcctctccttccctcccctcccccttcttcccttctttgtcttgctctgtcatccaggctggagagcagtggcaccatctttgctcactgcagcctccacctcccaggttcaagtgattctcctgcttagcctcctgagtatctgggactacaggtgtgtgccaccacacctgcctaacttttttttttttttaatggagatggggtttcaccatgtcagccaagctggtctcaaactcctgacctcatgtgatcccccaaccttggcttcccaaagtgtcgggattataggtatgagccactgcacccagcaaacacctctttttcttaagagctagctcagatcttcctcagggaacaatcatgcttctgactatttcattgttctgcctttgcatgcacagctcatgggtatggaatgtgttagacatgagcatgtcaagcatacaactattattcttgaaacgggagagttccctgaaccgctctcaggacttgtgacaggagtgtggctcatttactcagccactgtgcactcaaatcccttacgggaaggggagcatgcagacaggcaggtgcaggagccaaggcaagtgcttttgggctctggccccatggtagcatctaggagtgtgttacaattaatgcccttttagcagttgccatctgtggagggctgaatgttaaaccagctcagtggaaggtcagggtgacagctttttacactctgccctcttggtacctgggtccttgtccagcatccaggaagaaccaggtcacatggacttgaaggatggtgaatttggggattttattgagtgatgaaggtgactctcagtgggatggggagctggagaggagatggagtgggaagatgatcttcccctggagttcagccatcctgcagctgatctctccaattgcccccaactaaactcctctccatgttcagattcttctgttctctccttctttgccatgttgctctgccattctgccactctgctgctcttctgctcttctgttcctctgctcatctattcttgagcctgggatttatatgggtacaggatagtggggtgtggcagcccaaaaggaaacacttgggcacaaaaacaggaaggcctgttccatttagggcttcaggtctctaggcttgagggtggtgcctttgccagggaaccaccctcttctatccagtgtttccctgcctcctgtccctatcactctcacctcctttgcctcctgttgctggactaacaggtggagcgactactgggtctctctgtgttctttctccatgggtctccttagctgctgagtagtgtggagagtttgctgttcatcccaaccgtaagttatggcaggactgcctcctgttggcccaggccatggggtatgggctctggttcaacctttgatgtgcccctgtactctgtgagttcagggctcatttttgactcagaatctagctggtccataacactcccttcttcctcaggatgagatcttttttctttgctcatcctactcattctctcacctcctcacacagtctgtaggcaggggttaggaaggatttttcatatgagttgagttcctggaaaaatacccttggaggctctacttgtttctattctctttctattatcatctatccgtctaccatccacctgtccatagtcatggcaaacatttactggacatcaattggataccccgtttttgctagtgaaagggaagaataatactttttaaattcagcactcatagtttctcagattgaatggacccctgcaacaaaagacagatgaacaagagaaaaacaggcacaaattaacatggatatttcatgtgtacatgagagacacccagggaatgagtaattctccaagaggtagctttgaattccaagtcgtatagcatcttcaattaaaagaacagtacatttttagagaaatgagaagacaaaggaaaggactgtgagtctctcagggcagcaacttgtaggaaggcaaatacatagcagagaaaggtgagttagtagagcttgttcatatagatttctttggtgccatctccagatgacagggtctaaatttatcttcagtggcactctctgatagaaggagggaaagataccttttgactttgtaaatctgggtcctgcttttaggtaaatagagggaaggtggagagctttcctgcatttgcttcttcttaattgcctttacctaaacaatgcttcatctttggggatggcatattctgatcccccatactagtaagacaggattcctgcccttgacgagcacttttagtggcttgggttggagggagatatctgtggctgaataaatagttaaaatattttgtttaagaaataaaaacaattaaaacacaaaagtttaaaatattcatacacatgtataaatgtggtaagtgtaattggtggaagagatatgcacaagatattatgggctctcagaggagagtccctaacctacctgtaagtgacctgaccttactgtcttgggtactgcattaaaattcctggaccccaatgtagtcagaatcctgcctgaacttgctattccttttgggcacccttctgaggagactcaccccctaccccagcctgcctgtggagctcagggacagctggggtcagcagtggggcttctggaggcagatggtctgactttgaaacccaactccactagctccctagctgtagcacatccaaaaaccatgtaacctactttattcctttttcagttctttatctgtggaagggtggtaataatggcccctatcttacagacattgcctttaaggcacctttcactgggtttatcaccttagaaactttttatcacatttagtttttgttgattatttgtatcacatcaatgcatcacctcctagcccagcctcccaacccctcaggccatattccagttcctgggattccatcgaattctagacctcttgcccacacacttacttcatgtcccagtcactaaatttctctgttggcagatcagaaaggggaggattttttacccatttgaaactactttactaaaaaaaagtaagtttattcccaaagtgctcaattaatagagttaaaatagattttaatttataaatatttaactcacaagcaattctttgtcccattcattctttgaacaaattttttttaatgaacacttactatgtagtaggttctgggaagatagtggtgactcagatacatggttccagacctcaaaaagctgaggatattgcagggtatgcaggtaagtaaaccaacagcaccgcttaccaacagcaccacttaatttcttatgtgccccaaagggaagtggaaggcatatgggaatatgaggaggggctccggagtcaaataggggcacctataaattgtaccactaaaaagctccttcatagttatttactcaaataggattgagtcctccagaggttctgtaaacttaagttaggtttaaatgttctgtttcattaacttcaggacaaggtgtagttctaggtgatgtacactgtaggtgttaaacaattcattgttctcaaaatgtggccacgtaagtttcatcctatggataagtataacacagtattatttttaaccctaaagttgaaattagcaggaaagagtttgaaatgggactgcctaaaaataataaaaaaaccattattaagacatcctgacaactgcaattaagggttcaaggaagagtctcctttctattgccctggtttggagaatctgcagaagccgctaaagcttcagagaggggatgactcagagggacaagtgcccacaggcatatgcctgctgcattggaacagaaggaggaaatccaagtgttctagctgtggtaatggttttcctggatttgaaagcagatatcaagatatctcaggagagtgagtgtgttttctttgaagatagattaatcaatgtatctagtcccttgatttcttgaggaaggctgtttatgctccaaagcccctttctctgtgttggtgactcaaatctatgagagatttacactgatttttctccatgtacaaaagagttcgatttcctcgagtgcctatgggatcttccatgtttcaatttggaaagtgcaatgagcagagcttcagaagagagtgtttgctttctgtgaagctctctctcattcacttggcttagacactgcagggagggctccatgatcacagacaaatcttatgtggctggaaatgccagtctttctaattaatgagtatcaccaatttcaccccctagttggagtgggtctgcaaatgacagacactggactggtgggaagcatatgaactgcagagacctgtgcacagtgctgcccctgcctccagccatctgtgtggttcttgtcaagttccttaacctctctgactttctgtttctttatctgtgaaatacagatcatgttcgctttctatggtttatagtaggaatgaaatgttaagaaatggaaggcaggccgggtgcagtggctcacgcctattatcccagcactttgggaggtcgaggcaggcagattacctgaggtcaggagatcgagaccagcctgaccaacatggagaaaccccgtctttactaaaaataaaaaattagccgggcgtggtggtaggcacctgtaatcccagctacttgggaggctaaggcaggagaatctcttggacccgggaggcggaggttgtggtgagccaagatcgcaccattacactccagcctgggcaacaagagcaaaactctgtctaaaaaaaaaaaaaaaaaagaaaaaaaaaggaaaagaaatggaaggcaaatggtacatgtcaagtactggaaaactgctaatttctttccctccctcccttccccactgaaagtatcaatgaaagcagacaagagctatatttgcatgtgtataatcaagttcactaaattggagaaaaatatatagactgaaattagtgaaatggttgagatagttttgtgaattaacatgataccaatatagaaactgggcagaattttccactttccagacactagttagcctacttggcgaacataaatcttaaatgaaggattaggtcaataaacccttcagcagacagacaatgctattgctctcagccctgcctctcaccctacagactggagaacaataccttatctttgtcagatccctacaaatttccacacattatttcatgcagccagcaaaaagggtttctgaattagatcggggaggaattattgtctccattttgcagatgatgaaaccgagacacagacatttgggtacaagaagagaggcagcagaaagtagaattcaggtctcagtttgctggcttcttgactctgctgttatcaggcacttttgcttgactatataatgtccacactctctgctttgtccctctcgacattctacaaattttgttcactcactcatcttcctatacttatccatgagtctgacaaggtgggtcccactcccccacatgtaaagccagttttgggaaacattgaaggaaaggggatgctaagtaaatctgtctaagtagtggctcttggaggcattcaggtgtagtgcttcaggcttcctgtggctgtgtcagcagtggccctgaccaagaacctaggggggcacatagaagacttgtgtcttggtctagggcaagggttcttaaatttgaatgggcatcagaatcacctggagggtttactaaaacatggatttctgggccccacacccagaattcctgatttcataggcctggtgcgggcctgagaatttgcatttctaacaagtttctaggtgatgctgatgctggtggtctagaaaacacacattgagaaccgttggtcctaaggaggagtgggtcttaactttgaggattaactgaggagttttaaaaattccaaagcatagccgagtgtggtgtgcacctctgtagtcccagctactcaggaggctgaggcaggaggattgcttgattgagcccaggaggttgaggctgcagtaagccatgccagtgtcactgaactccagcctggatgacagagtaagactctgttcccccgctcaaaaagcaaaaaaaattccaaagccaaggctgcactccagatcaatttcatctgaatctcagaaggggacccaggcctagtagtttctaaagcttcctaggtgatcatggtgtatacagaaataactctagggagtttagaaggcctgagtttaaggcccgcctgtgactgaggggtggtggttggtgcagtagatcagtgattctgaaatatgtaaggggaaatgctgtcacattgtacaactctttgtgagcagatatcaaacttgcactcagtatagtcctactattttatccattgtgaaatttcaaaaactcaataagcatgtgggatatttacatttgttccaagaaagcatgaacggtggcatgcaggaaagagtgtacatagcaggcttgatgtggctggttcgatgggcttgctttgcagtagaccattggctggcctctgggaacctggctttggagtattccctatgttattaactgataagactgttttgtgtgcctagggcactgtaccagcttgctagactttgtattctgctttctttagtgatcagatgcctgggtgaccagcccccccgtgaaaaccttggacactgggtcttaagtgtgctttgttaggcagaaacacttcacatacattgctgcatttcattgctggaggaaggagcacattctatatgattgtccccttgagagagagaacacataaagcacactaaagcaaggatgcaggtacaactgcctccaagtcccatgagtccttgcagccaagtcaccaaatgggtgggtgtttgtgaaatgtccaaaatagatgggtgaagtttttgtgtaaaattagagataactttttgtatggaatgtagacaaaaataagatttcaggggcctctaaatttattatgctaaggaagaattaagccctggagattgagtcacagagcagttttgcaattctgtgtcttagatgatagattaactcacttcttcattgttcttattctgtaactgactaggggagaccagagaccaggccctccccattccggtcagtgatctttgttatagattaactgcctcctttattgtcccattcctaactccgactagacactgcaaaagaccccatgactgctacaccttcagtgtgaaatgttacatatacatttcctgaaagaaaaaagactacttaaactaattagatcattgtaactatacattaagccttatataggaagatgttaaactttgtctacataaacaatctcaaacttctaccctttgaaacaccgacttccattttttggaatttgcctttcctgggtggctatccttaaacaattgcgcttgaataaactctctttaaactagattctgacccttttgattattttaagttgatataaacatatactgaggagactttatatgtagccatgcatgtttaaagatcttctgtatgtgaaatagaatccagttaacagaattagaaagaggatattaagcaaatttgacagtcctaaaatcacaagaagaatgaagatagaacctgaaaacgtttgcgcagacagtggagaataacatcatctgcggggagactcagtgatggatagatggctttactgaacctgggaactcgtacctcctgctggcgtggccatgaacacagtggatcaactaaaagctcctgaattcttattgctatcctatgctgtttctcaccattcctgcatctatatgtgatcgcagagcctgctttataactcatcagctaccatagcagctgactttttctgccacactctcaagagtcaacaaagagaggccaagcattctcccccactccccactgagagagtaggattgaaggagagagtgtgaacaaagggtctcagaaggttgagaaccactgaactaacattctctaaggatcatgatgaccctgagattctatgattctgagtccaagcattctgagtcttggttccacatctgtaagatggacacacccctgttgactcacagcattgttgggaagattggcagaaagttctaaagaataatggtggccgggcacggtggctcacgcctgtaatccctgcactttgggaggctgaggagggcagatcacgaggtcaggagatcgagaccatcctggctgacacggtgaaacaccgtctctactaaaaatacaaaaaattacctgtgcgtggtggcgggcacctgtagtcccagctactctgaaggctgaggcaggagaatggtgtgaacctgggaggcagagcttgcagtgagctgagattgcaccactgcactccagcctaggcaacagagcaagactccgtctcaaaaaaaaaaaaaaaaaaaaaaaaaaaaaagaataacttgtcagaacaaggaaggaggcatgggctccaaatcatccattttacagaggaggaaaaggaaacacaagccataacttggctcttttgttcagttaaagtcagagtcaggactagaatgcaagtctccggacccctctgtttggccatttgcatgcatgttaaagttctttattaactttttgctgctaggcaaatacagtcaagtgtgctatgttatattgagtgcctactgtgtgctagatgctttatgtatatcatctcttttactccttacagaaattaaagatgggaacactcagagacatacaggactacttaaggtctatatcagtcctgagtttaaaactcagatctaagttctcaatcattttctctcatgtaatctttgctgcagtaataataaaataaatagcatttcctgagtgttgactatattccaggcaccatagcaagctcttcatgaattatcttatttaatccctgcaagaatgttagcatgaatcgtgatctcatcagctgatttcatccattcctaaggcagcagagtctctgttaaatcagtgctgagtgtgtggtaaattattaaatctcagtgccagtcctaggattctgagaccaagccaaatgctagtgattaagattataactctgatttaggacagtgttgaggctaaagccatttgtaactggacagtcaagtctacactgatcaaaatcagcctctgccccaagtactcttggaaatgatggttttcatttcattctcaaactgctaagttgtaagagtttggtagtaacattgatttgagtttgaatcctagcattgattctaccaggattcatgcaagttatttaatctttctgagccagcttcctcatttacgtaatggggatatatacaacagaaactgccttcttaaatattcaaagtatttaataactagcccagcaaagacaccaagctattagtgtgaaaaccccatggaagttccctgctgagctgaataaccagagcagggcagttcagggggtctctggggaaggttcagggtagtgctgctggtctagcctttcctctccgtttgtcatgttctccacagatggatgtggcagtgaacttggagtgggtggggaggattttggagactgagacaagaaaaaaagaaagctaggaagttggtgagaggatctgatatggtttggctctgtcccaacccaaatctcatcttgaattgtagctcccataattcccatgtgttgtgggagggacctggtgggaggtaattgaatcctgggggtggttgtttcccatgccattcttgtaatagtaaacaaatttcatgaaatctgatggttttataaagaggagttttcctgcacaagctctcttgcctgatgctatgtaagacatgactttgctcctcctttgtcttccaccacgattgtgaggtctcctcagccatgtggaactgtgagtcaattaaacctctttcctttataaattacccagtctcaggtatgtctttattagcagtgtgagaacagactaatacaggagcccacgaggcccacaaatgtggaagttcttgcctcaaatcaccaagaggaggttgcagctgaaactaagaaactagaggtagtggaggacagtgactctgttgagttaccactatgtactaagcatgttttagagggtagttctaaaagagagagtggtttctagaggtagatgtcctaagtgtaatgtttgttccatcacttacttgctgtgtggcgtagaaaagtttcctagcctctatgtgactcactttttccatctgtaaaatgggaataataatagtacacgtcacatttagaagtgagaattaaatgctgagtaaaatgctaagaacagtatctggcaaaaacagggcacttatatgtgctgactattaatattataattaatattatatctgaacattttatttctttgattatatcacagattttatattatggtctccatttcatagatgaaaaactcgaggttcagaaagataaggcaagataaggcctgattcggggttagaatccaaatctttctgattccaaattcaaactctctccccaagtcttaggaaaaagtggtaaatcatgctacataatatgagatattaatgaaagtgttctgatgatgtatatgacaaccagttcatagtatctgaccacgtgctattaagtaaaaacacagaacaaaaacaaaggctcagtgcagcttactaattcttgtgtaaagggggcatgggaagacaggtagacgtgttctggaggaagtttgtaccagcttgtaaggactgattgttaaattttcaggatttgttccggctagttggcatacacatggtattttgaaattgacatggtaaggaatatttacgctacggaaacaggcaaacactatgttggaaagataaaaactactacagaatggtaaactacgaaagagggcagatggggtagaataaggggtagaaacaagatttttctgggtagaactttctatatagtgcaaatgtattaccattaataaaatctaaaaataaaaatacctcaagtcaaataccaaagtcagataccaaactgtcatcagagtgaacagacaatctatagaatgggagaaaatttttgcaatctatccatctgacaaaggtctaatattcagagtctaccaggaacttaaacaaatttacaagaaaaaaaataaacaaccttattaaacaatgggcaaaggacatgaacagacacttctcaaaagaagacatttattcagtcaacaaacatgaaaaaaagctcaacatcactgatcattagagaaatacaaatcaaaaccacaatgagattacatctcatgtcagtaagaatggtgattattaaaaagtccagaaataacagatgctgatgaggttgtggagaaaaaggaacacttttacattgttggtgggagtgtaaactagttcaaccattgtgaaagacaatgtggtgattcctgaaagatctaaaggcagaaataccatttgacccagcaatcctgttactgggtatatgcccagaggaatataaatcatcctattgcaaagatacatgcacacatacgttcactgcagcactattcacaatagcaaagagatggaatcaatccaaatgcccatcaaggatagactggatagagataatgtggtacatatacaccatggaatactatgcaaccataaaaaggaatgagatcatgtcctttgcagacacatggatggagctggaggctattattagcaaactaatgcaggaacagaaaactaaatatcacatattcttactcataagtgggagctgaatgatgagaacacgtggaatcattgtgggtggggaggaaaaatacacactggagcctgtcagaggattggggatgggaggagggagagcatcaggaagaacagacaatggatgctaggcttaatacctgggtgatgggatggtctgtgcagcaaaccaccattgcacacatttacctatgtaacaaactggcacattctgcacatgtacccctgaacttaaaataaaagttggatattttaaaaaagaatacatgattagagagagagagagagacagagagttcatacacacattcacacatgcatccacacatgtacatgcattgtttattgtagctcttaccatggaaatagtagcaatgagcacctctagaatccatattatgatcactaattcaattccacagtgaaaggaactagagattcctagaaaaatggcaaatttcaggtctgaggcaatcacccccctccccccaaaaaaatgataatacaagatgaactaaaggcctttcattgtgctaaaaagcaaagaaactttcaaagtttactactgtaacataaaaaagacccaggagccaacttacaaagtgtcatgaaatgttatgagaatttgaacataaaaacagtaataattgtaatagatttaaacattcagtcaataaaaatccacaagtctatagtaatatttagaaaatgaaaagaaaacccctatttcttatcattttaggcagtttaaaacaattgattacagtctgcccttcatattcatgggttctgcatctgcgggttcaaccaactgcagattgaaactacttggaaaaaaaattcacaaagttttaaaaagcaacacattgtttgctacatgatgagtattacattgaattcacgtaaattaagtgatgtggcagcattatatcagatattataatattctagagatgatttgaagtatatgggaggatgtgtgtaggttacatgcaaatactatgtcgttttaacggacttgaacatccagtgattttgttctatcaggggtcttggaaccagtcccccacagagaatgagagagaactgtactttgaaaattggtaattacatggatagtgttaagcaagtatctttcttttccagtagaatctatgctttggtgttactaaatagccctagttaagatataaatctccagtgtataaaagaacatcagattaagatataaatatccaatgtataggtaaataggaaaggagtgattgaatttttaaaaactttaatttataaaccctcttgacaatattgtttggagcgaaaagtttccatagatgttaaagtcattagatgaacatttgatggacaactggatgtttgaataatgtcaataaacaccacataggttgctttctggatgcaggtgaaaaatgacaactaaaattgagttcagtagtattcaatcttagcttccatagtggtgtttattagtttgcttgggctgcctaacaaactacaaactaccacaaaatggttggcttaaacaacagaaatttattttctcacagttctggaggttagaaatctgagatcaaggtgtcggcagttgtttcctcctggggcctctttccttggcttccagatgtccaccttctcatgtcctcacatggtctttactctatgtgtccaggtaactgtgttcgtatttcctcttcttttaaagacatcagctacattgaattagggcctaatgacctcattttaactcaattatttctgtaaagaccttatctccaaatattccaagtattctgaagtactaagggttaggactttaacacacgaattgtaggggttcacacttcagcccataatggtaggttaaacaaagaatatgtatttttgaatatgatgtgatgcaacatgtagtatactacaatatccatcatgtgttctagtcaaaattatctaaattaattacatcaagtttacaggaaatacaaagaataaaggaacaagctaaataatacccctaggagacaaccaaacaaattcaccagctgggacaatctgcaggacgacgtgtccagtctttttaacaagtaagatttttttaagtaataggaaatgcttacaaataaaagagacttaaaggaataaacagcatgaactgtgctgtattggattggatattgttttaaatgatttagatgtaaagattgggggttaattgaggatatttgaatattgcctggatagtggagaaaaaggaactttaccaaatggaaaggtaataattatggacccaaaacattaagtaccgtataattttacattgattttaaaaagggctctttgcttctgaccaagacaggaaaaaagagatcaaatttaccctgtagcctgaaacaaccaaaaaaacgtaacaaaatatatgaaacaatgatttttggaacactggacattagaaaaatagtgacagtgatcttcaagagacagtaaacacaataaagtgagcccagcttctccagcttattgaattgagggggtttccaggctgtaacatagtgggagagaacccaggtagagcctggcaaacttcatgagttgaggagatgaataaatgaggtaatgaagcttagagtctaagaagatcaaagcaggtagagttcacaagatagcataccagagaggagacagctgcacacagagagaaaaccagagaactgcagagggactcccacttaagtattcaacagaattctgatcaatgcatatttgtgaggaaagtacctgaggcctctaggggggcgggggggaacaaacactggaaaggtttaaggcagggatgtccaatcttttggcttccctaggccatattggaagaagaattgtcttgggccacacataaaatatgctaaaacaaatgaaagctgatgggctaaaaaaaagttgcaaaaaaaactcataatgttttaagaaagtttacaaatttatattgggctgcattaaaagccatcctgggctgcatgtggcccatgggctgtgggttgaacaagcttggtttagggaaatcagtgcctggagctcagagaggatcagaatactgtatgttcccacaagtcaaactggaaaaacctcatgattcataggccactgggtggagtacattgaaggattttgccttagtaatcgctaataaataagcctagactgagcattgttcttgtcatatattagtaaacattaaaagcaatactggggaaaaaaagcaatactggaaaggatcaaactattttaagtaaattaactgtgtcctgcaacaaagttcacatatatttatataaatacaaaaacatccaccaccacacagggtaaaattaacaatgtctggcatctaatcaaaacttatgagacatgcaaagaaacagaaaaatgtgatccatagtaaggaggaaagacaatcaataaaaaccaatagaactgacagagatgtcaaattagtagaaaagaacatcaaaacagttgtaacagcattctatgggttcaaaaaaaattaactacagacataaaatatataaaaaagacccaacataatattctagaaataaaaactacaatgtctgagataaaaaatacacttgacagaattaatggcaaattagatgttgcagaattaaagattaatgaacttgaagacacagtgatagaaactatttaaaaataaaacatggagtaaagggtgaatgatagtaataaaaaagatgaacagagcatcattaaaccatgctacaactcccctggcctaatatatgtgtaattagtcctgaagaaaagaagagaaagataaatagatcaaatagttaaagaaataatggctggaaaatgtacaaatttgagtgaaatctgtaaatccacagatccaagaacctcaatgaacccaaagcacaaaaattatgaagaaaacagcataaagatgtaccattgtcaaattgctcaaagccacaggtaaagggaaaatcttaaaaatatccatacaaaaaagataatttatatttagaggaacaaagtgaagagtgacagaattctgaagaaagaatgcaagtaagaagacagtgaagcaacaatttgtcaatactaacccctcaaaaaaaactgttaacctagaattttacattcagaaaaaattgtagaaaacaaaggcaaagtaaagactttttcagatattcaaatgctaaaagaagttacaaccagcatacctatactatgggaaatacttaaaggaagtcccttaggcagtggaaaaatgataacaatttacgaatgggaaacttgttttaagaaaggatgagacaatgttgaagataaagtccacagcagacaagacaatgttgaagatgaactctacagtggcagatcacccacatcaatttgcaagaaaaaaattcatcttttttgtgttctaactgaagaggaccagaaatcaatagcagaaacaagagccaacatcatagacatctcaattggttcagcttacactattctgactgaaaaattaaagttgagtgatctttccacccaatgggtaccaaaaccactgtgtccaagtaagctgtagacaacagcagagctttcaatggaaattttgggaattgtaaacaagtgggattaagattctgaaacctttctttgaagaattgtaagaagagatgaaacaaaattgtaacaagagatgaaacttggctttaccagtacaatcctgaagacaaagcacaatcaaagcaatggctaccaagaggcagaagtagcccagtcaatgcaaacgctaactgggcaagagcaaaggccatgacaatagttttttggaatgttcaatgtgctttgcttgtaggctttctgaaagcccaaagaatgataatatttgcttattatgagagtgttttgagagttagtcaaagctttagcagaagcagggaaccttcaccaaagagttcttctccaccacgacaatgttcctgctcattcctttcatcaaactagggcaattttgtgagagtttcaatggaaaatcattaggcactcaccttacaggtgaatgatttgggttattcttttattttttcatttcttaatcttaaaaaatttttaaaggacacccatttttcagctaatcatttaaacaaagatggcattgacatggttaaattcccaggatgctcagttctttagggctatactaaatggctgatatcactgcttacaaaagtgtattgaacttgatggatcttatattgagaaataaagtttatattttttattttatcttttattcaagttttccgtgaattttttgagatcctctcatatacatgtctatattacagtggtgatattatactatagttttgcaaaatattaccactggggggaactgggtaaaagtatatggaatctctgtattatttcttgcaatctactatgatctaaaaataaaaacttcaagaaaacaaaatttattgttcaaacaaacatagtaacaagtcagtgtataatttctgacactgtgtaaaagtaaaatgtaaaaaatccacagcataaaggttgtcggaaagatagaggtatactagtgtaagtttctcatgttataaatgaacttttataatattatttaaagtagactgtggtaatttaaagatgcatactgtaaaccctaaggcaatcactatactaacacaacaaagagctatagctaatgagcgaagaaggagatacaatggaatcataaaaatgtttaatctaaaagcaggcaacaagaaagaaaaatgaggcaaaggaaagataggaccaatagacaaggagtaggaggtagatttaaacgtagtcaggtcaagaatcattttagcagagattgtcagtttatactgaaaaggtaaggtccatctatattctgagtacagtaaactcactttagataaactcactttaaagacacatataggttaaaagcaaaagcatggaaaaatataaaaggctaacactaatttcaaaaaagctgagtgtctacattaacatcagacaaagtagattttagagcaaagaatcttaccagagatgaagaaggacattttatactagcaaacaggtaaattcatcaagacaaaacaatttgggacttttatgccactaatagtggagtgtcaaaatatataaagaagcacctgacagaatggctaaagataaaaacaatccataaatatagttgaagattttaatacccctctttctatagttgatagaacaggtaggaagaaaaaccgataaggatatagaagattttaagaacacatagaggtggcagaggcaggactcaaacctaggtcgtgtagctccagaacccttgctcttaacctataggcatgctgatctgtatgttgtagccatcaggatattttgctgtgtcagtgattacccatttacaatggatgaattcactaagttctaagtattagccttccctgattttcaaagatcctttttatctttattaggtagaagacttgaaggagatgccatttatgtgggagcttgaagggatcctgcaacaggcactgaagttgatttggtttcagattttttcagtgtctggatgaattattttcttgaatgaaacactctaacctcaaaagagcaactcacagtagttcacaaagcatatagagcctaggtagtagatcgtctatgccctacctgtaggccaacacgctcagaggggacccctttgcatctgatcccaccttttactttatctgtttgtgcttacaagaattttcatccttcagtttctaagtgcagatgtctttcagttgcattgatatgtctgggctcagaaccacatggtctaatacaatgaacactgcactagaagttccaatctcaaatctgcttttcactagccctagtcatttaatgactatgatcctcagcttcatcccctttcaatagggtccataatggtcattgtgaaaattgagattatgtttcctactcaatactactcagtgtggacactcacttggcccttaccattgttagctttcttccttcctaatgaacaaaaaatagcaaggagcaaactcaaaaccagggcacacagaagagaagaagggcctggcagtccatgggaaagagtcagttttcttcatgtaaatgccttttggggagaaacagccttgcacagaagtctatcaatacaaattatccagattgtaaacttgtttgtatctcactttccgttttctgctgacatctaccctacatcaataaaatcagctgaaataattttaaaagatgcaacagaaaactttctctaaattataatcttccagcatatttcagaattcactccacctgtattctgcgtatttgatcttggaacagaagattagcaaagtggaattgataatacttcctatctttgaaaggtgctgaagagttaattcactaagcaacaatttaaaaataacacctgagttatctcagagccattttcctaaagaggctggtggaactactgaaacaatgttcttaaaagcttttttagtccttcagtcccccagagatcattcaaggagaatataattttatgtgatgaaatgagaactggaggagaatataataagtgttaagtgattgaatcaaattgagtgtttgctaaatgtttcctaaatgggttgacaaaaaaaaaggccatgagattccatgtagcccttcaggactggtggtcttgactaggtcagatgtctgagaagttgtggggaccacatttttttattcaagcagtgctaaagaaataatatctcttagaagaactattgatcagcatttcatgatttgatcattattcattcttaacctctctatgctgcagtgtcttgatctgtacagtgggaacaaaaatagcatctacctcaaaggtttgtggtgaagattgaataaaaaattaattaagatatattttagaatggcatctggtgtacagtaagtgcttgaataagttagtgattttcaatcatattaattactttcttccagcaaacctatagcacctactctgtactgggcattgtggtaagacctagtgtatcagtcaggctcatagttgcaaacagcagaatctattgtagctaatttaggcagaaaatgaatttttcaagagatattgctagctgatagaatctctggtgggacagctactggccaatagtggtagccacagtgccagtttctactgcaggattgctctaatgaaccttctgcggcaaccactgataagaagctccctagcctgcggccattgctgaaagtcagacatccatcttgttggaaatggattcagcatggttccctgctttgggacacaatatctgaacataaggctcccacgagttcatctgactgggggagaccaggtcacatgcctagctattctagctgcaagggaacctggtaaagtgagttttaggattttaacttgggataagactctttgaaagccatgacaaatgtccactagacctagcctctgccatggaagagcacagtctagtgatgagacaggggtataaataattataacattgggagtagggaggtttgtattattatccagcacatacctactctcacaccccacaaagagggagcctgcttaactttagacttggtgatgtgacctgctttcatttatgcaattgtgggtgaaaaagatggtttggtagctccaagcaaaggttttaagaggtatttcaaattttctctcagatttctgccctctaccatgagaacttcacatttatgattgcaggtggaaagtagactctccttcagccttgacacttaaattgagaaaagttgtgggtcagaccccaaactcaaccacagtctggcagggctatagcatcaaatccacaggtataacatgagtgagaaatagttatttgtatttgtacgcctttaagctctggagattgtatgtgataaagcattattatagacaatgctgacttatacaaggagataaaggcagatacaggtatatataccaaatgctggaggaaacttagaggaggtgataattaactggagacttttaggaatgcatcacaaacgaagtgacctttaggaagagttttgcaggcatttaggatttgtccaggaagaaaagcccagggaaggaaatttcaggatgacatatgcatatgcaaaggcacagagaattaaagtggtcagacatgttttcagaaatacaatgggttaatcccagcatatcccaaattgtagtgatttaagtatcttgtgttatcttttcaaaccagcagtacaattttacttattatcttattgaaatcaatttaccttcttgctctgctcccaaccttaatatcgttctagacaaaaatatttgtaaaatctcaagcctgatatcttaatcattttttgaatacatactaaaatacatgcttaactattataagtataaaaaatagttttctatgtgtcaccaatgttatgtgccctgtgttgtctctgactctgctagtagactatgaaatatgtcttcttccctgctttatagtaatagaaatacattttgtttgaggaagcactgtgcccagtttaaaaatgctcacctctccaaactcctttgcagacatcccttgagttgcctgtgtgaccaaattctggccaataaaatctaagtttactggatggtactggataaaatttagttggcaggtgccttttgcattttcatcatcctatccctttctcccttttcttcttttctggagcctggattcagtccctggaagtgtggtagccacctctgtgaggatgaaaggaatatgctgagtggcagagcagaaagctagacgaagcctggtccctgttgccttcattttgcaggtactgtagccctgcctgcagttgagccattatagacgagtgttcgttacatgcagcgtaatataatcttacctgacacatacgttctggcaaaccctgggctagagtatagcgttcaagtctgcgaggccaggaggtaattctgggaaggctggcaagggccacatcccaaagatgcttgcagagcagacaaacaagttttatctttgtttgtttgtcttttggcagacaatggagtgaaacaatttggaaaccagggtgtcatagatttagggccccgtccaatcacccggactatttttagttcttttcccattatcgtgaaactcatatgggagccagaaaatcttattatttctggacctaattacattaactacaagctgggaaaatcacagaaggtctagacttcactttgttcaactgaaaaatgccatagatccctatattagtttcctagagctctcataacagagtaccaccacctgggtgtcttaaatagaagaagtgtattgtcccacagttccagaggccagaagtccaaaatcaagatattggttccaaagcaggattggatccttctgagggctctgaggcgggatctgttccaggcctctccgagcttctggtagctgcaggcattccttggctctgtcttcacatcatttttcttctgtgtgtgcctggctctgtgcccaaactccttttcctaaggatgcagtcttattgtgaatgctctattttaaaataaggtcacattcacaggtaatggggattagaagtggaacagctttatggaggacaccattgaacccatagcaatgcccatctctcagagttgtgaatatcacatggcatgcattggcatgggttggaaaacaaggcactgtgggagggtggagaattgcgcatcatgtgtgctggtgcattgatggaacagaacacaacagcctgaagaagtggaatgtgaaagagggacactgggtcctgattctgtcatggacattgtcaccagctggtgactgggagccactttctcgctttcgtctcaatcactgtgaaacgataataacctcaactggcctctctctgcctagtttctgatactgttggatattctgggccagccattcgaactttcacagaaactttccttccccaaggttttctgactttaggccttaccttagccgagtgggctgttgctgaggtctgagtatcaaaatgtacaatggtggtaatgaaagtaacaagcttataacaataaagccaattggaccacttttagaaaggtctaagatattatttgtctagctgatgagaggattagcttgagcagagaaggtttctgtggagcaaagaagttgattaacttggatgctagagaattctctgtagtgtgaactctgtttgttgtgggaaaaaccttgagtaaacaagtagtgaaaatgtaggacaagcaattttatcttttattcctagagaaggggtcctagttcttgttcagtttctttaattgctttatgaggaagattgtttcttgagagtgaaatgttttaaatattgcctggatttaaaattgggtaaggaggtcagcactgcctgacccagcttaaatttccaaagggccaatcacaagtatattgcacatagactcagctggctgcaaggcagagattttattttcaagatgacagtttcatttcagttcatttcacccacacttggaaggggagagagcttcctatgaaattaactgagcaccatttcttatttcatttttgcttttctaattaaggattcaggtttgtggctgcctttccagccaggttcatgttgaactggcagactcagctgtttagaaatagaacttgagctttgaagttcaatatttcttggttcatttccaggttctgctgcttacaagtgctgtggctttgggtacttaatctctggattcaactgtaagataggaaaaataattacataaaatagcaagttctaattgacctgtggagtaaggtgcccagtaaatttgtaatttctgtttttcccattacggaaccttcctcccaggattctgttcttccagatgaaacttgaacctgctaggtttagccatttagctatgtatctatccatgtatttatgtatctatctatctatctatctatctatctatctatctatctatctatctatctgtctatctatatcatctatgtatgtatgtatgtatgtatctgtctgtctgtctatctatctatctatctatctatctatctatctatctatctatctatctctattcttccatgcatccattcatattttgatcattccttcttcctttttcctatcacccaaacttattcttcctgtattgtgtcccattagaggctctttgtatatctgaaacttacctaataaactaattcatgggaatgtttaaaggcttagagaataaaacattttaaagctagaaagagctttagaattttagtccaaatatcttaatttacttatgaagactgtggagtaatttgggcaatggttcatggtttagtgggaatatcatactaatttgcgtaggtttcccagacctcaaatgcagtgaaactaaacagatgaaacattttcccatacttgtattttaccatgaggaaagatgatggtgattatgatgatggtggtgattatgttgataacaacaacacacattctttttagcctttctcctgtacctaatattacactcatgtagtacctcattttatcctccaaaaatcttctttgatgcatatattgtgattttatagatgaggaaactgatatttagagaggttaagtaatttgcctaaggtaatacagctgggaagtggaggagccaagatttgaacattactttgaatttaaaattcaaatttaagctcttaatctctatcctcttctgctggcataatcaggccagaaagtggtggtggtgatgatgatgatgatgacaatgatatcactgaatgtttatcgagaatttactgtatactaagcacacagtaaattaacacatatgatcatgcattaacacacttaatcatcacacaacccaataaggtcaatgcctttattgtcccattttttgaatatggatatggaggcagagagaggaagttaaggatcttgccccacagctagagatggtagatttgaattacagcccagctattgtgttctcagagtccttactccaaaccactgctcagggcagtttgttttgcaaaggcagggagtgtggcagactggggtatgaagtgggcagcaaggttgtctacatttcaggttgcacacgggaatgcaccatgaatatatccagctaatgaaattatgtacacaaaggtattttgtaaagtctaaatcacaatcatggttaccattacctattctcagccttgcctaggacatggccaacaacagctctgttttaccagtgaggtctgagtcacaaggacttagtgtttgtccctgggatgagaatcccatcctctgagagctcataaccagaacagtttggaaccagggcaatctctgtggcctgagtgtccatagagagccagggagacaatgtgattgggtgaagattaaactatgggaataatcttgacttcttgcaaaaacaatatggcccacttacattatttctgatacacaatcagttcttttttaactttttcaatgtttcaaagtaaggatagtgggataatcactttcttcataattctaccagaagccaaggggcaaataacaacccatttgctctctagcctcagaactggggagttgtgggatctggcattaaagggtgagctctggacacatcagaggagccaattattattcaacaattattagtacaaactgtattgatcaggatctattgggaaaactgatacatcaatcatttcaaagtggagaattattacaaggaataattaaacaagttaacggacggaaaggcttaaggatcacactaagataacactcagctggtaactgcaggatgctgctacactgctagtggctggagcaacaagaaagagagaatgtggttcttagagcctagtgctgccaattccaatacagaggccaccagccccacgtggccgttgagaacctgaaaagcagccagcctgaatagggaagtgctgctataagtgcgaaatgcacactggatttcaaagtcctagtgtataaaaaagcaatgtaaaatatttcattaaaagttttaaatattaattacatgttggaataataatattttgggtgagttgaattaagtagcatttatggttgaaattaatttcctctgtttctttgtgtcttttgaaaagtggctactagaaaatttaaaattacataggtgattttaatttgtagctctcattatacttctgttggacagcactaacttaaaagcttggagcagaggccccatgtttcagaaacccagacctccaaggaggtgagtgggatgatggctggtgcttgaatctcagtgaaggggagtgaccacgctaatttgggggcatgttgaaaaaccacaaatgggaatcactactctatcagggtcaagaacttttgcttgggtgacaatgatgaagaggaaagacacaggaaggtatgtgtcctttctttctcctctacatttcagactgtctccgcaatgcttcttattagcagaacccaacagggaatcagatggcaaaagagaaatgtttgcagagttccagcatctgcctcacgaccggtgtaagaaagggtgggcttggcattaagagtcagtggtttaataaccagcatgactggcattgcaaaaactacttatttctcaagaaagcaggaattctagattgctttttaatgcgaaattttcctagttctaactgataactaaatattttcttaaaaattatacagtctaaagaaagtacatctgtaggttccgtttcttgttggtaatgatctggggaccatggtctggatgtctcaagatcccatgcagctctgacttctatgtttctatgagcatttgatatgtgggtaataaaaaaattgaagttccctggggagagaccactgtgggctgtagtctaggaagacttcctggaggaggagaggcctggagtgagttcttggatattcttaccagtaagcatgcccttatacaatacccttagtccatcactggcagctttttcctttgcttgcccccatgtgtctgcaaatactggtcggagagtgccagcattgtttataatcaagggtggggtttgcctgggccaaaagctgagtttgtttagacccaaataaggcatcccattgacagcctctccagagtaacttggaggcaagtcatgactttcagatgcgggtggtgttggggggatcttgaaactgctcaggaaaaatggctctttgttgagttatttcttgttgttcatatgaaacgggggtgaatctcaaaagtatacgtttccatttctaaatgttgatgtttgtttagtgataaggaaagaataagatcatgtaataaatctttcagaaattaaaatgctaatgccagtctttaaagtttgataaggaagaacctttaagtatgcttgtgaaaatctaatatggaattattactggcattttaaaactctttaaaaaatttcagcctggattgcaatgtattccaggccaagcccttctctagggaaaaaacaatgggtatgcaactgtttacaggagaaagttggtgcagatacactgatgaattcccatctgactttagttcttgagtcttgcaggagcccttctcttggctgttcactccatccagccatctccactggagcccacttaaggaacttttccaacttcagaacttacggtttacaaaatcactgcagcccctaatgtcctgggactttcaaacttctgtttgtgttttagtttgtgccctgtggctacatagcttgttggaggctacttctaggaagagctcacaatggagtctttacaggcttgacgttcactagaccttgcagtgttagacactttgctttggaatcaggtgctaagactagtgatatggagatgcagtcaggcctattgcctgagctccagctgtggacagtgcatcagcataggagccaaaggtgactgaccctgaagagtggctgtgggatggccagccacctgctgggtggcctggagtgaactctagctaacagaggtgctccatgctgagtggtggcaatgtcaaccatccaattcctatcttagcagaaatataaatttatgataaatgaagagaaggtatctcattccagatttctttctgtagcaatgatgagttatttctttgatttttctgttgacctactgtgtactccagtgtcaaaagagctgaaactcaatggtatagttggtttgttctttcattcaagtgtttattaagatgcctaatatggggcaatcactttactggagtctagggatacagctatccacaaaacagtctttgctatcatggaacatactcactaacattgggaaaggaaggtagtaaaaacacaactacaaggtagtatgtaagttctgtgatggagataagtacatggtaggtagtatgtaagttctgtgatggagataagtacatggtaatatggaagcacagagaaggggtcactagcttggtgtaagggtgttagggaagcttccagaggaagtgtggggcaaaacaagaattgagcgatgtatagaagttagccacagaaagggggggctttctatgctacctagacatctttgcaagaagcctccaattccaaaggtcatctatgcatgactttggatccctgagcagttttactctaattgaccagctcagagtttgtagcttagtggccttaggagatcagtccttggtgtaaggaaactgatccaggcttctcaccgtatctccagcccacacgttagatgtgactgaaacatgtaatgaagcatccaggggcagtcaccatacagaagtcagaaaaaaatgatggataacttgggcccctcactgacccctgtgaatggaagttctgagcagaattagatagtccaatacagaaaataatgtggcatgctctctgaaatgtaacagctctatttctatactaaccctccccttaactagccaacaattttgctctaagggacgagataaaccacaaacttaattctattcaattcctcatcttatatcaagagttagtgtaaaactcatctcttctccagccagaagaactatctctttctctctgtgtttccatagcacatgttctgtgttctttaatatcatagcctttaatctgtgttctgcttgggaagtggggaggtgacttatggatggctttgaaactctcagtagattgagtgcttctggaaggcaagacctattttttgtcttaaggtcttgcacttagtaggagttctaaaaataatttttgaaatgaattgctgagagacttgaagtatagtcaccatcttctggacagataacttgacttaggagcacttttcatgcttacttgtttttggttgggaatgtatctgcaggtgaagagaatactggaaagaatagaaacttttaaagggttcaacacatattttttctcaaaacttgtctggaaacctgcatgacatctattgcaaaaaacattaggattctagagagttaaactctatgctgttacctgtgtctcgtgctgtgatgctgtcaaagggctactttcctgggtcagcttcttaggtgactcttataagaagaggacaagagctattacagtggagcctgcaaaagagcatgcactcaatactcaatgttagttaagtccttattctcatattccaagtctggagaattaggcttttatcggtgaactccctttacaaaatatgcacgctttccaggctctctggctgctgctgttctcccttcgtccccaataccacaggctctgaaacttcaccattaattactgattcctttgtaattaacagagccctgtattaagagacaggttccctctcctgcagggagcaacagttcagctccaatgaatgaatctcaacaatcatttttgttgttgttgtcaatatgagggctttggccttagaggacacagaaggagtatgctgccttgaaatacatcatggtattggaaattcaagtctcagtacaaagaaagttggctttcctgggaagctgatttgtttttatttttgggccctactgttggtgggcggtgggtaatagaacccactaagatagtgcttctgacctcactctaccctcctggattagtctgttctcatgctgctaataaagacatacccaagactgggtaatttacaaaggaaagaggtttaatggactcacagttccacatggctggggaggcctcacaatcatggtggaaggcgaaggagaagcaaagtcatgtcttacaaggcagcaggcaagagagagctagtgcaggggcactctcatttataaaagcatcagatttcttgagagttattcattatcatgagaacagcatgggaaaaacccttatgattcaatcacctcccaccaggtcccttccatgacaagtgggaattatgggagctacaattcaaaatttgggtggggacacagccaaaccatgtcacttcctgtctgggcagtggagtgacttactggatcaatgaacttgagaagggaaagtgagtgcagcctcttcccaactcattgctcttatgaaggcagcacgggttctgtttggtttgctgtcatatggcaaagtaggcctctctgacaagtcttcagggctgcagggccacctctgactggctggctaagtctctccaattcagtttaggaaggcttccttcctgcatacatcagccatattttccacgtcagcattgtcagtagcactatgatatttgaatatttacgtaactcaactcatattcaacttaaattgatacaaaattttgtcaggaaagtggctccttttattgattagaatccctctcactctaacatataaaaatcacaattcatgattcaccctttgccttgatcttcaggaaattttcaacccaaaacataagatggttaacaagtgtaatgatacacagcaaaatataaacaaaatacaaagggactggtataatttttcttttcctttttttttttttttttttttttttttagatagagccagtgaagtcctttggccaggcatgaataaaagaactgtctttatttgttcttgtcccaatttctcttcatttgttgctcaggttctgctgagtctcacaggtctgtctcttattacttttatcccgggttagccaccagcatatgtgcttttctttgatgatagacataatatgaaattacagacaaaaatcttgatttctgcatactattgtttaaaaatgcaactttaaatacagacactcaatgaaaagcatttctgaaaaggtgttgctctaggcaagggttccctctgttttgtgatagtactgttcctctctgtctctgtgaaggttctacctctgccgttcttccttttgagtctcgttaacactgtgtttattttacactcctccacaataagagctgaggagtgggaaagcaacccttcgactggggtgtgatctgaaaatggattcctcctttgaacagaaactcagaagtgattacaacagctgtaaaaatgattaaacatgcttttccctctcccaaacacagcagctggagttttattgtttaaccaattcatgcccattgttagagagtttacagtttcacctccccaagcctcaggtttttcctccatgagggaccaaatatagattctctggcctctgagtcctttatttttcattgcttcctttctaagtgaatcaggtatccatggaaacaaccgaagattaatactcaaaatagacaatcattcatttctctctgaaccatacagcaaaaataaagattgttttagccacaatttgaattcttgcaacaaattatgaagttcagttgcacaatataggtagaaaggaagaggctatccctctaaacatttttttaaaaaaatatctgagtgtaaaaatcacagaaggccagaaacagtatgtttatcttaggtagaagcatcagctttcatgaacactggatctggtcacttaatgaaaccttttaaaattaggtgctgtttgacttcaatggaactgaggtgccaactgtatttttgtgctagtggtgacccagcttgccaaagctcccctactgtgacctgggccctgtacctacagcagttgtaggtaggttctagcctgctatcttgtttgcactctttgtgaaccacctcatcatctaatatctcagttatttatcttctttttcccccaactacattccctgggaccaatattccgaatggtctatctggatcacaagctgtatttttggctacaggagagcagaacaactgatctccccaaaggaaacaagactgttgtctagtagaagaatagggaatggatactgcaaggttggaagacaatccatgtcagtgaccaggttcacatgagatagcatgtgcagatgtggaaagacagcacagagccatgagacaaggaggtacatggttggcagaagtagtggggactgcattagaattcctcaggctgtaaaactgggagtttgagcctaggtagatgactgcacctgacatttaagaattggtagatgactgttgttagacactgtattgttttgactactagtggggcagaacatttgttgtctatttattcatgatttacagttctataattttctaatgttccttgtctactttctcttataattttttccgataaagcaatgctttttattttaataacaatgataactatttgcttggtagatttgtgataattctcccagttaataattttcttttagtttgatgttacaaacaagctttgtatttttacaaaataaaattgtattagtccgttctcacactgctaataaagacatacccgagactgggtaatttataaaggaaagaggtttaattgactcacagtttagcatggctagggaggcctcaggaaagttacaatcatggcagaaggggaagcaaacacgtccttcttcacatggcagcaagatagagaagtgctgattgaagtgagggaaagaacagcatgagggtaaccaccttcatgattcaattacctcccacaaggtccttcccatgacatgtggggattatgggaactaaaattcaaaatcagatttgggtggggacacagccaaaccatatcaaaaattaaataatctttttaatgaaattttaatctattgcttttatacttgacaagtcagtctacaatcacagacaagaaagataatacaactatattttcttcttattttacacttctgttttacacatttagctgcgtgttctagctgaaatttatttattttctcttctgagtgctgagaatttacaattatgtcctcctcccatagttagctaattgtgtagatatcattaatcaaataattctttcctttagacttgtgatgccattatattataaacaaaatctttacacatgctagagtttgtttttaagctatctattctgattcaacaatctgtcagttgtcataagtacaatattttttgaattactgatgctttataatgcatttaaagagagaaaaactgctcttcaccaattgctcttattttttaaaagactccttagcaattctgcttgattgtatttcttaaagaaatgtcaaatgatatttgggaacaaaataattttgggattttgattgaatatttatgttaattcaagataaatatacatctttgtagaaacataatcataatagtacttggtgtttattgaatacttttgatgtttcaaaagtgcaacataaataatatctcatttaatttccaaaacaaccttatggaataggttcttttatgatattcacttaaaaaatcaggccaagaggaataatttccaaaatccacatcgctgattagaggcataaactcaggtctgactctactgcttatgtatgagagatccttccaattgtgttctttttctctatcatagtagatttttatcattttgcttatatggattttatacttttaaaattaaaattattcctgcatattttatatacgttcttgctttcattcattttacttctctgcagttatttttgacaaacatgaaaggtgctaatttgtatattgatagtgtaccaggccaacttgggaacctgttgaaaatgctctcagttaactgtcttggatgttcaccagcaaaaaaatgatgtgttaatattgctaacgtggcaagtctccccaatttgatctacagattcaatataatcctcatcaaaattctactctgaacacagatgcatgaaggaaatgaaataatagaaaataaaatgtaacagtatatcatggaaataatttaccacgatcaagtagagtttaacctagtaaagttaggaaataaatcaacaaaataattcttgtgaatagtacaacaggcaaaagtatacttgatcatctccttagtcggaaaatggcatttgctaaaatttaacttctgtcagtgattaaataaaaaacattaattagaacatttaattaatttatttttatttacttatttaattagagatggaggtcttccttccttatgttgcccaggctggtctcaaactcttgcactcaagtgatctcccaggctaggcccagccctggcctcccaaagtgtcgggattacaggcgtgagccaccatgcccagccagaactttttagaagatagttttctttacatatgataagattgacaacatcatattaaatgaataaacacactagaatcaattttactaaaaccaagaataatacaaagatgcctgttaccactgtcaactatttagcacagtttaacttttaggcagtggattaaataaagaaataaaaacaaaagataagtccattgaaaagggagagagaagatcctcagtatttacaaatgaattaattatattttttaaaaattctatagaatggaatgagaattacagagaaaattaattattagaattaataagaaaattcagtaaaattgttcaattaagacatcagtgtacagaaatgtagcaattactagagcatagaatggaaaaaaattccattggttgggcacctgattatgaggaaacaattgtaatgaatctcataggcccctgcttttggaatccttgtgatttaatgtggagatggcaaatggaagaaacccccgctcacaagctctgctgctttgccatggcaggcgctgctgagttcacacctttcttcactctgaataagttactacctcagaagctttcccaatgcaagttcccgagagactactcaccatcttagatggtgaggaaaacaaaacttgtttgatcccttatagggcctacgttttcccaaatttcctttttctgcaaaatgaaagttttcatttttgtgacaatggatttcagctatatctcagaagcccatgctattaaaacaatttcatgctcatttgtgaatttttgaagatctcttttacggcattaatgctttcactagaacatgacagaggagtttgtaaaccccaaaagagtaaactacttgtaacaaataattgaaagagagagaatgactttttattactggattgacctaaatttggaatcagagaacagggctgaagatagagcatgtcagctctggaaggcatcaaaaggagaaccagtttgcttatctgaggaatttttttttttttttttttttttagacagtctctatctgtcacccatgctggagtgcagtgtcacaatctcggctcactgcaacctccacctcccgggttcaagtgattctgctgtcttagcctcctgagtagctgggattaccgtacacaccaccacacccggctaatttttgtatttttagtagagacagagtttcgccatgttagccaggctggcctcaaattcctgatttccagtgatctgcctgccttggcctcccaaagtgttgggattacaggcgtgagccactgctcctggccaggaatggatattttcaggagattatttgaaggctactggaaagtgagaaatgtttcatttgtctagaatggtaaagttttagagtgaatagaaactgagaaaaaaggtagggtttggtggggcttttgatgttgcttcaccaatttccttaatgtatagttttgttttttttttttctcccgatatggcgtcttcctctatcgcccaggctagagtgcagtggcacgatctgggctcactgcaacctttgcctcctggattcaagcaattcttctgcctcagcctcccgagtagctgggactacaggcatgcaccaccacacctggctaatttttgtacttttagtagagatggggtttcaccatattggccaggctggtctcgagctcctgacctcatgatccacctgccttggcctcccaaagtgctgggattgcagccgtgagccactgtgcctggccaatgtatagttttaaaaacttttcaatgtctttttcagctcagtggcttcaagcaaaaaacatctttatataaacaccaacagttcaaatgcattaggttttgtttaaaaccgaaacttcccaatactcccaatgatcagagacaccatcttaactcttctgatgaataaaaggaggtggccagagaggaactttgtggaaacaaccagacacccagctatgtgtatgtgtattaatgtgttaccatccaccatctctcttagtctttcctgacaatacacaatcacagcatttgccttttccccagaaatctgaggcttaacagagaaaaaacagattttggagtcctgcactgattcaaacttgaccttgctattttctgtctgtgctaccttggcaaattattcaccctctctgagtttcatatacaaaacacttgcatccccaggttgcagtgaaggataaattaaatgcaaagtgctacatggtaagtgcacaatacatttgagatccatacctctaaactcctagagcttttatcttctgtgctttgttgacaccttgagtttattcagccttatgtatgtggttagcattttatgcactgtcccttatcccaagtcaattgagagcaccttgaaggtggaggctaggtacaggaatctctagtaatgcttcgcatggtgttaggcatatgtcagatacccaataaatgaagtttgatttaacaaactcttttgaaccttcaacaagcctatcaatgataaataaattctaataggatgaaaaaagggaatggaccagtcataaataagtggggtaatacattacaggatcttccattagtggaccattatatagaaactaagattatgtttttaaagaatacttaatgaggtagctcatgatatattatttaatgaaaggggtagaatctgtaattgtctactctgaatatgatcagtattgtaatgtatgtgagacaagaagacttgcaggatatgtatcaaagtattagtattgatcacattagagcaatgagattactttcttattgttcctctttgttcaaatgatgtacaatgagcatgtattactgtacaatcagagggaaaaagcctagcaattttttcttatggaggatggaggggatattccattataaaatgaatttcctaaggttgctgcaaatcctgctttagggaaattgatcttgatggccttgttctcacagcaccccaccccacatagcaccaatgtgagttgtgttatcctattgcattaaatgttcaccccaaggttaaagagaaatagagaaagaaaggatttcctgcaggactgggccacttatttataagtcccttgtcagatgcccttgagatttcaaggtgttaaaaaggggcctccctgcttgtgccattaccaggtaagcagagtcttgacctctgatgtactctttgacaaccccacaaaatacatagtgaatggcagcagggtggatgtcaggacccctctcccaggccagaggatgctgacctgcagactgtgtacctgacatgacagcaagtctaataaagtggctcagagtcaagatggcatgttgtcatttgtgagttctgcaactttgagaaaactgtttaattgttctgtcttatttgcaaaatgggggataataacttcacctcactgttaaagactgaatgtttatgtcctccccaaattcatatggtaaaatcctgatccccaatgtgattatattaaaaagtggggcctttgggaggtgactaggtcatgagggtagagcccttatgaatgggattactgcccttataaaagggacccctgctgctctctccttttggccatgtgaagatacactgagaagttgacagtttgcagggaaaagaccctcaccagagcacgactatactggcaccctgatctcagacctcaacctccagaactgtgagaataaatttacgttatttataagccacccagtctatggtattttgttatagtaacccaaactgaccaagatacccaccaggacattgcagattcagtgtcatcatgcttgtcaagctcctaacttaacccatggaggataaccattactgtgactcttattagaccagtacggtttcatgaaaggagcacaggctttgaccttgaggacccatgttcaaagctcacttcaccacttattagctctgtgacaaagggtgtcacttaacctgcgtaagcatcagtcttcatatctgcaaatggggcttatgatacctacttccaaatgtggctataaggagtaatgaccatgcatagagtgaatgcagtagccaacagcagccaggcgggtagcaagagtgagtgaaacaggctgaatgttacaagctggagagcagccaaccagggcaactgtgactcaacaccaggcaactgttaccatccagcaattcagaagtgtgaggctgttgtctgatccgattttttaagaaaaataagatacttcaatttttataggaaattcatcagttttcaagtgctggcaaataataagaaactgtttaggcaacattatataggccaccagtggtagattggattcctaattgtttacttatagcctttgccatttgactttgcaagaggcagagtgtatttccccgccctacagattctgggcttgtccttttgacttgctttggccaatggcagtgtgagcaggtgtgtgcatgtgtgtgtgtgatttgacatggtctctatcacttctgccctgtgccaagagaggagcattccatggagggccactgtttctgaaagaaacatgagggacagacccacagcagagttgccccagctgatgaacagttagttccatgagtgaaaaaaaagaaagtgttgcttgtcatcagccattgaaattttgaaattattacaaagcaaaatccaagtaatgcattacacttaagttcccagtttaagaccaccaaggtaaaacatctggcaagtgactggtagataaaatgttcttgacgaatggttatcattacacttattctggtccggacaaatcttatggggtttctatactaaaaggcaggcttggtccaatcccttgcaaaatgtttgttttgtgctgatttgagttctgagaaacttaaacacactcatctctgtctatctcttgccaccttatatacttacagggataaatattaccactaatcttggaattaaccaacttgcttttgattttacaggctcctaggcggaaaagacttgtcttgtgtctcagatgagactttggactatggacttttgagttaatgctgaaatgagttaacactttgggaagtgttgagaaggcatgattggttttgaactgtgaaaagacatgaaatttgtatgggggtgggaggggcagagtgatatgttttggctctgtgttgccacacaaatctcatcttgaactgtagctcccataattaccacgtgttgatggcaggacttggtgggaagtgattgcatcatggcggtggcttcctccatgctgttcttgtgatagtgagtgagctctcacaagatctaatggttttataaggagctgtttcccctttgctcactcactatctcttgtctgctgccatataagacatgcctttgtttctctctcaccttccgccatgactgtaaatttcctgaggcctccacagccatgaggaactgtgaatcaattagacctctttccttcataaattcctcagtcttgagtatgtctttatagcagtgtgacaatggactaatacaatggcaaaaagtggtgtcatgatttcttacttggaatttcttcactcattcaatccaaccattatgtatgatagaggttagatattaagaatacagattacaatgattaaacttctcagagccaaagaagtctaatgggacagtgaggggtattcagcaacaacagaatttgaaaggaaatgctggaatgaagcaagaatcaggtgcttttggaccccagatggggcagtcaagcctaaccagaggtggggagatgtctcagaggacaagagaatcaaacagagtttttaaagacgagtagctttggttacataagaaggtggagaatggcattttaagaggataaatatttaaagacacatgaggcataaacatttggtgtattcagaaaatagtaatctagggtagtgagttaatcaggtctaagtggggagggagtgaaaataaaactgtaaggtaagctgaggctgggttgtaaattgccttggttgttgtagatgtttttttcccaaaggtgacagctatcaatttcttccctcctggtatgcacgtgccatttacccatcataagtgtagtctgtcctttagtgccttgaacctgggctggcttgtggctgctttggtggatagcatacagaagaggtgcttcagtgccagttctaggcactggcaatttctattccctacgttttgggatgctgtctcttgcaacaccctctcttagaacccaaccattatattatgataacctcatagagaggctatcaaaatgcacttcagtgaacagcactggttaagctcctacccaatagctagcatagtgagggcaccatctacaatgtccagcctagtcaaggctctgatgacttctcccccagctgccatctgacactctaaggtataaatcacctggcaaagagcagtgaactctcagaagggtaactaataataatcaagtgttctcttgagttaataagttttggattgttatactatgcaacaacaaataactggaataggtgttagataaattgttctatgcatcatctgtaatgattgtgcaatagtttgaatatgtcccccaaatttcatgtattgaaaactgaactcccaagtttatgtgttgatggcatcttgaggtggggacattgggaggtaattagtgttaaataaggtcatcagggtagggtccctatgttgaaactgatggctttataagaagagaaagagtgatctgagctggcaagcttttgccctattgccatgtgatgccctccaccatgtcacaatgcagcaagaagcccctcaccaaatgctgataccattcaattggacttcccagcctccagaactgtgagctaaataagctgattttatttataaatcactcagtctgtggtattctgatataacagaaaacggactaagattgtatatataaatgactttaaagaattgataaaagaaaacctaaaatggtgaggtgagggtgagggatgcactggaagttatcttaaaagtacacagtgggaaagcaataaagtatctgtttctctatattttcattagttctgttgctattacagtatacatgtgtaacaaacccgcacattgtgcacatgcacaatagaacttaaagtataataaaagaaaaaagaaaataaaacattaaaacagaaaaataaaaataaaaagtaagaatgttctaggaagggaatgtaatattctaggaacaaaacaaaaccaaaccaggctttacagtcaaggaagatccaggttaaaatcccaactgttgcattcctgatgtaggagaccagggacaacttacttaatggagtaagcaaatttgtgcccacatagatgtcctttattaagccagaacactggtcccaagatactgttactgttgcatctagttggtttcttctctgtagaatgcccctcggttgatgaagccatcttgctgtgaaggtcacaaatccctcatacattctggggatggttcccaatcaatgaagggttgatattgatacaggtgccaaaaggctgggctgtagcacaagcggggataactcttcagtgaggtctacaaagccttcacctcatggattaggcccaggaagctgactgtggaggcccatagctttccttagttctttctccttccctatcctgcttttcccactctcatatatatatatgatcttatatataatatatatataattttttttttctgtagaacatacccttaataaacctcatgtccctgaatcccagctttaggctctgcttctagagatccgaacctaagacacttaacctttctttagcttccccttttcaaatccccttcccagaattcagtgagatgataaattgaaattgcctggcacttaataaacaaacacccaataaataataacagatttcctctctcatctttctttatcattagtgcaaagtgaaaaatatgagtaatgttctttaaacataaaagatcctccagtgaattttccttactctgtatagaaaaataggcaggtgagacattgatttttaaaatggtaataatcatgcttatgctatggagttatcatgaggattaattgaaataatgagccttaagtagagttctttagtgcagagcaagcactcagtgactggaagctactgcctttctacttgactacaacctccaagaacaccatccagtctgtcttttcatgttgtatcctcggctagcacaggactcagcacagagaaggcatttctgtgtttgctcaagaagctgcagtgaacaaggaaagaaacaatacttcataaaagatggcacaggttgtaggacagtgcttctgtggcctcgaactgacccaattctctcctctttcttgctcttagttctcaagaataactgtagcatgagctgggaatgaaacatcctaagataaggggtgcctggctgaaacagcctgagctctggtcccaacccatcccctcatagaaacaggatgcccttcagtgctttagtccagcgtgtcacatgaccccagggtataaaacccaggtccggctgctttccaggttccctcagctgtggtgcaaatggggcttgcaccatctgccctgggcagcttttctgagtcttggggactaggtcccatgaatcctaggcttctgttgtttcttgatgcctgtctgtaagtaagtaataaacctgctccatgtaatttgttgcacataagtaagtaagtgtcttctggctcactggactcagacaagttggtaaccagtgcacagtgaacttacttcacacagattttatggttccacttcatttggagtctgggccatgaatctaagctcaatacttctgataattgtgagcagattgctacacacgtactcacacaaatagccagattcacttgctttggtcattaacacagtttattattggcacacttatcagtaaagcatacataaaatacagctgttttttaacacacggagccactgtgcctttacatgtgtggaggaacatattaatatgcaaatggaaaaattaattctcttataaagtttcacataaatacactggagttgcccaaaaacgaaaagtccccataaaagaaccaggtgagagctttacaaaatatcatacaagaaatatactataaaaagaaaggatggtcaactcaggtacaattagaaaacacacaaaggttcaggtttattaaactgcccacaaaaccaatggattacatggcttgaaaatatttggatcaacagcaactttacaaatgcataaattcttaagggtccaattgtctttctttacttaaaaatctgccctggtgtctttgatgaaaaaaatgacatttcttgtttcagcacttgggctaaattgagtcgactcaagacaagaaccaattgacatcagctcaaccataaattaccttgctgggccctcttagctgttgcccaatgaaagaaaacataaagaaaaaaaaaataaggtacatttaaattactttccaaagctgatttttttgtcttttctttttttactgaaacaagaaactctcagatgcaagtcaaaaagcagaaaatattttacaatattaaaaagtcatctgtagttaggttcggcatattaatgagatcctgagcactgagcatttatggacaatatggccttcgtttgatgcataaaaaggaaattcaacacaaacacgttgttaaaaccgtgccagaagatgcgctagagttttctctcattttaattacaatcagtgccagtatctgtattacctgtgaaggcctccaagaaagggtcatggaagcttactgggaataatcctctcaattagaaaaaaagaaagaagaaagaaaatcagatcattgtggtttagaaatagatatttgcatggaaaagtttttatctcttctgtttcctctcctgtaagtaaagatttgcaattgtaatgatcacccacgggcctattgacagtggattctggtgccgatcatcttattgggaagcctggggtggggggttttctgatttggtctcttgagtggcgggaggtttactgttccacgggctgttgttccccagcgcgggtgaattgttgaagtcctcctcgtcgtccatgccgttggccgcatcatattgcgtgttttctaatctagtgattagcctttcgtcctcgtccccaaactcacctcccatcagagttggctctcctaccaccatcacatcctgtgaacagcagctgacattattacagggaaaccttgggagagagaagctcagcttaaaataacagtgggaggagtcggggaatctaggacagacacactcgtgtactgtacaacggggtcaagtctcaatgtcgggggccgagacgcatatttgatttctacaggaaataaacatcgcctcctgatgtgtaacaaccacgcgagtttatgtccttagtgcgcagcctgacactggagaacgagcaatgctagcaatctgcagaaataaaaaaatgtatttttcaaaattaaaaaaatccatgctttcaacttgccgacattggggacttttgagagggctgtggaaccttctgctgggtgcttctcaatacctccaaaaatctgccacttttatttagggcctgtgagtggctttggaaactagcagtgaccggagacacacgtaaggtgcaattctgcaatattcacacaactcattccaaacggtattttctctgtcccagggatgatatacattttaattgaagacagaatctctcttttctctactcagccaggcccttttatgcagccaatatccttgacattctgctacttaattatggtaattaatttaggtaaagttttcgataaaaacaatgttcacactgatttgacaatttgcatagctaattaagtcattagcaaaaacctgctgattgccaacaagccttgaatttaccatctgttatttcatggtgcctgtcacctatcaccacacaggcaaccctgccacccatctgggcagtaaagagaaccggtctgtccagctggtgccataaagggaagatgaagaacgctaattataattacattgatgaagctggtagtcatcagagatggaagcgtgcaagaagaatccatctaatcactcttttaagtacaaattgtccttccatgcaaataagtaagccacctactgtagctgggagcatggggaggccacagctggagaggccagggatggggaagaagaatgcatacacagggcagagctccagcttctttgttcaaaggggaccatatggggttgatgagggaccttggcatgggacaggacatctgtcaggtggattcttctgggcaggctctgagcaatactccacttaaaagtgcagtaacttcaggaaagtgaccaactgtgatcagcctccactgaggccagagaaggtagggctagccagatgcttttggagatgagagggtggggtttccagtagaaaggctaattcaataaaatattttgacaactgggcagaaattcattttactagagctttgcccagagaaggccttcctgggacagtagaatggaatactgcctactgtcaggagaaggaccagtgggattttgaaagtgtccattgaacaaatcccttagttaccccctagtcttttacaatggaaaaccttgttttatttatttctgctccccaccattcttgagttaggggagataattaataggtttccaaactatgttttctgactaatcattcttgtgaatagataaaaatgattttaaaaagaaatgtcccaaatggagtaagtaagtgcctaaaatgtgagcttggtaaacccagcaataaaaatgccaggggatattcatctctgtgcttccaagatttatttatttattatgcaatgaagaaccagaaatgacagtgacatggaacgagactcatgaagactgttaaggtgagatgcaaagtagataccgtccttctgactggcagaaaggatgacaggattttagatggagtgtggccaccacagaggcatgaatggtattcagttagctgggcagctgcagtgttacctgtttggggatgttcaggataaaagagtgccactgagttataggcaattaggagatgacacttatgatcaagaacaaagggagatggaaagaatagggctaggttgtacagagcatgacctgagggttaatctcatttcatgacttgtgtccagcacacttgaagggcttggaaaacacatgcgtaaggcgtcacagggcaggagaaggatgttaaccaaccaagtgggtctgcattagtatcgtgactccaaagtcattgagagaggatgggagagtatgaggaagcataatttgaaagaggaggaggaaaataaaaagcagccaacttaagcatgatattaaaagaaaagctctcaacactccaaatgcattcattgaattagaaaacaacaatcattgaagaaaagtactatgaacatagtggtttgaatcatttccaatggagccaacaggcttgtaatctgttcggtgaatctttgttctaggagcagctggaaaagatgtctaggcataggtgtttttaaatgtactaaatttcaaagggatgccacatatgttttactaattatataaaatatccctagctagatacttagttgtgtgtgtgtgtgagagagagagagcgtgtgtgtgtgtgtgtatgtgtttgtgtgcgtgcataattgacaaatggcaagttaagggcttcatatgcacatagacagttaaggccacttaaaaatttatgtgcatgtttctattggttcttctaagcctctagactaggatagtgattatctgctctggcagtcttgatttgttattctcacacaaaataaataaagcatgatgcacattctaggctgcctctgattaggggttgttagcaacatttcccccccattttgttaaaaatccccccaacattggcagtgagagtacatttccttcccatctctatcctgtgtgtccacgagagacaacagcgagccatctgagagaggtccatatgccctcagctccccacaaggccaacttctgctccttgctggaagcccggaggtgccaccagctctcacccatttcacatcttctcactaatcccccgtgcaaagaccaccaacctctgaggaggactggaagtgactcctttcagggcccctcaatgcttctccttaaattggccagaaggggtcactgctgttgaatgacacaggtctccatccctcccagggttgaggctgcagttcgggatcgctcctagcccctgctcatggagtgagaagcagaatccaaggattaaaccctagccctcgccagacacacacatcgctgccgcagcagctacacagaccacagctgtggtcatagtggcacatgcctttggaccagacagtggatgcctgcaggtagcatctctagttaaccagtagaatagtgttgataactcagtagacagggttaaaagatatggtcaccacaagtcatccaacgcttatcatttaatgtccattcaactccaggacacatatgaatttgtacattttcctaatctggttgttctttctgcctctctgtaacatctgacaattttactttattaaaacatctttaactgcatagtgtggagatagtgatggaatccaactctcatttcctaacggtgccttgctcttaatcacacaaaatgcaaagggtctctacttgttacaaaccctctggatacaggtaacctccagtaaaatacagttgttgatttggaagacaggagcataacagagtacagaagctatatcctctttcaaatgaaattgaaatgattctgactagaccatatgtgtcaaaacatatgacatgtaagctgctactctcaacttctacaaccatgtcagacatcactaatggatggcccaccaaacccagactagaccttagaatcctcctcaataccatactctgagggctggcaggagagagaaaatgtccttgccatccctagattagacagtgagctcttcaatgacagggctttgttgttgttgtttttcaccttggtattgctagtacctggcacagtgtgggcacatagtaggagctcagaaaacatctgttgaactgattgggattcttgcagctacagtgcctttaagtagctatatcaccgtttcagaatcctctgagatgcactttttcttatttgctagaggaaactaacgaatgttactgcctttaactccaggattggataaagaaatgggctcctgtgtacactttttcagttgatttatctaaatcaggccattttctctattcaaaatttcaccagaagtgggcataacttgatacttttttaataaagagactctttatttccctcttttggctttttccccctgatcttcagaggtattaggtataaagcctagctcagaaagtggaggaccacctggagactattttcattatttgaagactgcaatttgtaaccttgtaaaatgtaacatggcaccttccattttaggctggtcattctccccatgaccccttctttctaatgcagtgggaatgaaaagtataccccctgtctgtgggagacaggagaagagaaacaatggcccaaggaatcctcagggtactgatggggttggttttggccaaagagaactgaccagtggaaagtagatacaagtaggtgggggcagatgtgaaagacacacttggaagtaagtggggaatccctgtgcgaaggtccactcgcacatggaagcgatggagcaggatcagaacaataagggtaaggatgagagcaagaagggtgagggggaaaaacgtgggaaagacggaaaaggtaaaattgtactggttgagggatgtaacaagaaatagggcaactttggaaaacagagtatctaaaaggtatccatgaagcactaagaaaatctcaggatttgaatgatggccaaacacctggtgatagggtggtatgacagggacagcagagaaggaacagaagcactttaaaggagcaaagtacttaaaggagatagtctaataaggggctggggagttaggagatgggagggaattaggcagaagggacagaattcaagaagaatgaataaaagatgaagaaagttcctgtgcagttttcactatatgggattaccctcagctgtcagctttggaattcaaagaagtccccttcctaatggtctttgtcaagataaagaaatgaaagaaaggggccaagggttcgagagagttgagaccaaaccagaggctgatcctcccccttagctaatgcaatgggctaagcgagagcttcactgagctacatgtttagtggctgctggttaattacctgagtcttaaaataagaggggacgcccatgttgggaaggcccagtcaaattacaatatgggactgagccgctgggagctagtttccagtggagcacagggtctccaatgatggtgctgagaggccttaatacgccaccaggcatgctgctaagtgatattttaattaaaccttaagtgacatatctcctgtctgtgactctgatggctttttaattcaggtcccattgcagcacgactcttaatattcctttctaattcccagtttgcaggggaaggtttccatggcagagttcctccctcccatcccaacctctgtccctgtcttttatccctcccccacctccaacctgcccaggattttttttttttttctaatgaaaagagactttaatttgggccctttgagtaggaagcagacagttaggatttcgggcctaagaggaaagcgagacttacaggtacctgactggacagactcaggtttgcagctgtggtcttcttcttgctgccagtgctgtttgcattgttcccagcgctgctgttggaagtgctgctggtggaatttttcctttttctccgtttggttgttggttgccttgtgggttctgctgcaatatggaaaagggaagagggatcagttctagggcaaaagcaacaaggcaatcatcagtatggttactctaaggaagctgtcttggtaaactgaagagtagactatttaaacattttccatttcttatagctttagaaagaataaaaggagaaaactgtagatgtgtttttagcacaaaatatgtgacactcttttctttgtgtgtagatcaaataatttttatttaatcattctctctaatggtatgtatttaattttgtaaaaatattttttaggtatgtaactacaagtaccactttcataattggatttaaaatattttgccattagaaaatttgggaaacttttttcctctggtgtatcttctctttaaaacagagagaggactcctgggatccctagggtaactaactccaaggtacgagtgaagtatgaactttaaatagccaaattcatgagccagtgtgcaacagcagcatctactggtgaaatgtcatattgcaacccacctctattatacctttatagaattctcaagtaaagtcagttccatcagctgtggatgtggagcttagggattcccaagttcagaaggaatacccatggtttgggccctgctgtttaataaatgctactaattccaaaattgctagaaaaaaatatgtctgagtacatggtatagccagcatattactgaggggaaactagacctcttaaagaaaggcctattcagaaacagagaaaaatattttggacttgaaggatggggcaaccctttaatagaaatatagagacccaaggtaaagtgtgataagagaaatattctttatttatttgtttgtttacttataaggtatagaacattatgtaatgcttgtcactattcttaatgtttccaatgcactattttatattcaaaaaatcctattagttaggaactattattgtaatctttgtttcataaatgagaaagtttcagaagccttctcctgccagttactgaataagttggaaatggcaagtaagagcatcctttttgccagctctattttagacctgactgtgatggagagaaggcaactcagggctacactggaaccaaataagagggccttgtagcattttcttaaaacacctatgctggacgggtgccatggctcatggcaataatcctagcattttgggaggacgaggcaagtggattgtttgagcccaggaattcgagaccaacttgggcaacatggtgaaccccatctgtacaaaatatacacagattagccaggtgtggtgatacgcaccaggggtcccagatactcttgaggctgaggtgtgagaatcacctgagcccggaagtcgaggctgcagtaagctatgattgtgccactgcagtccagcctgggtgacagagcaagaccatgtctcaaaaacaaagcaaagcaagacaaaatcacaccaaaaaaacacctatgccacttctggtggacaatgggaaggatcttcctctaaggctcatttcaaagatcacttagtccaatgagtatccctgacttctttttgacttttctactcacctactatttttttatcgtccctaaatattttgtctcttatgcttaaagattttcatcaaatggtctatcatttccttccatcgagttcagggtgcttgctctgaaggatgagaggaacaggatatagaactgttccaggtcatggagttgaataaagggttgaggaggacattctaaagtccagcagatactcaggcccactcctgacaagtatcttctttctttgaccttaagagtataaatttggtgctctttttatttatactttgaccatgaaattggggcaagtgtacctaaaatgcgtattctggactattcccattaccagtaggtggctgtggtagtaaaataatagactttggagacataaaaaccttttggtgacacagtcctccttcatttgttagccatgagactggctgtgtcaaattactaccctaagtctcagagtgcactatataaaatggagataatacatttaaagttatggtaaggattcaatatttttgcatgctttattcagttttgtaactcccagtggctagaaccacgtctggagcctaataaatctcaataaataattattgaatgaatgaaggaattaatgaataatatatcaattatatatgcctatgttagaaaatatagcacttgctgagtggattacgttttctccataaagtcttattagcgttaaaagaaaaaataaagccaatttaagcacatttaatatatttgaaaaataatattccaaaagtctaaaattcccataagatggggatgtaactattctacataaaataacacttattttctcagctttctaaatatgtacttgattaaatttgctatattcattttacataaaacccctggccacttaccagccgaaggtgaccattatattttgtgattcagaaagctatgtgcctcgtgttaataattactttttataaaaataatttttagcaaatggctacattttgcttttatgatgaatgaggctcaacacacgcctgggagtgaaagtatattagataggaagacaattaatgatgacttgaatcggtgatttcagaaccccagcaggagactatagtatctaaactgcattctagggaagtgagggaaatggaattgcttatatattctcttcatgatcagaacttttgatacaatatatctttaaaaacagagcaaacttcatttttccttcatcctttcctccttcattcatctgttcctttcttccttccttctttccatcccttcttttttctcctttccttcttccttatcttccctttcttccttccttttcataatgtctgtcattcttaaaaaacaaaaacctaaaacattaggccgtgagaagccagcagtctggctcagtggaagaaccactagattagaagacaggaacccctggctctgatctcagctttgccaatgaccttcttgatgaccttgaacacgttattttacctctctgagttgcaggtcctaatctggtaagtgaggagactgtagataattcttaaggatgtttgcctgtcacaaattcattgtctttatgtccacaaccatggtcagaatatccctaataagctacttgtcctgataaattaatgatcactttcttctttttcacatcacttcatccctggaagacacctctgaaaacgtgtttagagagagagtgaagaatgagggtgtacctggcggagccaccatcctctgccacttctgaaacaagcaggtcttcaggcagtctcggggactgaggttgtaagttttatgtctcgacatcagttcctgcattggctccaatattacacacaactgcaagaagttcaaagacattggcatttcactacttcataacactaattacaataaataatgctaacagctggaatcaagta

SEQ ID NO: 85 - DNA, 46379 bp, Homo sapiens
gaacttgtctccagcactgcggacacccgggtgacacattctttcggagagggagggcaagacttttctccggagcctctggcaactcgtggagtctatataaggtggggcggtggggggcgcggaattctctactttggattggtttgtttgttttaaatctagggtggtgggcagttgcgcgaggcggggtggggggtgctttatgaactacacacacacacacacacacacacacacacacacaccacatacactcgccctgcccttctaggctcacggctggctcttcccggctacaacttccccttccttcctgaaacaccagcgccttactcgctcagtcccccgttgccacctccgtcacctcctcggccgccgctcctgctggcactgctggcgctagcgctggcggccccgggctccgctggacgcctatcttttttctctccctcttccctagctctggattgattgatgaccaccggcggccaatggctctgacaccacgccatcctcggtcgggcatcacagccccacgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctcttctgacatcttttttcacttaaacttttgtttgtcccacccccccgacctgtttgtgtttgtttgcagcatctcaaatcaattatacatttttcatgacccgcatttgcacttaatttggggtgtgtgtgtgagaggggggtggtgatgtactattataaatcaacttcactggggcatccttaatttattttcttgctgacggattccaaccggctcctgagcctctagaaaaatgcccccttcacctcctaggccgcaaaaccccggaattcaaaggctttacaaagataaccttgttatacgtaaatagcaaagaaactcctgcctctgtagagaagaaatccggcggcaacggttacttttcctcggtactcgtcccccgtcgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagtaaacagctcgctgagccctcgtccccacccccatccccgccgcccggcttccccagcttctcgccgataccccctcctctcctcctaagaaatcctggcggaggagggagcgaagaggtggggacccccagaggtcgggggactgatggctggagggggtggagaagagaagaggcgcaggatggggagtcggagggaagacacctcctaaaaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgcaggctggggctgggggccagggggcgcggcgctagagggaggcggggggagaaaggacccgagcagcctcgatctggggagagagcgagcgagggggcgaggagagggagcgagggcgcggcgagccggagggagagcgagcggtgcagtgacagggactgccactggggtcaaaggagcacagctccaggaagcagggcggccgaggcgccgctccgtgcgcgctccccggcgggaccccgcgcccctgcacgcccctcccgcagtccctgcccactcggacccccaccggtgccccgaagccccagggtttcgagaggaggagggagccgagggcgaggcccggtagcctgctggtgctcccgggtcaagcaggcggcaggaagctgagctgcaagttcatcatcatgagtgcgatctgcgtaaaaaatgataggggaaggaaggcgggctacggtgccccaggaaaagaagggagctttctcccaaatggtgttcttctgcaaagagaacacccagctccccgccacccaccgacctgccaggctctgtcaggagtcctggcaccgttccaggacgcagggctcaccgcaggggtaaggggagcggctgggacacttcgctcagacctaggaaggcgaccctaggttccctcccatctgctgatctgaggctttcctgggggagagctgtgctcctttttccccaagcctttcaacacgacagacacacacacacacacacacgctcactcactcactcacacactcacctctttctctctgcaatgttgctgagaaagaaaaggccaacccagctgatcattttttttacctccatgaattaaggcagattcaggacaggaaggtgaggagaggcaaagactctaattgtttccattttcgtcttttggataaaattttccccaaaagataagcatgtcaaaagcattttaaaaatcaaacttagtccagttttgtctgctactttggaaaatggaagaaaaggttttcagaattttgtacaaacaacacaaggaaaggaaatgccgctgaaatgctggaagacagaaaacaagggagagaaggcttttagaaaacttggttggcagggttgtctgtgaaagatgaggtggccctgtgatgttatgccattgtcattgctgaaagattgggacagcaaccagatctaattcctttctaggagtcagactgaaagatctgtgcattctctgaagggaaatccaatgtatatatatgtgtgtgagagagaagtgtgctaagtatactatgtgacaactgactagacatcctggctgaaattataccccctaaaaataaaaaggagccattgcaacctggtctgtggcctctgtgctgagactaattggtttccagggtctggggaggaagggagagaggcttgtaggagcccctataaaaaaagatcaaacggaattcacttgaaaatatttcccttttacaatgggctttcctggcacttgaattttaagtaacccatctcttatgcctaggctgaaatgaaaagggaaatggtcttactaatgtatttattttattttacagcatgcccagagtgtcagtgcttgtcaaatgtgctggggtggaaaggacagtgtctttccttgcccagcacaaatcagaacaagtgacattgacattaaaggatgccaaagatgggggcatagaggcacctttaaattttgttttcttttgttttctagcccatcagcgaacactgactagaatcacgtttttgaagaaatgcttggttttgtttcctttactctgtgactgagtactacattcctcatatcttaatagtttgaatttttagactgatttgggctgatttaatcagttcaaaaaaaaaaaagcatcaccagccaaataatttctgtggtttccttctttaaaaaaaattgcagtcaaacaaaacagacaaactagtttgaacatgattctgaatctaaatatgtgcacccagacagtaaataataatgctttctactttagtggtacattttacaggatacttaatgccataaaaaatcaagtgggttatccattacaaagttgatggaaatttgtataccattttactgagtggggaaaattgaggtaaaaaggcttaaaattgtaatttgtagtgctggaagaagtcaacctgctgatagatcaattatccaatagtgaccaagttatatttggattatgaaattttattttcattaggctactagcaagctggagatatgaaaatgaatttaaataataaaccaggaacaaaaagacactcacttttcaaataattctctttacgtggatttgaacatattgcattttgttaaatcatattgtctacaaatacagctacctacactaaaagcttaatttaaaattattggatgtgaaccatgtctatcccatctcccatataagctttgaaatgttacctcattatatcaaattttaaatcctataagcttcagcttttttttaaagataagtgagtctataagttccattttcgttgttgttgttaaattcaacttttattgtgtataatggaaaagaaaagaaggatgaaaatcaaatactaagtttatgattggcttcaaggaaatattacaatttttttcttttaatggaattcaaagctggaccctttccccagtgatttcattgaaggaactggtaaatatgcttcctgatagcccactgcaataccttttaaattatcttttcagaatgcatttaggaaagaaaatgagaaagaggagcgtgggagaactttgggtggaagcttggaaagaaaatgatgcttcccttgaaagctcaatactttatttggagttggctttcatcttccctatgagaacaggttttcctgtacttcagagatgtgtatgacttaaaacttggttcaatactgtggttcttcttctaaaaagcaatccattgaaattactgcatgttattgaataatttcattgaaatgatatgtaccagtctaactgcaggaacaaacagcaactattttatttctttttttctgtaagttgtaagcatttctatcattttacagcaaaggctaagatgtatattatcagaaatcagagcctcttaatagaactaccactatgatgtaattagaaaataaaactcaacaaactattttatttttctgaattctcacagttcttatgttcattcaaatgtttttattatgacccctccaagttgaataacaatgtcctatatttctttgagttctttatctttatgttggaaatagttgttaaatgactgtgtgggtcaataaatgagaaagtaaagaagagaacacaccagtgaatgaggcaaatacagaattaagaaaaatccacaccagatctgtgggagaggaagtgatgtcatgaggcagtgttgtaggataagagctaaggacttcccaaggagttaaaatagcacattttaaaggtcttgctaatgcctttagaaatatggaataatcctaagactgttttacaaattaattttcttatagagagacaagcttgttatgtatcatgtccatttaaaggcagccctctttttaaatacagcaggatgccacaataaaaagaattccaagtaaaacttgttccttaaaatgtacagaaatgtatcaagccattctcaaaagaaacttatataattaatctaattccttgattgatcctttttgaaatcctcaaaataaatatatgattttttttcaagggtggtactttgtattgaaaattttctttggttaaccagtaaaaatgtttatgggtcaaaaaaaaaaaaagaatcaggaaacactagaactgatcaaatttcatttcataaaataaatgtcatgctcattatcatcttagaaaggctaaatttaattcagttttgcctgcagcttaagtagcaagcattggggaagaatcttaaaatttagcaaaacactcacaaattcttaacatacttactagccaatatctagcatgtatcaagaaatcagatgaaaattatttatgcaataattaattttaaaagtctgaacatgatactgagtctggattcatgtgttcttagtgttagtaaccattctaacagacatccataatctctgtgttgacctaaagggaataggctatggcacaaaatataatttaaagagtttacttgagccaaagtgtgaggacaactgcctggaagattcacacccaggtaacattggatatgagcttcctttggcctttgttacaagcaaatttttaaagccaaatatgggggacagggagtaggctgacacaaagttctctgtaaagaattctcattggtttacagaaaagcattgattagtggttggctagacattgttaagctataggctgtgagttatagtttccagtgcagcattattagttaatttatagctgctagggacaataacaagctatttcaagagatgaatacatagctcaaaagctgggggttaggatggacttgctgtctcattttaatgtctttctaggcctgataatttaaaaggactcacattcctcaataaaagttcttttctcattttaaatcaattaatgcttgctgagtctttccccatgtcatggtcccaattttgggaaaatggtaaaattttgtcgtacttgggataggcttgtcatggtggaaaagagctttctcattgaagtaaactcaaaataatctctcttgaaagatgagcagtatagaaaccccattaaaacctggtaaagaaaaggtatgtgagcatttccaagtttaataattcaatttggcaatctagcataagatatctgtatttcaagaaagcaatatataatgtaactttctttctcagcaaaaataaatcaatgaatggatacaattttttaaaactgagtttgagagaccagcagaatataaaacctttttctcactatattattaatgtaatggcttgattcagtattcaacaaatatttttaagctctgctctgtgtggggcatagttcttaaaccatgcttatggtctaatgatgtaaaaaaagcagagttctttccacattattaagtatacaatctcagggggatgggagacagtgacttaaagcatcacataaatgaatgcaaattatggctgtgtaaaggagaggcccctcgtgcaaagaaaacaaagcagggaaaccttttctcctctggggttgagtgaagaccttcctagtggaggaaaggaatataaagaggtcgcaggaaaaagagaagccagtgtggccaggtactgagagtgaagatttgtatggtgcaagaagtgtctgggattcatctggatgtgtaggtagaggccagaaccacaaggtcatgccaaagatatttgaaggtcacagtaaggccctgtttaagatgtttgatattatcctgagggcaacgggaagctgtttaaaaaattcaactggaaagggtaacatgattagattagtattttgaaaagatcattcaccccattttgtaaaacggattttagggaactagactgaacacagggagacctttgggagctattgctgtcactgggttggagttgatggtagccttagccaggacagttttggagtagaagatgatacctagagagaaatgaatagaagagatttgaatacattttacataagagcaacaaagattactggaatctggaactactggctaacagcactgtggtacccagccagagaggttgagagccataatcacctaatgattttctgaagcatctaattccacacacactccagcctccctatgtctctaagccatcttcatcctatcctttacacacttcttgggattctgtgtttcacgaagaattgtggcattaaatacagcactggtataaaatgtcactaactttattcagacttacagatcctagaactcactttatcctcctttcaatgccccacacctatttttggcacacaaacaaacttgttcttatttcatatgagatgtaattgcaagaggcaagtgtatttgtgtttttccttaaagtttttgaatgctacatcacttccatatctgtcctcatcagtaccagtttaatataattgaactgcttaatattccatgtactattctaagagatccttaacaaaagtggtcgcttttttattcagatcttcaaagaaagagatatcctttcgaggcaacacaagaagccaactacaaatgagaatattattctcttggtgcagggattgttgcatgtggaccccatcagccttgaaaagtccatggtaaggatgatactccagtggctgtttccttatggatacaagctaagttactatggccctgctcagcaactcagactgctaaggaaagatgtgatagaaatatgttcagaaattttaagactaatatatgacaactatattttctgactttattcctttcttgatatttctgcattttgaaagttctatcaatttcttcttctgttctcattactccccatagtgaccaactgtaaacaaagtaaaatctacacacaagagaacagttcaatagccaagatctagggcacacgttctactagatgcataaaataaaaggaaggtttactggagagcagttgaaaaaaaaaatcacagtgctacatccaaatccctatttcatgctttagtacaaagggaactttaaaaagattttttttcttttcaaaagcactctattgattgttttgtgaaaaactggaaaatacagacaagcaaaatataaaaaaatagaaattaaccataattatgtcactcagaaatatccactgttaacattttgtaatgtagtttttcagtcaaatgtatttcacagaaatggaacaatagtggaatatcaaaagcagagaaaggtttgaatcccatctctgcctcgtagtacctgcgtgacctcggataagttacttaagccctctatgtcttggtttcctcatttgtaaaagagaaatattaaagttatctacttcatggagttgttacaaaaattaagttgatatttttaaagtacttagaataatgtctgatacatatcaattattatacagtgttataatccacttaaaaattttaatacacagtcattgtaaataaattaaatacagaagtaattaagaagtaaaagttacccctctttcttcgtcatatcccatcccctaggtagcctgtattttcaaccgaataaaacactgaacatcttcccacgttgttacacatctttttatgatttcttatgattccatctttttatgaatctaactttcatttaaaaagtgctatgaatgtcatgagttcagaataacccaacagtctatattgcatttcaggatattgcacacatgctataatcatagagattactttaaaagattcagtaattctaaagcatattaagaaaactcttctgatattcatattttggagtttgattgagttgatgtttgaaagaggaaaagcttttcatttagtttcccatgagtttagcactgattatattagttcttttcctttaaggcataaacagtgttctaaaaaacaaattgaagataatatgttttgccagctatagacagtttttatttacgctgtttaaagtcataagcaaaacaagttgaaagtttgttgaaaaatggtgactgatatttaaactttatcaacaattattgatataaaacttatttgcatgcttcagaattatctggagtttactatgggccctaatctgtggcatttgacaatgggagcttcaagacgtgacagacagaacacagaaaagttgtagaatttaagagagaagggattttagaattcttttgaacttggcagttctttggcaaattgtatggctgctgcttttccattaactgggatatgaactgtatggaagtatatacagccattgttcatcttatcataacatttgcacatcgaaactaaatagtttgccataatcctgaaacttcaccatagacccaggctaatccagttaaacaaatatggtgtgtttggttgttagggggttggcctggtgggttataaacttttcattttagaaaaggctatagtaagagaaaaatgtaatctacagcagctattatctggtatctgaattcacttgttggcaaattggtccttgcatgtctttgaggcatatggaaattgatgatgaaagtgtctagtgtaactagaaatatgatttgatgaaaactgaagcagtgaactgtgagaaactgttaaaccagtgtcatcaaacagtgcttcaaaaataatgaaacaggaatactagtcctttacgagtaatattgggtaaaaaatgagaaaagcacatggtgtgcacacaaagtttaaatatatgaggtaatgttttttaattactattattataaagaccactcaaaaattctacacccagactcctttccatttatctctaaggagacaatgacatcacgtcttctctaaattattcagactcaggggatggaattggctcattaatagggaatgccatgtttggtattggcacagtacttaaagcttctctccacgttatccccaaactgaaaagcacatttcatgggagccaaatgagttaaaaaatttttcctctagactttaagcactcagaaacacatgagaacaaaaatagaactgcaccataaggtataatcataaaacgtcatagaaggaaaaacttaagaagcaaaaaacactccagtcatctgaaggctagcagttcgtgaagtcattaaaagtcattccatacgggctgagtttgaggaaaagtcagaggttgctttgttcttgactctgagtgaaatcaaaacctacccagactctatacaaaggcaacggcagcctgcctttctcttgctgggtatatgctactaaacacacgtaaatgactagtgttcagaaaagtctgtgattctgttcatattaatccatgtcgcaggctggcaaaatgcctaagtacaatcaaagaagggggtagaagcctgccttttcaaacaggctagaaaatttgtaccaaaagatcacagggcaacagagacagctggaaaaattggagctggggctctgatttttgtgccagtgttacacctaatgcaaagggaatgcagatgatagattgagagttatgtatgttgtttagttcaccagctctgtgcttacacagaggcgaaaatgtaacttttttttaagtaatatcatagtaaacataacatttaaaacaaccttactgtagctaagaattaacacatcagaatctagcaacaagttgctaataaaacaagataaacacatgcaaagaataaagagtgaacggatagctctaaaattagtcaatataaagatgtttcactaatgtcctttaataatcatttctttggaaaagtagtccctgcaagtgttttaacacacatagaattttctgcaagatagcttaaggtgcttaggccacaaggggttttcaaatcaaaggttgttgggacatttgtgattctaaaaagaacattgatgatttttcttggcttttagtagtgattttattcataatgtataataaaaaacaagatattgggtataattctctgtattatttctctgtttgaatggaccttttcattcaaggtgttatttaatataattttgttcagacgaagtgtgtcacccacaactgaaatactgtgtataaaatggagataattgaaagttttattgagatgctgttgaaagtctctggggtccgtgctgattcaggctgcgtttgcaggcttcaacactctgtggcctttgacaggcatgaagaaaagcaagaccaaaacagttctcacaacacagctggtggtcacaaagaacagctcatggagatgtctgtcactgaaaagagtggtctctggaaaagaaccaaaagtaaaagaggtggaaatggagttagaaaaagagagattgaaagtagatgaaatataatatttgaacacttaaaggtaaaaattaaatcctgaaaaacaccagtggctagaatcataggcatatattttctttctctcttttacctccaacagtgttatcaataaaaagagtttggaagtacaggtggtcaatcaaacaattaggtttttaaaaatcttctagaacattctgatatctgaggaaaattgacttataagtcccagaaggaggaatggaatgttcctagaaacaataaacttagtccctcactccattattttatttatttatttatttatttattttcatctttaataaagcaatatcacattttacatattaattatctcatctgattttttttctaaactgtattgttgatattcatgtgcttttatgtcaaaattcttttctttttaggagaaaaggatcttttgaggatctttaggaggattttttgatgactgactgataatattttttgaaatatacattaatttaaaatacatacacacatgtcctgaagcttttttagaaagattaaaggactataaacacacacaaacatatatgtacgcacacataaacccatgcacccctaatatgtaaattcttcaaactagcctggttaagataaaatcataaactgggcttctattctaccattctctcaccactttttttttctggtattccaaataaacagcaggccctaagggctctttgaagtcactagagtgtttagtttagcaatcactggttcatgtagcttatcttttcctggtatttctatgtgatttaatagttccagcctggcccagggaatgaaaacttctgggtctgtttctggaagcaatgcactccccattgccatctgtgataaaccaaataacctttctctgcctcagctctttgcttataatcgtgcctattttgcagcaatggagtgaaacttgacaaagcagttgcagtcgttcaccagtgaagcaaagtcttcttcctagtcacgcaggtatgtctagtaattaattaattaatgaataagtaccaacctctcgatggtgatgttaatgaaatatccaacattaaagtggcaattaattgtcaagggtttaataaaacagatccttattctattagattgggattctttagttataagtaatagaatctgaccctggctaagatcagcaacagaaagtttactgaaaattaacaagattacatcaatcagaaggcttgatgtggtgggtgaaattttccaaagattatcgtactagtatatatcctgtcccacatgttcttcttacagtgtgatattgtctgtacaccattgagaggtgggtgagtttatgttctttgcccttgaacctgaatggacttctacagtacttcaattaaaagagtggtgcagaaatgacacgatataacatcagaggctgggtcattttaaaaaatgataagagtttctgtgttgatctctcttggggcacggatctttggatccctgagctgccatttaagaagtccagccaccctccagcgaccatgctggataagccatttaaaattatgagagatgctcacggggccccacctgttctggtcttcagccgttcgagtcttcccagtccaggcgccagacatttaagcaagccttcaagcccctgcctctgagccaccctatgtgaaaatgaatagaagagaaacaagctgcctctgctgagctgtccctgctaaaaccctgccccagagtgcagtcttgagcaagacagattttattattgttattgttttaaaccagtaagttgagagtggtttgttacacagccatagtaattggaacacttgggtaggaagcaggaataaaagaagaaagagtgagaaagctcggaatcaagaactagagaaatatctcatagcatttgtagtgttgttgtgctactgccaccaggttgactcaactccaaatgtctcttcaatctttgtatcacttgcttaagattcgaagtcctggacagcatatccacacaccaagctgagactgtaaatctaactcctgcttgtacctgagtgatgcagggaagagttggtagaaagagcccccagcagctccagtgactccccagtaggaaggcatgattttctagcacctggatttatcacccccactaagacaataacatggagggaaggaaattctcagaaaagaaattggagtgtttttcagaagggcagatgtaagtcagaaagtaaaaataccagtcagggtccactcagaacacattttattctacttaaataagcaattttctatagtagtagtatccttgaatacaaatgaattgcaagtaaaatgtaccatcttgtctgctaatagtcttcaagataaagtaattcactggagttagaagatattaggctgctctgtttctttttctttttttttaaaaatgatctttaataatttagtatttagcacccagtctataaaatattcacaaacataagacaagagtctgcagattataaaaatacttacagctgccttaaacctcttccagaacaaaattgaggaataaataaataataaattaataaaatactgaaaaatttctctgggtcattgtttctcaaactctagtcctttttcattagatttaacctgttatcaaatgctgtggcccaacacacacatacagaattgcctcaatcattttcaatcaaataagctgctcagcttcttgtaaatgctaataagactcactgattgctggaccacattggaggtttacagcatttgattgaattgaaaggccattgatccagtggcctcatagatagaaaatgtaaagaataatttttctttattgtcattgtgcattcaagtttgaatttgccttagttatttaacaggagacattgctcccttttaaatgatagtataagcagcagtggcaaaatgattcttcatcattgagatttctctatgatattaaacaggagaaataaagagttttaaaaaccatgatgcccttttatttgtagaaaaaacagctttagaagacttatgattttcctaagtatttcaatcagattacatacatttagatcaatatgtactgaaacaatacacccttgctaagaaagtttattattgcacatgcataggatagacttgggaatagaacaaaatgtgacgtattcatgccaatatgggaagtcttatatagtttcagactttgttagtgaaattataagatatatatatgttttaattatatatatcttataattatctctcatatgatttatatatcatgttttatatccttatatctgatatatatatatcttaacagcattaagagtgaaaagaccactatcgttggacagtctcttactgttgttctttcagtattttgtaaaagcaagatttctcaacttcagcactattgaaaatattttgttgtaggaactggcttgtgcattgtaggatatttgacctctacccactagatgctagtagcacccccccagtctttttattaaattggggtcatagatataaaatataaaattttccatttaataatttttagtatgcagttcactcagttcagtggcattaaatgcattcaaattgttgtgcaatcatcaccaccagccatctctagaacatttttatttttccaaactgaaactactctatacatgtttaaacaataacttctcatttcctcctacttgcagcccctggtaactaccatcctactttctgtcactatgaatttgatactctaggtacctcatgtaagtgaaatcatacaatattcgtcctttagtgactgatttatttcactaagcataatgttttcaaggtttattcatcttgtagcatgtgtcagaacttcctttttatagctgaataatattccattgtatatatatcccacattttgtttatccattcatctgaaaatggacacttgagttcttccaccttttggttattgtgaaaaatatggctatgaacatgggtatacaaatatctgcttgaattcctactatcaattctcttgggtatttacctagaagtgaaattgctggaagatatggtaattctctgttttctcctttgaggcatgtaaccccagtcttgacaacaaagaatatcttcagacactgccaaatgtacccttggggtcaaaatggctcccaattaagaaccagttgtctgaagtaacaaacttttgaacaatggtgttaccacaatcctggatttttggtttagaagagacatttgatgagttgagtgaatcatctctgcctactctctgaggcttgtatttgacgaccagaagtgcttgggaagtcaatcacccatagggccacctcaatcttgtcccatcaattcttcattccttaatctcttttagtctactggttcactcttatcatgctacaaacgtttgtgcctctgtatcttctaccttctagtcaccaacagacatcttaacatgctaatctataaaatttcacctcccaataatggattcttcaatcaattaacacctgaaactgctttatatatagtcacctagatttgatcacacactttcttttatctttttgtttgacctagtcatggcaggacaagtttaggagtcatgactcctagatttgagtcctggttctaccatgtgttagctgtgtaaacttacatgattacttaaactctcaggctgtctgatagaactttctgtaatgatgttctatgttttataatttgagctgaaaaatacagtagctgctgttgagcacttagaattggcctgtgtaactcagagactgaatattaaattgtatttaaattaaattaaattgaaatgttaatacccacatgtggtgatatggtttggctgtgctactacccaaatctcatcttgaattgtagttcccataatccccatatgttgtgagacggaccttgagggaggtgattagattagagagatggttcccccatgctgttctcatggtagtgagcgagttctcacgagatttgatggttttataagggacttttcctcccttcacttggcacttctccttcctgccatcatgtgaagaaggacatgtttgcttcccctcccaccatgattgtaagtttcctgaggtctctccagccttgtggaactgtgagtcaattaaacctctttcctttacaaattacccaatctccaaaatttctttatagcagtgtaagaacagactaatacatgtggctaatggttactttttggatagtgcatatctaagaatcagttttctcatctataaaataatgacaatgataatatttgcctccagggatagtttgagaattaaatgagataatgtatgtaaagtacttagtttactacttggaacagcaaaagaacctggtaaatatcagcaataaacttaactagctttataggcaacttacttcaccctctgaaactcagttgttgcttttgttttttaatctaacgctatgtaagatcctctgagtaatggtgtatctaatgatttaggtctgccataagactcatgtgtaggatgcataataagggttccataacgaggatcataggacagcttttgtttgggggatggatttttaaaatcttatttgacctcaatttcaaagctcttggagttatgaaagtttaaatgtctaagacaataaaagaaaatacagggtgaccaaaagaaactttgagtaaactaaaaatattactctataccaaaagctttctaatttggatatcaaagcaagcgtgaaggtttgttgagttgattttgtcgtgtgttaaagtttctgatattctagtctcactgtatccaatagcctgcctctttcccttaagaaaaatgagagttgccatgaactgagtgcctatgatatgcatagtactctcctggttattactgcttatctacaattttgcaaagtaggtattgttatccctattgtgaaagttgggaaactgagccttgggaaaattaaatgagttgtccaaggtcacatgactaaaagtagaaccctgccttacctggctctaaagtttgccatctgtctactacagcacattgcacctctttaggtgagtatattgaaactataatagctgcccaataattagattatccaattagtttataagtttggcttcatctgaatccacataattaatttttctgagttctttccaaagctgttgtcaagtattatgagtgtgtttatttgtatgtttgggaaagttctgctgtgaaggatagaaaacaaattactaagatacagctatcacttttatagctaacatttgttggtaattaatcaaaactaggctctaagtgcttcacctggaatatcactgttagtccttttaacccaatcccatacgtgccatttttacattaattttattgaaaagtaaactggggcacagaggacaaataattcatctcagattacccaactgcaaccaggatttggatccagatactgtgtcaccagcatccaagttcaaaactactacaccatgttacctgctggtagtactaacatgaggattgagcactggtcagtacttgtgtgtgtgcattgggcatacagatttctttagcagcatccttatcataacctttcatactctttttgttgcctcctttgtaatattcctgctattacattactgtcctctagttgactttctgttccagtctcttttatcttctgccaattttactactgggatactaggtaacattagaaagtgtagagttttttttgtcaaaaaaggaaaaaagactctttattgacaagagtaatgagctttcagagcacctggcataaaaaatgattttgtgaattaaataagtaaacaagtccaaatctcagttacttctttattttgccactatagtttgaaatggtaagagcagctacgttgtactgaagctccaatattttatgttctgttaagagagtttagttccaaaagagaatttatgtgattttttgcttttagaaaaactgcaattctcaggactacaatatttaagggtattaatgagaaatatccaagggaaacactaatcatttgaggggaaaatacattttctatgtcaagcaaaaaatattccagtgttgtcagtgagccaaattatgagaattattcagagaccttttttttatagcacttaccagagcagttaggataatctatgccctattgcatcataaggtacgttcaggatttggcatttaagtatgatacatgctaaattgaaaatatgcacttgttaaaaaaagagagtaagaggattcaatgtgtggtttttcacctgtcaggggttatcggaagctgtaattcaggaaaaaatgaaaggaaaagatataggttgcccaatagattaacactacttagtgaacttttaaccaccttcagtggggttttcatttgacaggcaaagaagtgatatactttgacgacaacaatcatggaatccaccataaaggtatttgaacagttccagaatgtgtacaggtcactaagatatgcaaaaaaaaaaaatccaaaaaaaaaaaagagctaaccttaattgtttctattctttcaatactgccaacccagaaataatagaataatgagttggatgctacatgctgaacgacatcatttttaagtttgtatgagaatttacatttatcttaacaaactgccttggggacatgctttgaggctctataaactataagtctctatgtttctgtaaactatgaggagctttcatcagggaggaaattatatataataggcaatatgaatgatatttttatctgatgtcgacattgcaagaaatgtgttgattctaatagagtgaatcatatgaaactgtcaatatttgactgtttttgatctacaaaatgtcgatttcatgtggttcaatctaatattttaaggtgtgagtaaaccacaaagcaaaaatgttatttttgggcttctaacagtaactgggattgcattggaatttgttcaagcttaaagaagctaggatgatttgaacatttttatttcaagaatgtatttcaaagtgatagactgaaaaataaatagaatttaaagtgtactctgacattcttattatatcaaatttgttcaacacagcagacactttcaaaattatcagaaacctaaacaaacaaatcataaatagataatgcaaaacatctaatgattgtattttctgtgtcagtctgaattactattatggtaaagaggagcacaggtggcttttcctttttagaaactctacagccatacaaaggatccttgcctgtgtaataacagggaaatgaacgcaggaaggaaaaaggccgctgacattaggtaatgtttaaaatcctgaccccttgatttgggcatatggtattcactttatcatttaacccatatagagacctttccaagagtgaaaataaaatgactcattaaaatgaaaattacaaaaacaaaggtcagctagttcccagaaattataattagtaaataaacaaattattccctccccattttttattttgaattattttaaaactacagaaaagttgtaaaacaatacaatgattattcacatacccctcacctagattcaccaaagtactaaccaattgttagtattttgttatctctctgtctcttcctctctctctctcttaattgttctattctgacattcataaataagcaaagatatattttaaggatttttcaatactcttcaagtcaggtgtgcatctccccctgtccaccaggttaaccaacatgtcacagattcatagaatgattctgtcattggaaagtacccagttatctcagaaacttactcctaatctagcccattctgtaccacagagttctgaagttcattctttcaagaaagaggaagcagcgatggtaattttatcatttacccacagggcatgtaggtgacagtgatatattcacttggtaccctcagtaacaaaacaaagctccaacaaatcaatttaaagggggaagggattacattatcttcctcctatcaaggcagggtctaagtttcacagcaaaaccctttagggaatttgtgtgttcttctcaccttatctcgtgcctcttctggaataacctgctaattgatttccttgcctcccatttacccctgcactctctaacttatcttgcacacagctgccagcacaatctttagtaggaaatcctacttcgatcctgtcattctcctgaccagaaatgttcaccaatgtcctatgtcaaacaggatacatttctgacttcttaatctaggagtgatgttcagctggtatgacttagtatggttataccagttgttacagtgttgaaatacttccataccacttgataaagagaaatacttaacttactgactctataaatgacctaagaatctagcctagcatcagcttcgacaaagagtaatggggcttgggaatggtgctgacatgaaggtggctggtcaatggtaattgcttagtagacaaaggtaatggaggtggtgccagtggtggtggcctgagcagatcctgacaggtccaagtcaagatatcatctttgttttaggtcttgccttcagaccatatattcagtctattaaaaataagtaaataaagctgggtgtggcggctcaagcctgtaatcctagcactttgggaggctgaggcgggatgatcacttgaggccagaagttcgagaccagcctggccaacatggtgaaaccccttctctactaaaaatgcaaaaattagctgggcatggtggtgtgcacctgtagccccagctatttgggaggctgaagcaggagaatcgcttaaacccaggaggcagaggttgcagtgagccgagattgtgccactgtgctctagcctgggcaacagaatgaaactctgtatcaagaaaaaaaaaaaagtaaataaatgagaaatctgcccatttctcaccaatagcactggtataatctagtccaggccatcatcagctcagccttcacatcagaagagcctcctcctcctctggccagccagggtgatcttaatgcttaaatcagaacacaccagggcactgctgaaagcagcagctccttgagcactgtagatgaatatccacactcccaatcatggtctacaatgccatatgggccctgcctcctctttgcgttcatcttctactcttcccttactctagtcacactggcttcatttccattcctcagttatgccaaacttgcagcccttttgggacctttagcatttggtttcccttctacttggaataaacatcataaagcttgcttcatggttgcctccttctcataagtcaggtctccattcaaagtcagttcttcatagaggcctttcctcaccagcctagacagcctttatctccccggtctctctctacctcatcaccttattttctttattatatcacaggcttattttctatcttcctccactggattctaaatttctaggagttagggttatctattttgttcattgctttatccaaacacaaagaacagcgcctggcctaacgtgtttgttgactgactgtctgattgacaaaaacactgagcacagtgcctggcacttcatatctaggtacctgttagctattttatcgtcacagtattctatgtagttataaatctggtagcctgtcctaatcttttggcttcacctctcttatatttatatcccagcaccagcacagtgcttggcactaaactgatttagtggaatctaactttttattataataaattataatcaacctgttatagaccttggacagagacttcttggagtagctttattcttttctttctcttggctttgactttgggagtagaaagaatcagattccttataaagatgtgttataaatttctcaagttatgcatgttgtctataaagcaaatgttgtaaactggcagcccagaggttcaatatattgctggatgttatttgttttgctcagtggtggattaaagttttttgagggtgcatttaaaaatcaaaagagttcacagtttttcatagaaaaaagaaatcatatttcaggtttttattttaaaggaagatctggacacagcgaactcaatttcgtgcaacaattggccaaagctgagtaacagttgctcacttcaacctgggcatcagcccctggggctgtcctagttaccacctatcctttctcattcatttgtcatctgcctggatcccaggaagaccttgagtttgtgattactattgtaaagaaagtttccataaggggcgtaatttttttttttttttttttttttttttacaccttgctgtgtggaattagaattttcccagcttttcctatccagagtcttggtttcatttgataggataggagttaaagaagaaaatttggaaaaaggcactaacttagatatgaggggaaagagagcagttaggaaaggagcaaattcaggttttatgggatgagaagcttatataattttttggatccccctttttttgtgcgtgtgtgtgtgtgtgttctcctggacttaactttaaaaaaaaaaaatggctgggtgtggtggctcaggcctgtaatcccagcactttgggaggccgaggaaggtggatcacgaagtcaggagttggagaccagcctgaccaagatgatgaaaccctgtctctactaaaaatacaaaaaataaaaaatacaaaaattagccaggcatggtggcaggcgcctgtaatcccagctacttgggaggctgaggcaggagaagcgcttgaacccaggaggtggaggttgcagtgagctgagatcacgccactgcactctagcctgggtgacagagcaagactttgtctcaaaaataaaaaaaaaaaaaggaaaaagaacatataattgtaaatttataaaaaaaattactaggatctttcccagggccttggaagagactggagcaagagaggtaccctgaggtttatgaattattagctctattgtaagtccacccccaactggagtgagaaaggagatggaaagctttataagcaatcgtttagacagtaacatctgtgctgtctgcaatgtccaacatgaaactgaagaaccgatgaagttcaataaagttgatagagatggaagcacataggctttgtgccaaagcatatgttaatttttttcttcattatccacttttttctggatgtaatcctcttcttggatctaaggattcttaaatcctctgcagtctgtttcccaggctcctatgtcagatgcctttggccaatgggagccactggctggagatgagagggtgggagagtttttatccagacctctctctctgggtggcatcttcacaagcagctgcatctcctcctgtttttaggtcttactggataaaccttttatggatctaacttccaataggagactttagcctctgggctttgttcatgggccccttccctttatctctccagcaaagtggtagtagacatttctggttgttgctaatctctgggttacctcactattcccactttgacttttctgctcctctgtcagcagaggagcaaaatgtaatcaattccctgcattacaatcctcttgttttaaatactcagagtggattatttttcttttttcttctattggactctgatgcattgattgatgttgggacaattttgtctagctttattcatacattgttctgatgcttaattctatgatcttacgattcttattaaaaactgtcatttttaatataaagtcttcatgcttttgccaccatgttctttacttcatgaagttgactgtgcttgttggcttgtttgattatttaaaagtatctttgaattacccagactatgacaaacttaggttgtatgagagtgattttcttgtacagatatgcatagagcaacccttatgaatgaaatattgaaatactaaagtatgtcccaaacactattcttataaagtatgtgaacttggtatggatctaatataaaaacatatattagatgatgatataagtagtgtttgattttatgaactttttttatggaaaatttcaaaaatatacaaagtaaatagaattgcataatgaatccataggttatcatcacccagcttcaacaattatcaatactctgttattcttatttcacctatacctccatccaatccctactccctcaccaaaatattataatttctatagttttttatagtaaaattttacacatgaaaatatacaaatatatatacatatatgtgtatatgtgtgtgtgtgtgtgtgtgtgtgtgtatatatatatttaatagagacaaggtgtcgctctgtcactcaggttagagtgcactggtgcaatcatagctcactgtaaccttgaacctctggcctcaagaaatcctcccatctcaggctcccaaagtgctgggatctgccacacccagcctaaaataaacaaaccttagttgtacaagtttgactaatggatgtccctgggtaaccatatctttaccataatacagagttttcaatctcctaagaagattgcctcctgtacccccccaggcaattcctatcctacccgtgaaggaaccacatttctgatattttttaacccttgtattagttttgcctcttttataatatatgcaaacataaaaacatacaacatgcagtgaaatcagaagtatgtacacttctgtgtctggctttatttggccagcatatctgtgatactcattcatgttgtgtgtattaacaattcactcctgttggaattgcactgtatggatatactttgatttctccagtttgcggatctggtaagtttcctggttttgtgtcttttgaataaatttttaatgaatattcttatacattttttttggtgatcatttttctcatgtctctcggataagtaggagtagaattattgggtcaagggtagatacttaacttcatactaaactactaaaacttttttataggtgaattgcctttttactttcccatcatcaatatatgagagttccagtcacgtcacaatgttgcaaatatttggtattgtcatgctttttatattttaccattctactgagtgtggagttgcacctcattgtgatttgaatttgcatatttctaagaagtaatggtattgcatacctttttcatttgcttcattctttaactagtgttttcaagtgctttgcccaatttttaaattgagttgtttgtcttttattattgagtgagtgtagaagttctttatatattcagaatatgtatcttatgaatgtattcttggtatgtgtggcttgcctgtattttattttattttgaagcaggtctcactctttcactcaggctggagtgtggtggcacaataatgactcagctcactgcagccttgaccttccgggcttgggtgactctccgacctcagcctccttagtaattgggactacaggtgcattccaccacacctcccagctagttttgttttttgtttttgtttttgttttttttgtatttttttgtagacacagggttttgccatattgcccaggctggtcttgaactcctggactcaagtgattggtccgcctcagcctcccaaagtgctgagattataagagtgagccaccacaccccgacctgtttattttaaagagtagaatttgaacagcaacaacttttaattttgatgtagtttaatttattcatattttcttttacagatattgctctgtaaataaatctttgtctactcccaagttacaaagataatctcttatattttcttcccaaagctttgtagttttacttttagatttttatctataacccagctcaaattaattttcatgtatggtatgagataacgattgtggtttattcttttccatatgtacaccagttgttccagaacaatttgctgaacagtttttctttcttcatagaattactttggagcttttctcaaaaaataacttattgcctaagtgtaggcttattgctggactccccagtctgttccattatctatttgtctgtccttagccaatatgacaagactacagtctttattatggaagttttaatgtaattatttagtataggaccttcagttgtattcttttttaaaaattgttttggctattataaatcttttgcattttaaaatacattttagtatcagtttatgaatttctataaaaatgcctgaagtgattttaaaagggactgtgttgaagttacatattatgttagggggaatttacatcttaatactattgattctacaaatccataaacatagtatatctctccatttatttagtacttctttaatgtcttggttttcacgtagaagtttttgaatctttattaaattgattcttaatttatatgttttatgccatgttaaaacattctttttcaaatatttgttgtgaatagatattcatttgttttaaaaaaactgacttcatgttgatgtgtctgttggctgcataaatgtctcttttgtgcacatgtaccctagaacttaaagtataataaaaatatgtatatattgaaaaaaaactgactttatatatgagaccttactaaactcacttattagttctattaatttgttttcatggaaacaattatgtcatctgcctacagagacaactttatttttcctttcctttattttttcctacactactatgttaaataaaggagtgaaagcagacttacttttttattttttttttaattttaggggagaaagcattctgtatgtcattagctatgactttttcatagatgtcttatatcagattgaggaagttttcttctttttatttttttatttttattttttttagagatgaggtctctctctgttgctcagactgaagtgcagtggtgtgatcatagctcactgcagcctcagactctgggcttcaagcaatattctcatctcagcctcccaagtcattgggataacaggtgggagccagctctcccagcatttttgttcctcagtttgctgagagtttttatcagtaatgagtgagaaattttgtcaaatgttttttctacatatattaaaatgactgtatgtttttcctttgttcagttgtatgtagtattgtatttattaattttcaaatgttaaatcaaccttgcattcctgggataaactctgcttggcttgatgtgttacctttctgcatttttaaaaatttcctcatatattgttatttatttcatatattttcgggagacactttgatctacaatttttcttctttctttactctttttctttccttctttcttttgtttcctctttcttccttcctctctctcactttctttctttctattgggatatcaggattactattgcttcctagaataaatttagagatgtttcttctttctctattttctgaaatagtttgtggaagataagcattatttctttcttaaatatttgatagcatttaccaatgaaaatgttgagactggagtgtttttgcttgtttatttttgtgtgtatttgaggaagattttgataacagattattttcttagatagaaatacgagtgtccaaatatcccattttatcatgtttgcttctaagttgtgtcttttcaaataattagttgattttattaaagatgtcaaatgtattcatataatattgttaatagtatgcccttattttcattttgatgtctgaatggtctatagtggaatcttttttattattgatattggtattttgtattttttcatgatcaatctttctaggtttaaatttttgtcttaatactttcaaggaactaaattgttaattttgttgattttattcattgttttcaattttattgatttcttctctttacatttgctttttcctacttcatttagattaaattttctttttcttctaacttcttaagattgaaaatatagataaataattgaagcttgtctttctttttactatgaacacttaaagctataaacttccctataagcattgttttaattgcatcttgtcatttctgatgtgctaaatttcattatcattcagttagaaacattttaaaatttccttttgatttctttctttgttgacccatgaattgttgagaactatgttatttaatttccaagtatgtgagactctccaaatatcttgttgttacttaattctactgtggtgagaaaatatactctataaactctacacttaatcttttgaaacttatttattaaaatattattagattttatattttttgacatataaaaatcggtgtgtattcaaggtatacaacttgatgagtttggggataagtatacattcatgaaaccattaccaccatgaaagtcatacacatattcatcacctcccgaagcttcctctcatgccttttattactgttatttttgtggatgtggtaacaacataacaactctttatttgtcttaacaaatttgaagtatgtaatacagtattgtcagctagctataggcactatgctgcatagtaaaccctttttttttttttgagatggagtcttgctctgtcacctgggcttgagtgcggtgacaagatctcgcctcatggcaacctccatctcgcctcccaggttcaagcgattctcctgcctcggcctcccaagtagctgtgattacaggcagctgccaccacgcatcgctaatatttttgtatttttagtagagacaggatttcactattttggcccggctggtctcgaactcctgaccttatgatccccctgcctgggcctcccaaagtgctgggattacaggcatgagccaccatgcctggccgccgcatagtaaacctttagaacttatcttgcataactgaaactttatcctttgaccatcacctccctgttttcccctcccccttacccctagcaaacactattctactctctgtttctatgagtgtgattattttaagtcccatatataaatgacatcatatagtatttttctttctgtgtctggcttatttcccttagcataatttcatccgggttcatacatattgtcacaaagggcaggatttctttcttttttaatgctgaataatattccattctatatacatatgccacattttctttattcattcatccatggacatttaggtagtttccgtatcttggctattgtcaataatgctgcaatgagcataggactgcagatatctccttgcgatcttgatttaaattattttgggtaaatatctagaagtaggattactgaatcaaatggtagttctatttttaattttctgaggactctcaatactgttttctataatggttgccccaatttacatttccatgaacagtgtaccagagttccattttctccatattcttgccaacacttactatctctttttttaaataataataactaatagacataaggtgatagctccttgtgattttaatttgcatttccctgatggttagtgatgttgagcacattttcatatatctgttggccatttgtatgtcttccttagagaaacatctgttcaggtcctttgcccatttttaagtcaggttatattgttttactgctattgagttgtatgatttccttatgtgttttagatgttaatcccttatcagagatatggtttgcaaatattttcccattccatgggttgtcttttcatttattgattgtttcctttgttgtgcaaaacctttttagtttaatttaaccccacatgtttgtttttgcttttgttgtctatgcttttggtgtcatatccaaacattcattgtcaagaccagtgtcaaggattttttttaggagttttatagcttcaagtcttatgtttaactctttaattttgagttgattttttgtgtatcacatataataaaggtccggtttcattcttttgcatgtagatataatttgaccaacaccatttattgaatgagctattctttctctattttgtattgttggcactgctgttgaagattactgaatatgctagattctaggttctgttgtattattgtaaagagtgagttttgtcttagtagatagttaatatggttgaattcaatacctaaattctgtgactcctgtgatcagcaggggtgggaatctatgctcatttatttaagcttctactaaattatcctcctgcctctatgtttttcttgttttaatataagaggacaaaaaacatgctcagaaaactctttatattgagcttgcctccttcagcgtttgagttaatgaatggagagactatggcatatacgatgctgaattcaaatgctgaagactaattcattaatattttattgaataaatatttcttaaacccgctttgtgtcaattactctgcatttttgtattctaggaatacaaaaataaagaagattttcaaggaccttatagtctagtgagtgggacaaccaatacatagattaatataaaggaatataataaatattttaatggagacacagagtgaatttgtaggagcatacaggataggtatctaacctagcctggtagtattaaaacagaaatttttgtttgtctgctttgttttctttttaacttaaggtcttgctctgtcacccaggctggagtgcatagtgccatcataacttacggcaacctcaaactcctgggctcaattgatcctcctacatcagcctcttgagtaacggggacaagtgtgtactaccatggccggatttttttttttttaatgtattgtaaagcaaggtttatgttgcccaggctggtctcaaactcctgggcttaagcaatctgcttgtctcagcctcccaaagagttggaattacaagcatgagccaccacacccagcctagaaagtgtattataaggaggtacaccctaagtaaaaacatggaaatatttagagactacaagaatgaatacaaaatctccatacatttctagcatttttgtaagatattttatttcatttcaactcaactaaaatttactaaacatttactgtgtgtctcacgttgttgcaaacactaaggaagaaaataaattcttatgaagcatctcacaatatacccaaggaaaaggaaggaaaaatggacactctttttacacaaaaaaatcttcattagccatcaccatgacttttttaaaaaatttttttcctaatttttaggtaagaaaatggaatctcagaaaaattaaataacacagataaggttatagagataataactgaaagaataaagactgaaaaccaaatccatctactccaattcatgctatttctaccaattttataagacaatattaagaacaattctaacttcatcaatttctatttcatttctagaaaataaaaatcaatatgtcacatgtacgtagttttaaaaatcaaataattctgactgttataatttaaaaatctcagaataaaaaaacaaaattctcaaccacagagaaacatctaaaatggagaattacactccaaagctcaataatttatgtaagtatttttctagtattaatatagtataatgcttgcaaaatgatgaaacatactgggtagatataaaattctgtgtaagacctaatttaagctatttgtaatgtgcctttaactttgtgttttcagggtttgccctgagattttgctagtttataatatgccattataaagatgtaaaaaaataacagaatgaagccatatggttctatatcagatatctttacaaaataaacaattagcaatatttcaaataattcttgaacacacgtctacaatttcaaggaattaacacaagcaaactagtactcactcactttcatgtcaagaaatattcagagtatatgatttgaaatgatagaacctcactactgggtttactatatgaaatatgcaggatattacaagtgtcattttatctagtagctgagttctgtgacatggaaactaagtttggaccatctgccacactcaggacaccagcaagtcatctcctgttatggctcaagagaaaaaataatacatttcagatcataatggggacacagttaagtccttggttaaaaacaaaacaaaacaaatgtattccaataagagaatagcaagagaaataatgaagtgggaaaagttaaaaatgaccaaatattccaaagtgcattgcacactactttgtgcactaccagggttctagcacacataacaatattgacacttcctaacaaatgtttatgtttcagaaatttgtttctagggcaattgtgtataatcataaacaactttctaatttaaacaaatgctaagtggtgtttcagttctaagtttaggctagagaaactcatttaatagtgaataacttgattgtaacataatgatactgtacaatataagcactattgagaacattcaagaaaacacattctattttctcccttgaaactctagaaatgtattttccttcattgaggaagtagctttagtagtccactaggggtagggagaaaagcagaacaggtttcaaattgggagaacagaggaaattgcagaaggtaagactctggtaggggcagtagaagttgaaacactggatatgactagaatttattgggtggagtttctggaaaagcactttaaagagggctaactgagctttgagaaacacactctttgctctttgcttatcctgccctgagtgcagatgtgatggctggagctggagtggatgtcttatagacatgagtggactttaagtatagaagtcatgcactaaggatgggaaataagaaaggatacacttggaaaattggtaaaagtaggaactgtttttcagcttgacactgcctgcgtttaaacttcatttatgtgagacaaaataaacatgaatcttgtttaagtcactcgtattttggatatttgttcctagcaaccaaatactagtcctaagtgatacaagggacataatgaaaatttattgagaacattctctttgccaggcaaagtgaatctgttctgaggataacagatgaaagacattactcttactttcaaagtgcttagtctatagcaagtaaaccaatgactataataatgtgtgatgagtgtttgtatgttagaggaacacttaggaggaacactcaatctcacttgtggcattcttttagttaaaaaaaaatcttgtgttatttggtcatgatcctgatttagctaaagaattttattatgttacagctgcaaaatacttgtaggattagattcttacttttcatttctcctaccccagtttttttcattttggtgaatggcacccactcacccaatttagattttcatttcacctttgattatttgtctagctgtgaagcagtttcatatatcctattggaagtagttgaggtttttgaatctgtaaattgatatctatcagcagttttgaaaaattcttagccattttctcttcaaatgtggcttctgcttcttatctctttcctgtaccctgaggctcaatcaaatgtgtattaaacctctccctgtctgctctgtgctcaattctgaattttctatccttttgtctttccctgcttaattagtgatattttcttctatttcactaattatcccttcaactacatcaaccatccattgaattcttcattttgttgttgtatttttcaattattgaatttctatttggtttctttgcccatttgtcttgtcactttttaagagtttctgagtctctgtttgaaattattaggattgaacttttcctccttgaatatagttgatttatattctgtgactgaaaattccaagatttgaagtattgattggtttatttttattcgttttacatctgctagtcatgtcttctcatgtatctaattaggtttggttttattcttggcttgatcaaatatttgtagaaaaatgtgtagagaatattatatttctctgtaaaggatttttgtctcagacaggtacctgtgcattagtaattaaagattatcctaatccagtttccatgcctgaaattttgctaggtcacccagatggctaaaagctgggtgccatccgtgcaagtgctattttgccttcagttcacctatctttcatgatatatcccaccagggtgcaaggccaaggtagagatggctcagcagagttcccactcttgccaaactttggactgacttgtatttcctacacttcttgaggatattaaaagtacaactcaacctctgggactcctctcctggatgggcaaatacagggcaaaacccctcaaatatttggctcatgtctctgaattttcatccctttttggatgttagtctattgatttctcatgtatttgttagctcttggattacctttaaaagattttgaaaaaataactctaccttccttagtagttgttatggtcttaatgtgtgccctgcaaagtcatatgttgaaacttttgatggtgaaagtgaaagtgatggtattaggaggtgtggacctttagaatgtgattgagtcatgagagcagggccctcctggatgggattatggtccttatagaaagagcttcggggaataggttttctcttttctgccatatgaggacagtgttcatcctcttttgccctttctgtctcttctgccatgtaaggacaccatctataaagaatgagccttcaccagataccaaagctgccagcaccttgaccttggacttcccaacttacagaacagtgagaaaataaatttctgctgtttgtaaattacccagcctgtgatattttattatagcagcacaaaccgactgagtcagtaattttcatcagtgatttgaataatctgccattatcaaaactagaagtccagttctatcagtatttctataaaccacatcttgagtcaatccacttctgtccacttcaatacaaaccactttgaaaaacaccattatttctacgtagaccactgggatggtcatttaatttaatttccctgtatccttggttgctttcttcattccacagtttctcaatctttgcactatggatattttgggcagaataattctttttggggatggaggcaggagatctgtcctgtgccttatagtatatttagcagcagccttggcctctacccactagatgtgagtaacaccctcccccttccttctgtagttttgagagccaaaaccatctcctagggggagacattgctaaatgtctcctggggaacaaaatcaccctccaatgagaaccgctgttctaatccatccattacacagacaaaagtaaacttaaaatatataagttataagccgtcattattgaaagtcctttaatggctctaagaaaataatttcaaccctttataaagcccttcaagggattacataagagggtttctgtttatattcctaattacatctcttaccaattttctcttcagagtttgttttgcagccacattgacttttctttctctcaaatcttttgacagctgtaggacctttgcatatgtggtccttttgcttttgcccttcatctgtcttctcatcctatagatctcagtttaattaaatcagaatgcctcaaaaccggcattctgttgaatgaaagaatgagtgaataaagcaatttcagttcttagattagatactaccttagaagaggtaccttattcaagaccttcttaacgaaacaagccaaatcaaaatgaaacaaaaccaaaatcaatcaacctccattatcctctgtatcatggcaacctatgattttctactaatttgctgagtcccagaagacagaggtccaaataacacccactgaccagtcatcaggacttttctgctatcttttttccctaatactatccctcagatggttccatgaacttatggccaaactaattgtttctaagaaaattagaaagaaaaccaagttcctctttttttttcttttatattttcctctaccctttttccatatttccacaaactgcaattttaaagcacacattgaaattatacaggcaatgtttctcaatgacagttttattaaatgtgctttagttcattttttaaaaatacaaatattaatttgacttcaaatttatttattttttcctttctaggtctggaaggatgttaactgatagaatttttatttagcctattatttcaagtttcagcatagtgatgcctctgccttaaggtagaagttagtttgattcttgaaatctcagttgaaagaattctggtgaactctattccaatcaccagacattcacattaactaactttctgatggaggagaaacagtctgcaaacgctgaatatggaaggcaggcaataatgcccattcacagtatttttccaccacttctgctataagttaagattgtaacagatagaatattaatttcaataaaagagtttgaaatgataagactgtagtagaaaatattttgaaaccatatactgtcttttcatatgtatagtttatcttcattatttatatcagactatgagaaacagatgcaagatgtccgtagttttctctagggagaaataagtaatactaatgaaatacagattatgcttaaacagataatcaagaaattaaaatttacggcattgaacaactcttggcatggaaatgatctacttgaagcttctgaagaacacgtgtacctgagaagaaatattagatgcactgtgaagagaaaaagagtacttgaattgtatgcttctgaaatgttaagatgaggccttaggaaaatcttgaaatacaaatgagtctaaaccctattttctcaatctgcgtaatatacgtggcattaatcagaatgtaactagaggaacatctgggaaattataattcatttatgaaagagtaagtcaagctctacaaagcaaagggctcgtgacaaacaaatattgtacctaatttttcagcataagaaacaaaattaaaactgacaggtgagtaggatgtggtgtaatagggaaactgcaaaaaaggagcttcagcttcaagtattttctccagttgtgtgatcttggacgagtcatttacttttatcttacttttattattttattatttcaaatgaataaattttatttttagagaagttttaagttcacaacaaaattaagcaggaagtacagagagttcctattaatatatactctctgcccttggacatgcacagacaccacccccctcgcagctgttatcaacgtccccactagagtggtatatttactataactgatgaacctacactgacacttcataatcacctgaagcccatagcttatattagggttaattcttgatgttgtacattctataggttttgacaaatgtatagtgacatatcttcgtcactgtagtatacagatatacagaatagtttcttaatcactgtagtatacagaatagtttcatggccaccaaacttctctgcattctatgtatccacccatccttccttgctctgaagtctgctctgcataaaattaatatgaaattaatatatagctaccccgcctttcttttaattagcattatcatgctacatatttgtcgatccattcacttttaatcaacatatgtctttatatttaaagtaggtttcttgtcaacaacatataattgggtcttcttttttagtccactcttacaatctctgtttttaattggtatattcagattgttgacttttaaagtgattattgatagagttaggttaatatttaccatatttgtttctggtttctacttgttgccattgctttttgtttctatttttgccttccatacttttactcccttttatggttttaattgttttttatgatttcattttctatctttccttagcatgttagttatacttctttttttttcagtggttgccctagaatttgcaatatatatttacaattaatccaaattcactttcaaatactgcttcacggatggtgcaagtatcttagaatgacaaaacattcctaattgctccctcccatcccttataccattgctttcattcatttcacttatacataaacacacacacacacacacagaggcacacataattctaattctatacattgttgatattattattttgaacaaactgttaattgttacatcaattaataatttttttaaaaagtttttattttaccttcacttaatcagtctccagtgtttgttcctcatttaagtagatctgattttctgacctgtgtcacttatctgatgaatttttaacattttttgcaaggtgtgtctaccggcaacaaatttgcctgagaaaatcttttttttttttttttttgagacggagtctcactctgtcacccaggctggagtgcagtggcgccatctcggctcactgcaagctccacctcccgggttcatgcctttctcccccgctcagcctcccgagtagcaggtggctcacgcctgtaatcccagcactttgggaggccgaggcgggcggatcccgaggtcaggagatcaagaccatcctggctaacacggtgaaaccccgtctctacgaaaaatacaaaaacaagattaactgagaaaatctttatgagttttttctttcagtttaaatattttacaccactttcttgcttgcatggtttctaagaaggttataatccttatgtttgagcctctatatgtaaagtgtttttttcctctgacttctttcaagattgtttctttatatttatttactgaactctgtacatgacatgcagaaatttactttttttttcttttgcatttgtccagcttggtgttgtttgagtttccgaaactgtggtttgctgtctgaaattaatttgggggaaattctcagtcattattccttcaaatattgcttctcatcctttctctctttcttctccttctggtattcccattgtgcataattacatcttttgtagtattctcacagttcttagctattccgtctgttttttgtttttttgttgttgttttgttttgtttttgccagttttcagtcttttttctctttgtttttcagttttggaagttgctattgttatatcctcacatgcagaaattttttttcctcagccatgtccaatcggctaatgagcccatcaaaggcattcttcatttctgttatggtgtttgatctctagcatttctttattattctttttaaatttttcatctctctgttgacattatccatctgtttttgcttgttgtctactatttgtgagggggacagaaacagtgttctacggtcctgtgatcaggtcccaatctttgggtgagccaagggccctagactgtgaacttcaccagtgcttctgggttttttttttttttttttatcctcccttaggtgggacaggatggctacagtaggctggagttgggtgtttcctttccataaggttaaaaacccagcaggttaagctctggtgaaatattcccatgagggcatttttccttaatattcactttaaggacctgttagagcttctgggtataattcacaagattattaaggccctcccaggtctgtgacccctggagttttatccctcaggcttgttcacactgaacctctggcagttcatcaattagcttagatttttcttcccaggtatttgtccctgcaaaggtttctgcttgtgggtttctgctctaacacattgagattctctgtatatgaatgtctaatgtctatctccatagttttggaggcagaggtttgccctgtgagctcacttctctcacagatctaataagagttgttgatttttcagcttgtttagtttttaacttgttattaggatggagtgaagagttctaagttccttacatgttgggccagaaactggaagtcagatcatttacgttttaaaggctcagtttcattgggtgtaaatgaatgagtctgtgccctcaatgataattaacttttgttaaaggaaagggccattcagaaaaaaatcatgttataaagacctatttgtttttcattccaaatgaaaattgctttaccgcatctcctggaaactgtgtacatttatcatttagattacctattttgttgaacagagtacttcaatgagaatattagcactgttttttgctacacttttaataactgaataaagaaaagatcagaaaatatggaggcacttttccaatcattcatgctgaaattagatcttaggtcctgtggagaatttggataggacttgttctctgagaacaatagatgctcatcaaatgactatgttcattccaggttaaaaattacataaatgctaaaatcttatgtaatcctaccacccattataaggtatttaaagcgccaggagataagattttggtgctattttagggactaggaaaattatatatgttggagttagagatagctctatagtaagatacaaccagagttttcagaaaatttagagaactgggatgatagttcagctttgtttaacactttaatcggtttctgaaaaaataagaatttgcctatggacaaaaaaactaaaatgagacgtgaatagagaaagccccgaagataccatgtaaacttcagagctcatctggtgttcattagacgtttcagaatatttcagaactgcaaaggaaccttgctttgtcaggatgagtgggcgagatgaaggcatgaatggctcctgggattttcaagaagcggggttcattcattctaagtgttgactggagcaaagggacaaggaagaaaatgatgatcacacagaagtagaacaaccaaaaggatttcctgaagatcgtgggtcaagagaataaagtagatatgagtgtttagggatttaaattgaaatcagttgttgaaaaatttgcttttcacacattgcttatctggacccagggttgcagaggtaaaatgttggcctgctaatctgatcaggccccaaagacaaggaaataagcacctaattatgcaggggaaaacagagatggagatgatgcggacatccaagtgatagggctgttgagtctttgacaacagaaatcctttatgttccccaacacttggggagtgaatattcttctccctaaggaactacctgacttttgctcattatttatttccgtaggttatattatgcccttcatgattttaatttctctatgaagcatcagttcctgaaggaaaacacacaaccccaagcagaagaagagtttcttctttatatcccaaaataccctgtgcaaatctctaccgtggctcttgaaactacatatagcagtgggctcaactttttcgtttttgagcatagaattctcagcagaacatttgaaggcattaactcatatttatcgatgtcactttgttcactgggtagacctttagccttgtgtttctgtttgagaggggacacttcacaccctgatttatacattcaggaggcatacatctgaagcttttcaataaatgcacactttctcaacagctctgcctcaacgttgcttcttttactccctatggtttttatcctgcaatacaccacattgcatgaactattctacttatttgttctcatagtttgtatcctagtttgtaataaataaagttttcaatgtgactaaattttgccacatgcctgtggaagatgcacagtacatcagagtgtcactttgctgtggttgggaaccagtgttctatcaaaattgttgagttttttttttcctatggactatggttaaatgaataaaagattgaacttggtataagatactgtaaatattaaagtctatatatttcaaatggaggaatttaagagactttttaaaaatatgcaatgccctgaaattttagtatttagtttttaaaatctcacaattcttgatttatgccaccactaattttgggaactttcacataaagattttgcagacatgcttgctctttcttccttcattatgttctccactttgtcttttgtttggcacaaactctctctgctcttccctaaaatttcagtataactcagaaggttacataaacttcagcatgagaaacttcaaaatattaaacctcttttttttttttttaaagctgaggaacgtattttatggggtctgcccaagagagttcattattgcaaagtcagttgtggcacctaaataattaacctataaccaatatatgtgtgaaattattgccttaagctcgccttggtgactgtttgccattaaattagtgggataaataatttacaccaaaatgtggacctgagataacaccattaaattgataggacttgttcattaattgtaaggaattagattagatgaaacacaattccccaagtgtgagctatcctgtggtgtaaacggtgtgttagttctatagttgcatagaggaatagatgaagaccctggaattgctcagctgatgcaatatcgaattgagtagggcatttgtaaaacattgtactaaatatacatagaagggggagtgtctgtgaagctttgaaatgactagaagcaagagaaagcacaacatttcttggctaaaaacaaaaagaaataggactatccatttttgttttcagttaatggtaattgtttttgaactctgctggtctaaaatcaccagaggtaatactccccaagaaaatctgattctgtaggtcaagggtaggacctaagaatattcttaaacaagcactgcaagtgattctgatgcaagtggtatggaccaaatttcaagtaacactattcagggtgatttgataggtttaatcaccctgtgggcaaagtccctgtcttgtacagctccagtgttaagcttggtgcctttaatccataaatattatttctccaaagagtactttgtgcctagctctgttgcaaagagtggtcaataaggcagatgaagctttgactgctcagatagagggagaggttttttaacacctcatatttcgcttttcttggcacattctctcaatgtagctcctttccaataattttaaggcaatatattgacatgcttgtgggggctatgataaaaatctgtcaaaagaaacaaatgaaaccaagagttagactgtttaatacacaatggaagcatcagtgctcacatgacgagacaggtaagaaagtgttgtgttgccttctttatgttttgcttcctcacaagccaacagggttgacctcattacctggcttatcctctccctgaaaatattctcctgttgttagaaccaggctgcaccccagcctagtgaagaaaacagcatccaacagatagttttcagtctgatgagtgttacataaaatatgctaaaggagaatacaacgtgttgctatcttaggctaggatagtccagggaaacatttctgaggaattgctgtttaagctgagaattgaaacgtcaatggaatttacctaagccaagaatatgaggggagggatagatgggggggatttcaatggaaagcaaaccgaatgtatggtgagatgacttaggaaggaagcctcctttgtaaaaacagccaaaaaaccagtaaggttggatctctagagagtgttgggaggcaggctaaaaagattcacaagggctagactagggagaactttgcaaatcactgaagttttaagcaggatgactaggcacttagtgaatattgcaattgggtagatttctgaactgtatcaagatgcaaataatctcaaagttcacagatttccttgaaatctgattctgacagaacttactaattttctatccccactcttacatgctcagagaactccagtttatttgagaccagcaacatacctagcccaggggattaatcagaatagatctaacacaatcacatctattttatttgtttgccagctacttattgccccaggctcccttgtgtctaggagtcacacatatgtagacgataactggccaatctgacatgtaggaaagtgtactcagggactcgtattagcttatcactgctgctataacaaattgcagcaaatttagaggcttaaaacacacacttgttctcttatagctctggaagccagaagtctgaaatcagtctccttgggctgaagtggaggtgtcagcaggggtcttccttcttgagactccagaaagagtcagtttcctcacctcttctagtttctggaggccacctgaattcttggctcatgagttctttctcatatcactccaacctcctgcttctacttatctctcctacttctcttcttttgtgtcaaagctctggttgtctccctcttatcaggacacttgtgattatatttaggatccactgagttatccagaataatctccccatttcaatttaatcacatctgcaaagtccttttgccatataaggtttcattcacaggttctgggtactcaaacaaggatatggtggccagtatttagtctaccacaatgcctctgggtaaatttttatttcctgataaccagagatcactctttccagtctctcccctttcttctgtctaggaatttttttgggggagataacttgatgcctggagctgctgctgcatcttatgtaaatgacaactaaggataaaaaccacacacagtaagtaaagaaagagctcagaacccaagtaattggtaacaatgttgagctgctgtaaagaatcataaggaacatgcctccaaattttctgttaggtatgatcattgattgtctttccttttaatgccacagttcattggtattatgacctgtagctgaatacagtagtccccactcacccactgtttctctttccttggtttcagttacccaaggtgcagtaaaagaagatattttgggaggaagagagaaagcaagagagagaaaccacattttcataacttttgttacagtatattgttataattggtctatttttattattattgttgttcatattttactttaatttataaattaaactt

SEQ ID NO: 86 - DNA, 252096 bp, Homo sapiens
ttttcctgcctcagcctcctgagtagctggaactacaggcgccgcgccaccactcccggctaatttttttattttattttattttttatttttagtagagacggggtttcaccgtagccagaatggtcttgatctcctgacctcgtcatccgcccgcctcggcctcccaaagtgctgggcttacaggcgtgagacactgcgcccggcccatactactacttttttgtaagtattctttcaaaatatttattttcatatgcatttttcgtttacctaaatgacatcatgtaaactattccatcttggcccttaattttttttctccaaacacttaaattttcaaataatcttagtgaaaaattagcagctcaatcgctttaatttttattactttcactgttaataaaactgaataagttttcataaagttaataaccgtttatattttcttttgtgaggtggctatttatatattctgtacatttttctcttttctctattgtttcatatattttttctttttcttattgatttttaaaggttctgtatgaggtaaatatattaacctctagccaaaaaacgggtatttgtcttattaacttaattaaaataattaaattattttgttctattttaaaactatgtagaatttctttaaatgtaatcggtttatgatttcttgagtttttaaaaaatataatgacatttcacccaaactaattagcaatattttcttctagtattttgtagttttcgtttttcaatttattctgatgtgaaatctaaagatagggcttttgtttcccccagaataatgacctaggtgtccaacaccacatattgaatagatccattctttgtccagtgattttagcagtaatttttatcatatgttaacttagatataaaacagggtctgttcaatcagaacttccaggtgtggtcaaacagcatgcaaaatgcagtaagacacctaaaaaaggtccagtgcagaataaaatccagccaagctcttttgccagccaagccaatggagcttgcgagcaagaagaaagggatatcttttctaactacaaaggcatcttcggctcctagccaagcacctgcagagcttccttggaaagaattgggcatcatgtgggctagcggtagtcctttcccatttaatagtcagtgtatttctgcaatagaacattattaattatctcaaactatcattgtttaaaatatctactggggcaaattctcctttattattttctccccctttcaaaggtttcatcactattctctcaaagttatttttccaaatgaactttggatccattctgttaagtttccttgtcacaacttcctatttcctacctttgcccacaaaagtcttctgttagaagtgtgttcaactcatgtatcaatttacttgaattcacttcattattcaattttttcttctgatcctgaaaaaggatgctttttcaacttgaaaagacctgactctgcacccattcaaattatatttttactctccaatctattaaattaccacttgttaagttccatgttgttgctaagagtgaaagggccatttttctacaacaattgcaggacataaataatacttggaatagaagagccctacttaacacgagtaatgagagaaagcacagatcttaatcaagggtcacatttctgcttcttgttccagttcatgtgcactctagatgatagtgaatgaataccttatatggagtccagccatgaccaaaagacaggagctaacactcagcttcatggaaaggcccaatctaatgtccaggaatagactcctgaggtatggtcttctgccacagagctttcaggcctagaaaatttgcttgaagcagttttacttgcttgaaaaactgctgcgataagaagatatttttttcatttgaagtctcacatacttaaaatacaaaaatagaacaaagacattgcattgcaaatagaattacagtcttattttcttaatagagtaaaaaataaattgtctaaaatgatttttgacaaaggaaactttttatttgaaaattatgatttgcagtctttcactagaatgctaatttattaactctcttcaaaatcctgtatcagaatttactcaggcttgctgatagggcttaacaaaaaagcaaagctaagcaaggcacctatacgcttgggcctgacataatgtgatttgagaaaatgtcatcatgctttaaaatgcaaagcgcctatcacaaccgaacaacaaaagacgttctctcattgagtatcttttccataacagggctaaaataattctgagagtggcttttctgtaaaaggcagtctgtggcaagaattgttggaacagagacttgccatgctggttctgcatcaacagtctctctagctcagcaatctgagaatacacacggataaagtgctatcagttcaatggaaattggcaggttttcagagggtgtgactgcagaagactattgttcaatttcaaaaatgaaaccctccagaagcaatttcaaagttatacaaatctttcacgtatactgagagtgcaggtgaagatcatccattttccacataaaaataaattgttaaggacttttaaatgaacacccctacctaaaatgcagtgttctgtttggaaatctgtacattatacaagtgaagagcataataaatcttgaaaaaaattaaatttttttcattgaaatatttttgtagagtgccatgagtttgggggagaactagtgaaatgtacatcaacaattttatagatttataagacagttcttaaagtgtcaagaaagctgtcatggcttaaattttatttaccgaattaagcttcagatatttcttataaaagtgaacttcaggctgttgagttttgaagggtgaagcataggataaagctttaaagcatgtgctttggagtccaaagtcacggttaaaatgtattctctactacttactgactgtgaaatcttggacaagtcactttcttctctgtattagttcattctcacattgctataaagaactacctgacactgggtaatttatgaagaaaagaggtttaattgactcagagttccacagactgtacaggaggcatggctgggagacctcgggaaacttacaatcatggtggagggagaaggggaagcgagcatgtcttcccatggcagagcaatatacagagagcaaaaggggaagtgttattcacttttaaacaaccagatttcatgataactcactcactatcacatgaatagcaaggggaaaatctgcccccatgatccaatcacctcccactgggtcccttccccaacattgggaattacaattcaacatgagatttgggtgggaacacagagccaaaccgtatcactctactttaatattagttttcttatttttgaaacagttgtcaagattaattgagttaataaatgtaaagcacttagcataatctggcaagtaagtataaaataaataatggcttttcatggaaacaggtaaaactatcaaaacttttgatatgttagtgaaagtttttcatgaaactgaatcaatatgggtcaaaataaaaggaaaacaatagctttggctgaaattaatctatagatgtacatttttcttggaaaaaataaaaatatttttggtgttatttttgtctagaaagaataatgattatttctatgattatttttattttttaaccaatctacagaattcattcagatatccccagattttctttttatttttcaacctttattttagatttgggggtacatgtacaggttttggtatgttgagtgtattacctgggtgtattgtgtgatgatgaggtttggggtacaaatgatctcatcacccaggtactgaacatagtacacaacagttagtccttcagcccttgtctccctcaccttcctagtagtcctcagtgtctattgctgccatctttatgtccatgagtacccaatgtttaccttccacttataagtgagaacatgctgtattcaattttctgttcctgcgttaatttgcttaggataatggctttcagctgcacccatgttgctgcaaaggacataatttcattcttttttgtctgtatagtatttagtggtgtatatgtaccacattttatcaaatccactactaatgtgcaattaagttgattccatgtctttgctattgcgaatagtgctacaataaacatacgagtttgtgtgtctttttggtaaaattaattgttttcttttggatatataccaagtaaagggagtgctggatcaagtggtagttctaagtcctttaagaaagcttcaaactgctttccacagtagctggactaatttacattcccctcaacaatgtataaacattactttttctttctagccttgccaacctctgtctttttttaccttttaatctagccattctgactggtatgagatggtatctcattgttcttttgatttggatttctctgatgattagtgatgtgaagcagctcttcatgtttgttggctgtttgtatgtcttcttttgagaagtgtctgttcatgtcttttgctcatttttagtgaaattttttggttgttgcttaattgtttaagttctttacagattctggacattagatgtttgttggattcatagtttgagcatattttctcccatcctttaggttgtctgtttcccctgctgatagtttcttttcctgtgcagaaactctttagttaattaggtcccacttgtcaatttttgtttttgttacaattgcttttgaggacttactcataaattttctcaaggccaatgtccaaaatagtgtttcctagattttcttctcaaagatatctccagtttttctatcaatgccctttttctattccagaattccacatagcatttatgtctcttagtctcttctaatctgtgacagttccttgatcttttcttgtctttcatgactttgacacttttgaaaggtgatggtttagtatcttgtagaaagtcccacaaatcaaggttgtctgctgttttctcatggttaaactggggttatgagttttgggggaaattttcacaaaagtaaagtatcctcattgcatcatattggggtacgtgacattgacatgagttcacacgaataatggtaagtcagtatagatggtgtctgccaggtttcttcactgtaaagttactattttcccttggtaattaatcaatatttggggagagatactttgagacaatacaagtatgctgtttctcttaaacttttacccactagttgtaacatgtattggtagcatgtaacatgtaatattggcacatggtaacactagttgtaacatgtacactagtacatgtagttggtacatggtaacattatatataaaattatttatacataatttagaattattttgtaaggaagaaggatttcttttccttctctttttacagtcatcttttagcttagttcaaatcttaaaataatgtctgctcaatgaactagactaaatgtacatctagggagcaagaatgatggagatcagacctgccccagaagttccatcaccattcattcagtattcagtattgtgtttctaatgtcagtcactgagctagtgtaggagagatgatgatgagtaagtacagcctctacccttaaggagctcacagtccagtagagggaaacacaatgtaataaataaaattataaataaatgtggttaggcactaaaacagatatatatttcttcattgtgggcaagatatagtaacaatttaaaaagcagtcatgttgtcaaaatgagagctgaattttgaaaagtgattgtgtgtatagcaggtagacaagaaagggagaaacatttatggcagaggaaatgacattatcaaagcctgagaaacctgaaatagcaagagaatatgaagaagttgaaatagcttagtgtgttggggagcattggatcagggtctcaaactttatagggactgggagctactgcaagtcttatggacaattttgttttagaaaaagcactctggtgaccatttaagagaagatattgaagttatgtgagattggaggtaagaaacgccaatgaagagagttagagtctcttattatcaaacttattatcaggtgtctgatctgctaaatacaagagggtgtagaaatgacaaactttagagtgatgtgatttttatattgtattaagagaacataccagggagagggtcttacagctttgatttttcaaaatgaattttcagctctggtcataacccattaacatgtttgagtaccttaaattccgtattattaggattttcagtactgctgactacttagaacagttagtgtcatgattatagaaaaatctagatttgttggagactgcttttgtctagctatcttcacagtcttacaatgtacattttcataatctttactagtttgctggaaattaaagaagtctaggtatctcaagggacctatcttatctataatcctaaagttatatttattcaggaagtaccacccttttaattactctaagtcaatatttaatcctagctgttaggaaactttaacgtcatgggagtgaggtcagttgttgaagaaattccagaaaagtggaaagataaataatagaagaacattccagttataagtgaacaatttggagtctaaataatgcaatagtatgaccttcagtaaaggagcacaatcaaatgacaatcagatagtaagagaacagggaaaacgtgctgacatcattcacttcttacattcccatttccatctggggctacccattggccaaaaccaatagaaaatctgaaggcaatgaaacagttggatgcagtttctatgggtcagtcttttatagaacagagcaggataaagaaagatggaaagtatatctaaagatattcagtgcattttaactaatattttgtaaggctccagacttatctttatttagattgcatttttttaatatacatctctaatgatagaggggttttaatcaatataaatgtttggaatttactacatttaaggaagcccaggacttattaacattttgaatatgttttatcacttttaaataaattttacagttattggaaacagaaagaatatacaaagatacagaaatcacacacatacttgaaagtagttgtatatgtcattttatgtaatggaagaatgatatgaaataaaaaatgattatagtttacaggcttaaaaacttcagtttcctactgggcatcgtgaaatccaatttgacattaaaacaaataggaaaacccacaatagatatttagaaaaatcatttacataatgctcagacatcaaaaacttcttagatgcctttaggcaaagcataatatgtttttatgatactaacattcaaatgtcttcttcaagtgaagtatatgatgtaggaatccggtttttgtgtgtgtctgttagtacaatgcttgaattttcacatggataattgaacagtattgtcatcatctacttcaaataatgtttaagagtagtagagattacaatattaataagttgagtattaccacttattatttttactactatgaaaaaaatttctttttatagtaaatctttaaactgagacaatatttaaatacacacttaaatacaaaagtcaaagtaaatgactttttacaaatttgagattctttttcagaatattctatttgtatcagtttaaaaaattagtttcggttagccagacccttgtcaaaagtaccttagaaatatgatttttttttctggtaagcattattagtttcatttttatagaaaggaggtaatttttgcagactatacaccactaacaaaaggcagaggagagttttaacctatttatttatttagtttgtttactgaaagtcttcaggctacaattatattgagatgttttctatagctttcaatttcaatattggttttcagcaatatgaaaatattattctgtttacaaaaatgattacattttaaattgatataatagtttctgtcataaagatgagtactaagcctcttacataagtggtcttgtcaagtctaaaacaaagagttagagatcatgtttgagagaagtaatgtagtgacatagaacacaacaatcaccgaacaaacaaaaaaaaatgcctgggctgaaggcagaacaatggggtctgggttttggttatgccccaccagagctctgtgagtcagttgtagtagcccaggataacattttatggtattaaataagatattgttttacatgcttccttgtacccattgttctggtaacaacatttccttcacatacaggtgcaggcattctggcttttgagctcctaattaggctttcagaagcccaaactgcaaacaatagcttgaaagttacagtgcttttgatttccaaatgataggctttattgagagaaaaaacgtttcgtttggaatttctaaaactgagtttggcatactgaaagcaaggctggcagaactaatgccaagaatcagaatagagaagagtgataatctaaaacaattttcttaccccaaataaacaaataaaaaagggtctagctgtgggattctaggaacagcagaagtagctgccttggctctgtggatagtcaggaagctctatacctttcaccttactggagagttaggagtaacagtagctgagagagcaccccactcacagaagaaggaatgctccgtcctcccagtggaatggaaacaaaatctctctataaatattacacctccctgctgggagtgttggctcagcctgtaatcccctcacttttggaggtcgagtgggcagatcgcttgagcccaggagttggagaccccccctgggccacactgcgagactctgtctctacaaaaaacacaaaaatcgggaggtggaggcagaagaattgcttgagccctgaaggcggaggttgcagtgaccagagatagcctcactgcactccagcccgggcgacagaaagagaccccgtcctaacaaacaaaatcaaaaacttacattgcacctcccaaaggctgaggactacagtgctgctttccccattcccaatcctcttcctatctgaagaaggggtaggaactagttcttttatttttgcgggtggctctctttagaaaataccagtatagctcctctttatttctcgttttgggttttcagcacaacaagacagccagaaaaatctcattaaaaattccgttatgcaaattcttaaagattatctagaaataattatatttttagattatacagtaataataacaatggtttttctaaggtttcagtgatgggttgagaaataaaaagcattatagttttgtttattgagattttaacaatgatgaagtgagtttcaaaggagaaaacacatttgacaattttctgtcacagggattcatctgtgtacaaaatttatacaatataaaaagctcatgaaatctgccatgtggaatataagacgtagatgtcataagtgagaaataattctcatacagctacacatctcgtttacgtttgcttcagaatacagatacataattaacttttttatataatggaaaattggactggttgttatgacagagcatgactccacttggaacttatacagggtatgtttaaggacacacagcatgtattgacacacaaaaaaatctgaaaactctgttctataaatacggttgttctgttagacatcgttttcacagagcctcattgaaacagtttatatgagtagcagtggaaaatagtcaagagacattaaattagaggcggcctatcacactgtattaggagctttatgttttaaaatattccaattttgatttgaaaattaatcagaattctacttgaatctcaaattccaaagtctcaggaaaacaaaaaagaaaaatattattgaaggcaagaaagtgatgtctcaactataaacataagttataattgtaattttaactattaatttcaaaaatttcaatgaaccgttaattattttagacccacaggtaaattatggatacatctctctctttttttttaactttcaagaaagttacgatgttgttagtatttgggaagaaacaacttaaaatctagtaggattgttttagaggtttgggatagtacgtttccctcagttttcttctatttcagataatgctgcttcctttactgtttcatattctatattccattaaccaccaaataatttgactctagaaccataatttactctaaaacaggagatgaggtgttttaatgcctatattaaaacaggtaacatttggccaagacatggaaatcatagataaatgagaaaggaattgcaaataaacataatgatatagataaagagtgtaatttatataagggggaaggtgataatgattaatataatagagatgtttctaacctttatttttatactatgtatacaatggtgatgacaaaaaaaagtaatgcaaagtatgcatagaatgttattagtggatagtctgggtggtagaaataaaaattatttaaatatttgataattgtctgcacttcctaaattttatacaatttttcttctttttaatttagtgtagttttctaatttctaggttatattatttaagtgagaaaaattatagaaatattacagtgtcattctaattttacagaaatcacttactattatgaaagcaatgtttcccacttttagttcagaaattagtctacagccataccaccctgaacacgcccgatctcgtctgatcgtggaagccaagcagggtggtgcctggttagtacttggatgggagttcagaaattaggggttgttggggctcagaaactgataccgcaaaatatggtgctttgacatgctgaactgaggaagaggcctcaagatctctctgagaatcacccccacttttgtcctcaatcctttgtctttcccaaagtacaggatgaagttgttatctaacattcctttgtttgccttatttgcacattaataaatttgtatgtcctttctcctctaaatctgccttttgttcactgattgtcagtgaagcgtcagaaggtgaaagggaagatttcaccatttccttcttagtcaagttatggataaattcctatagttccgccaggcgcggtggctcatgcctgtaaatcccagcactttgggaggccgaggcaggcagatcacctgaggtcgggagttcaagaccaacctgagcaacatggagaaactccgtttctactaaaatgcaaaattaggcgggtgtggtggcgcatgcctgtgatctcagctactcgggaggctgaggcaggagaatcacttgaacctgggaggcggaggttgcggtgggctgagatcaggccattgcactccaccctgggcaacaagagtgaaactctgccttaaaaaaaaataaaaaattcttatcgttccaatcgaaaacatcaggttattgcacattaattaaatttggtgagtgtatgttttgtatactgtgattctgaaaaaaaatccataacaatgtgcctttatattctgatttgattccttttttttaagacgagtctctctctgtcacccaggctggagtgcagtggtggatctcagctcactgtaacctccgtctcccaggttcaagcaattctcctgcctcagcctcctgagtagttgggactacaggggagcacgaccatgcccggctaatttttgtgttttcagtagagatggtgtttcaccatattggccagcctggtctcaaactcttgacctcgtgatccacctgccttggcctcccaaagtgctgggattacaggtgtgagccaccccttctggcctgatatgaatcttaaaataaaatctagcccctaattcttgagagaaagtttgtagtcgtggaaagaatgtggactttgaaatgaaacagatctgcattcaaatgctgagttctgtgactattttttaaatagtacttctcatatttcatattatgcaagtaacatgatagtcccccaaattccttctctttcacatcacttttctgctttgcacatcaatacatagtttatttaccctctctttgaatcttggctgtctatgtgaagtgctttactgcataaaatgcagagaacttctaagtgcaggtttaaaaagtacaggtggctttcaccttcttcctcttagaacccagcatccagaatatgagaagcctcaaccagggtgacaggccaggtggggatgctgtgtgaagaggaaaatgtcctacaactatatagcagaaccaagaaacccagctgacagtaaggacaaaatcccagacgtatgatccaagttaagccatgctaaccagcctccagttttttgaaccatcctagctggggtatcaggcatgtgatgtaaaagccattgtgaatgttttatgaccagcagcagggcaggctttatagatgtgtgacctgagcagttacacggaaggctcctatgctttaaggtttctgtgcttggcttaatgctctgctatcactaaattgaaatacttaataatttatgaacaagtccaacttcttctttttgcactggcctggtaaatcatgtattaattctgcccagcagacattatataaagctgagaccatccaaacccactatgccttgttcagatgtcttaccaagagtattttaagtgataattaaataattattgttttaatccactcagttttgggggagattgtttacagcaacagataaccaaaatacatggcatttgaaaatagcaaagaagctcacaaggagaccataaaaagagatttctttgtgaagacagggatgagaggaagatgcaagtatttatatgaagatttaagggtgttcttaaagaatatatccaaaaatgtaacgctttagaattgatgcagggcaggcaagtcccaaaattgaggcttagctagggagggtcctggcttcacacaggaaagaattcaggggcaagctggtggtgttaaacaggaacttttattgaagtggcaatgtacagcagcagcagagatactgctccttgtacagcagagctaccctgcaggcagtgtgctcagagtagcagctgaatggcaattctgcagtcatatttatatccacttttaattacatgcagactaagaggtggattatacagaaatttctaggaaagggctggtaacatccagatcgccaggtcattgccatggaaaggggcagtaacttccaggtgttgcaatggcaatgaactggcatggcacactggcatatatgtcttatggagagctacttcttccctggccatgttttagctagtcctcaatttggtctggtgtctgagttctgcctccagtgttgcatctgatctcccacatgaaaatgatagatggtgaaagaaatcaagttttttaaaacataaatatattatccaatgtatcatttgaaaaagtttaaagacttgtagctgtaaccaacacatgtaagctacccttatttgatattttaaatgttgaataatgaaaaagttactcaattaatttaaaagtggagaattttagaatgtatattttaataactagtttacaatttaaaaaacaagaaaagcatgcatgcatgcatataaaaaagttttgttagagaatgatttgaagtcacatgggatggaataaagtgatgcttataaaatagatttttgatgctgtatcttttagcaacttaaaaaaattaaaatatccaaacagttttaaatgccttaaagttctgtgtgttagcctacctgggatgaatttttatgtctgatctgaaataagattctaaattttctttttattcatttggatacccagttattctagtgccattaagcggagtcacttcttctccagtagtatgtaattccctgtaacttacatactacagtgtcatatttgtggatctgattctatgtgctttattctgttctattgtttgcttattttttcatttatcaatactacactgttttaattaccataaacttatctttaaatagaaattgcctgttttctttctcttcctccttttcttctcttttaaaattctactttttcttttttattccctttttttcctttttttttgagacagtgtctcgctttgtcgcccaggctggagctcagtgacaggatctcggctcactgcaaactcctcctcccaggttcacaccattctcctgcctcagccccagagtagctgggactacagatgcccgccaccatgcccggctaattttgtgtatttttagtaaagacgcggttcactgtgttagctaggatggtctccatctcatgacctcgtgatctgtctgcctcggcctcccaaagtgctgggattacaggttttttattcctttttaagctcatcttctcctcctcttatttattctacttttctacaagtttgtcttgtctagattagactctgcttttccatttacatttgggatcagcttatcaattacatggaaaacaattttatttatcattttgtcctgtatatctctgttctttttctggaactcttttttttttaatcatatattaaccttctccatttaaatactgtcttatatttgcagcattctctatcttttaattaaataattcgttcttgtcacatcatgttttctgttttaactatcaatgtagtattaaattgcagtatctatattttttattttcagaatttctattttttttttcaaatctactctttgttgttcatgattcttgttctgccattatgttttctttttcttctgttaacagtttatattttcgcctagtggaattaaatattcctttcattgagatctcaattctatctagccagattgctctgaactaaaacacttctttcctcttataggaagatgcactttgtatctagtggttggggactacattcaggcccaatatttctctggttattctgggtaacagctcacattttccatcctgtatttggtttctgcccttgtttccagtagttggaattaatacgtcaataattaaaagtattgatgtacttgttaattctttagttatcttttaaatataattatttgaattgctgactgcacccataatggccagcaaaacattccatttagccattctgctcccagccttggttaagcctctgttctaatgaggttataggatacgttggagccaaggtcccaagattatgacacaactcaatgttttcaaaattaaatgagtcatacagacttgattcattagattctcaactgaaataggtaagttatttcaatcatatgatacaatgattagaatcagcacaaaatatattctttagaaaaataccacttaaaagtgtaatttaatagataaggtctacaaattctttccataaataatagtcaaaaaaattctacaactttaattggcatctatattttaaatatgaaggattttggtacagaaactaattatttatgataaaactgataagtaaacatcaaattagagactgcatgtaggaatttatataattacgataattcagtaagataatttactcttttccaaataaaattaaacattgaaattttgccactttgtttttggtaagaaaacattctcacatttgcaattgtcaaaatatttaagcttattttttcattcttcttattgcatggcaccctctggtttcaactaaacacaatcttaaaatttgacaaaatattttcatgttcgaataattaatccctcattgagaaattggacactaaatacaccaaaaactgtataaaatgcttaaaagaaatggcattatcactcagcagaaatctaaatatttgaaaatattttggatattattttattttttccagatatattagtgtataatacatagaatctattagcataatactttgttaattcaaatactagtctaaaaataattattcattttcttctttgtcttaatacatcttggaacaaataataattctctattaatattatattgtgatttttctatgtaatgatacaaatagaaatctttcccgttttctatatttaaaatcattttcttaaatagtatatgatagaaacactaagtctgttataaacttctgggtcatataatgagacggtatattaaaaacaccctcttagaaaatgagaacctgtttaaaataaaagtcatcaggagtaatgtaggaaggacttcaaatacaatttgtaaaattcttatatgtagataaaaagatactaatgtcaaagtcaggaaatgctacttaaataggaaaatcccattctaacatatctgcagcagttaataaattgaacacacacacacacacacacgcacacgcacacacacagcccacatatttagcacatatcttgagttttttggaaaaaatatcgatttaaataaaataaagattgtttttgaactcgttgctttgtttgaagataccttaaaatacaatttaaagaaaatatttgagaaaattttaaacaaaactgaatcttttgaacaaatgcagacatagagaaggtcattgtatatttttagcatagaagttaaaaatataacaaaggccaggcacagttgctcacacctgtaatcccagcacttcgggaggccgaggcagtcagatcatgaggtcaggagttcaagaccagcctggccaatatggtgaaaccctgtctctactaaaaatacaaaaattagccaggtgtggtggcgtgtgcctgtagtcccagttacttgggaggctgaggcagaacaatcacttgaacccgggaggcagaggattcagtgagccgagatcgaaccactgcactccagcctgggcaacagagcaagactctgtctccaaaaaataaaataaaaataaaaataaaaaaatatatagcgaataaactcatattatcttagttgtaatcaaatcctaactctatgaacttactagcattgtgattttaggagagcagaggaaatgcagtatttgaaacaatactagttgacattttccaaaactgatttgagaagtttgctaaactcatttagaatttttttttttaaaaaaaacctcatttggacaattatatgaaaacaaatggaaacaaaattccaaagttgacttttaaaagtattaagggggtagaaggcacattatctttaaaagagcaacaaaaaagtacacatgattttttagcaaaaattatggaaatcagggtataatggaatgacatcttaatagtgctgaaataaaatgatttcaacatagaatcctatactagtaaaattatcttcaaaaagaaaaagggaaatcatttttttctggataaaaagaatctgaaagaaaatgtaatccgcagatccacactaaatagatatatgagagagagagggagagagagagaaagagatactgaagtgttattttccttcctctctaaactctaatttatattacgttatttggtctaaagaagctaatctgtgacattgtcctgagaatttcctcctctaccatagaataacatttctttctttctgtgtgatctactttttcatacgctaaccatagtctttctttgactgcacttcagtaaactcgttataatatgactcttgctttaatattaacttgtggtaagcagtagtgctaaacatttaatctgaaatttgtgataagaaatagtgttcgaatcatctttctctttctaacaattggaacattgtctgactcagtatatactctctatgtaattgatgaaaaaataaatacctttgtagtagaggctacggttaggaaattataacaatatagcctatcttctaaagtggttataacataattaagatgacttttgcacaaaattaagataagagcttttgcacattaatttgtgtagcaaatttatggactccaaatgtcagtcataaaatatataatatacacaatttgtatatgggatgtagagaaaatattgtaacaaatgaagatgctagttagttggtcttaataaaaatgttactaaatttgttcatgcttcttcatctgtcccttgagtgatagaaaaggtaatggcattttaaattttcttgagaagcgaattaatctcatagagagcactagctttgacacattgtgaaaatgaacactttaatgaacacttcaactcttttagaagttagattttacatttataacctcaaagcatataaaggcagcaaaggataatgaaagaaatcagcttagtggctgttcagagagcatggctaatcagatctccctggtttcctcaccagtgactgtgctcttgctgaggcaatggtgtccacattgtctctcagtcccacatagtcgtaagaagcctagggtaagctgattaattcccttaaatccttttgtacatcacctgaatctccagcaattttatatgattgctaaaatactgcctttaataaatgaggtcatctggatctagtctcagattcttcttctgatattagccctgggtatttcagttacatgatgaaatgaagtcattttcaatatacagcttatggagtttagagattctggtttttgaagccaaaagattcctaactaaaaaagacaggaaggatgctataagaattccatgatatttcaccctgaacttcgccgccgtttttgcttccattttggtctattaataaaaagccgcttatatgacccagacatatcatgctgtttggttacttcatatatttatgcccttttgagtaaaattgcatgtcaaagcctaccacaaagatcacagttaagtttctatggaggttttaatgatgatacatatctctatctcctcactttccccatgcaaacttcctcgttcttttttgtgccaacactttgccttttacataccatttttacaaaagtaacactttatgttaatgtctggtcctccccctgagtaggtaattcttgaggatagtaattttatctgattcacttttgtatccaatagcaactaatatggtgaaactaaagtggaagcaaagtatatattgaatgcataaaaataccataaagaaaaataaactgaacacagcaatgtcttatgcataagtactccaaaaatattttctcagctagatagctatgtcttgaggaactacttttttattattttggtgtttttctcataaaacagggtataatgaagtctgaaatcttaaaggcactttaaagcgttcccacatcaaacatttttttaatatcacaaggctactaaatattgtagggtgctagaatgcaaaacttgtcaaatatcacttttgagctatcacactgtttctctcttgaaatttacacatggtgtccaaaaaataaagtgaaagcacattggagtaaaacacataataacggtgtcataaacaaataatcaaatagactatattcaaagctaaaaatcataatgttgtttaaaattcaactgagtgaagtagtttgtatgactagtggtattaataagccactttatagaaaaaaatgcaaggtggcaaataaaaacaatgaataaaaatcatctttattataaatatgtgtaattatattttttccagcagctttaaactgacatgaatatctgcgatgagtatctctgagttctaatgttacctactatactaatagatgaggggtcattctattaaaagaatgagaatgcttcatgcacaggttatgatatcaaaaggcagcagttctttttagtaaactgaaactcctgtgacaacaagtgtggaaatttaactttgtacttttagtgaaacaagtttttggtcatgtactgaaatacaccatagtaaagaagaacttcttgctggaaatgaaaaattctaactgtctactccaactaggaatggtcatgctaaatttgaaatcccaattatagaataattatactttttttgctaaccttcactaataaaatagctattgttaatttgatttcattaattttaaagacaaataagcattacattacttcattttttgataacactttagaaagttctacttccaaagatggtaagagcagcaactttgttttgttcatttctatatcctcaggaaattattcaaggacaaggtggtttctcattaaatattttatggaatgaatgaatagatgagtatgatggttaatactgagtgtaaacttgattggattgaaggatacaaagtattaatgctgggtgtgtctgtgtgggtgttgccaaaggagattaacatttgagtcagtgggctgggaaaggcagacccacccttaatatgggtgggcacaatctaatcagttgccaatgcagctagaatataagcaggcagaaaaatgtgaaaagagagactggcctagcctcccagcctacacctttctcccatgaaagagagactccaatgtttgatgcttcctgcccttgaacattggactccaagttcttcagttttggaacttggactggctctccttgctcctcagcctgcagacgtcctattgtgggaccttgtgatcgtgtgagttaatacttaataaactcccctttacatatatatatgtgtgtgtgtgtgtgtgtacatatatatatatatgtacacacacatatatatgtatatatgtatatacatgtatatatgtacatatatatatacacatatatatatcccattaattctattcctctagagaaccctaatacaatgagtgaagaaataaattaatgacattcacaatgagtgtaggtgcagataatgaaagggtctgggaaagttggcccctcccttgaattgaataagagctcccaaagaaagagttttatattttattgaccacatattttatgcttgtcatttgtacaggttctataattgcaatgcaggttcagttattgttttttttgtttttggcaatgctgatgtatccattggaatcaagtcagagaaacagaagccacttttggatttcaaacagaatttaacaaagagaatgttgacacagttgaaattagagctaaaaaagccaaacaaaggataagacgatccagaaatctgtaatggcaggaagttgttaccatgattatgctgaaagaagaaacccagaagaccaccttactggatcttagaagccaggactacctgggagaagctggaagtacactacacaacagacctccattcatgcagtaaagggttgtttggtgggtaatggagccactgagaaaaactggccatcgctggacataacagtagaggtagagagctacagggaaaaactgtggagtgaaaaaccttgacttctcattttatcctgccttcctatttctattgagtgtgtcccattggttggcactagttgaaagccagtgggcaaggggttctggaaaatttagtttcctctgatatagataaaaaggaggaaaagttggagaatgaaactgagagcagataggtaaagtggaatgcactatgattttaagtagaaaaatgttcacttttaattctttatatgggcacattcaactttaacacagaattagatattatatttttctgattgcatttttaaaatatcctcataaaacaaaatataagaatgaactttctggagcatagatatactattttgtttttattttcccttcgtaaactatatttgttaactttgtgggtggttttataagcttcttggcaagaatgtttattgtatttgtattttctatagctattatgattgttatttaattgacagataaaaattttatgtattgatcatgtacaatatgccgttttgaaatacgtatacattgcagaatggctacactgagctaatgaacatatgcattgcctcacacacttatcacatttgtggtgacaacacaacatctactctcttagcattttttgagaatataatatattgttattaactacagtcatcatgttgcacaatagcactcttgaacttactccttctatataactgaaattttgtatcctttaaccaacatctccccaccctcacccctcacccctcaccccagcctctggtaaccaccattctactctctacttctatgaatttaacttttttagattccatatataagtgagatcatgctgtatttgtctttctgtgcttggcttatttcacttaatgtaatgttctccaagttcatccatgttttctcaaatgtcaggaattccttctttttaaagctggatgatattcctttatatgtatccaatatacaatatatgtctattatatgtacaatggtattccattgtatgtctgttatacgtatatatctcacatttcctttatctagtcatacgttgatacatattttggctgtcataaataatgctgcaatgaaaatgagagttcaggtatctttcacatactgatttcattttctttaaatacatacccaatagtgagattactggatcatacggtagttttattttcaatttttggaggaagcttcatactgttttctatagtggctacactaatttacattatccgcatcactgtacagtggtttccttctcaccacaaccttgtcaacatttattgtcttttgtattttgataatagccatcttaacaagtatgagatgatatcttgctttttaaaattttttattttattttaagttctgggatacatgtgcagaacatgcaggtttgttacatatgtatacatgtgccatggtggtttgctgcacctgtcaacccgtcatctgtcttgtggttttaatttacatttttctgatgattagtggtgtttagcatatttttcgtatacctgctgcccatttgtatgtcttcttttgagaaatgtctactcaagacctttgcccattttaaaaattaattatttggttttctaaaagtaatattgagtttcttatatattttggatattaatctcttatcagaggtatggtttgcaaatagtttctctcaatctgtatgttgcctcttcactctgttgatattttccttgagtgtgcagaagttttttagtttgatataatcccatttgcctatttttgtttttgttccctgtgcttttgcgttcatatccaaaaatgtatttcccataccaatgtcatggagctgttccccatgttcctttctagtagttttacagtttcagatcttacatttaagtctttaatcaattttgagttgatttttgtatttggtgtggaaaaaaaggtctagtttcattcttctacatatggatatccagttgtcccaacgttatttactgaagaaagtcttttccctattgtgtgttattggtgcctttgtcaaaaatcagttgatttcaaatgcatggatttatttatgagctctctattaagtttcatttctgtatgtgtccatatgctataatagtaacatgctgttttgattactatagatttgcagtacattttaaagtctggtagtgtgatgcctctagctttgttctttttactcatttttttttttttttttttgagacggagattcactcttgttgcccaggctgcagtgcaatggtacaatctcgcctcattgcaacctccacctcccggattcaagcgcgtctcctgcctcagcctcccgagtaactgggattacaggctcccaccaccacacctggctaattttttgtatttttagtagagacagggtttcaccatgttggccaggctggtctcgaactcctgacctcgtgatctgcccgcctcggcctcccaaagtgctgggactacaggtgagagccactgcacccggctcgtcttacttaatattgatttgactatttgggatctcttacggttctatatgaattttaagatttttttctatttctgtaaaaaatgtcattggaattttaataagggttatattgaatctgtagattgccttgagtagtatggacattttaacaatattatttcttctaatttatgaacatgaaatatcttttcaattatttgtgtcttctttaatttctctcatcaatgttttacagttttcagcgtacagttctttcactttcctggttaaatttattcctattttattttttctgtagctattgtaaatagaattgttttcttgatttctctttttgaatagattgtgtttattgtatagaaacatcactgatttttatatgttgattttgtaccttgtaactttactgaatttgtttattagttctagcagattttggtggagtctagtgttttctatatataagaccatgacaatttggccaagcacagtggctcacgcctgtaatctcagcacttttggtggtcgaggcaggtggatcacctgaggtcaggagtttgagaccagcctggccaacatggtgaaaccctgtctttactaaaaaaaaatacaaaaattagctgggcatggtggtgggcacctgtaatcccagctactcaggaggctgaggcaggagaatcgcttgaacccaggagacagaggttgcagtgagcagagattgcaccattgcacttcagcctgggcgacaagagcaaaactctgtctcaaaaaaaatcacaatttaactttttctattctgaagtggatgacttttatttctttctcttgcttaattgttctggctaggattccagtgttatgttgaaaagaagtagtgagaagggacatccttgtcttgttctgatcatggaggaaacactttcaaattttcagcactgagtatgatgttagctctgggcttgtcacatatgacctttattgtgttgaagtatattccctctgtatctaatttattaatagttattttcatcatgaaagaaagttaaatttgtcaatttttttgcatttattgatatgattatatggtttttgacctatatgctgttaatgtgatgtttgggaaaaatactaaaatcatgtttttcctctgccctcacaccacaacaatcaatacagaagacttctgtgatcaaatgtgtggtttattttccccattaacaagtattaaacaccagctgagtattctccaattcaattctgacactatctacctggagatagaccgcctccttgagcttgattaatttgctggagtgagtaacataactcagtgaaacacgtcgaccagtgtaatataaaggatattacaataactacaataaagagatgtgtagggctaggtgggggtaaggagcacatgtgcctgggtatgccagccgccaggaacctccatggttatctagaagcttgcctaatccagtcctcttgggttttcatggaagcttcatatgtcagccttccttccctaagggtatagggtgaaatcctctctagggagagtcttaagacctacaatcaaattatagtcctaccttgggactctagagagcaggaaaaggtcagagagattgtttccagatgcctgctcctgaggtttaacatacctaacattataacaaaagactgtaataagggctatgggaattatgagccaggaaggtgaaaaaaaacctatatatatattatatatgttatatataatatatattatataaaatatataatataatatatatattatataaaatatataatatataatatatatattatataaaatatataatatatatattatataaaatatataatatatatattatataaaatatatataatatataatatatataatatatataatatataaaatataatatgttatatataaaatgtataatatattatatataaaatatataatattatatatatatataaaatcatatcacttgtggtatttcacattcatagatttgcatgtgttaaatcatccttgcatccctgggataaatcccacttgatcgtgataaatgatcctcataatatccttttgaatttgatttgctagtattttgttgagaatttttatttctgtgttaatcaaggatagtgacttgtaatttctttttcttgtcatatccttatttggctttgttattagggtaatgctggcctcataaagtgtatttggaaaaattttttgttcttcaattttttgaaatagtttgagaagatttggtgttaggtttttaaatgtttggtagaattcagcaataaagccatcaagtcctgggcttttctttgatgagatagttttattactaattcaatctcatcactcattattggtctattcatattttctatttcttcataattcagtcttggtaggttgtatgtgtctaggaatttattcatttcttctaatcttcctaaattgttgatacataattgttcatagtactctgttactgttctttttatgatattagttgtctttttaatttctaattttatctatttgacttttctccctttcttagtctagctaatgatttattttgtctaccttttcaaaaaaaacagctcttacttttgttaattttttttcggccgggagcagtggctcacgcctgtaatcccagcactttcggaggccgaggtaggcagatcaccaggtcaggagattgagaccatcctagttaacacggtgaaaccccgtctctactaaaaatataaaaaattagccgggcgtggcggcgggcgcctgtagtcccagctactcgggaggctgaggcaggagaatggcgtgaacccgggaggcagggcctgcagtgagccgagattgtgccactgcactccagcctgggcgacagagtgagactctgtctcaaaaaaaaaaaaaaattctattgttcttctagtctctatttcattaatttatgctctgatctttattacattcttctttctactcactttgagcttacggtcttccttttctcgtttttatgtagataatgttaggttgtttacttgagatctttttttttttttgatgtaggcatttattgctatcagattccttcttagaactgctttcactgcatcatatacagtttgatatgctgtatttccattgttgtttgtgtcaagataatttttaaattttctttttgccctatttagtgttcaggaacttgttgtttaatttccatgtatttgggaatttttctaaattcttccaattgatttctagcttcatgaagcatagaagcacttttttattgaagataaaattacagatttagtatttgagaaaccaaaaaaatggtgtcaactaccacattttttcaggaataataatatattttttgcttgctgcttagaataactcaaagcaacatagacaatattttatgacacagtttaaaagcaagatgacttaatatttaacaattgtataatattttaattagcccaaaatacttttttcctagattttaaagatgtttacattttgtcacatttgtcatttaaaagagaaaattatagatacagttgaatgtccatttctgcagtcaatccttgtacctccctttttaaaggcatatagtctatcgacatttataggattgttagttcagattttaagtttacatacattataccaaatggtaataaacttttagaactggccattctaactcaacatgattatatatttaccaatgttgatatgtctagaacttgttcattctttcattttagttgtgcatagtatgctgttggacagtatactattatttatcttttgtataaatttgatgaagtttatatattctaggttctgtttttcagttgattatgttgaaaatattttccttcagtctgtgttgtagttttggctaaaaaattttaatagaaaaatataactcatttttcttacacattattttaactacaggaagagaaaaaaaaccccagaacattaagtaagactactgaaacaagctaaataggtgatattgcatgtaaacatacatacatctttctattcatagacaagacacaataaaaaatcttggatgaaatacttcgatttgcatatattacacattttcttttttgctggttgattaatgactgcaaagaaacttgaactcattttatgtggagaacactggtaaagaaaaagacacaagaaattctgaaaaagtacctgaaagtgaagatcctaagagtgaattggatcttattaaataaaaagctgttgtttctattctgtggtatttagagttgggagtggttatatgcatgttatttattcactcatacagtcatttaagagttttattttcttaattatttagtaaaatttaccaatacgaggtaagaatcaaggtgaagacttatttttatttaagtggaaagtaatacaaagttttatagttgaaggaaacagtttgcagctgagtttgcagccattttattttggaggtcccttggattttcccagtaggttctggagtcatttctacattttttcttatgaaatttggtgattattatgttaagtattggtaaatgtggtcatatcaaaactatgttatttgtattctggcaaacttttacactaatcatacattgtatgacaagcaagaatttcaaggaagtacctagtctggtctcttttatgcctgattatttttatgtctatatccatataactctccgttatgatactctgtttctctaaacagtgtatctctcagtttattctctttttttaattaaaattggagacacaacaggatagaaattgtgtgttttgttcaaatggtgtgccttcaactcatagaaaagtgtgtgacatataaatgacatcctgtttatattcattgaatatttgctgaataaatggaacaaacaaggcctaaacagttacatcattcccccaaatcatacaaagtattttttctgtgacaacccatttcccctccatactcctcagtctgacaatttagtgtttcggacccctgttcctttcatccacatctccctagtctactgaaacattcagaactactctgcctttttctttccagctcctaattatactcctagattttactaaggcagtttaatattttatttcttcacaagttgtataatctcttagaaagttatattccatattcctgacagatagtgtatcattatcccttcagatttagctgcatttgtactgctagggttattactaatcttttctttctttttattttccttatctcaaattctcagctctagtaaatctgtgctttaactataattttttaaaactattatcctcaaatgatgaatgtgggtgataaactctctgaatatttgactattaacaaatatctttctctcttccaggagactggtatcttgtctgtctaaagaatgattagtttatcatcctattttctcagtagtctgagtattaatcctttgctttctagcagataagaagttggacacaaatgattcttattctttgcaagtgacttgttctttctacctggaagcttgtaacgcttccttataattttgcagttcaaaaattcagattgtgccttcacataaatctatttcatcaacattacttggaatttgatgaggcattttaatctgcaagcttaaatatttatttagcttggagaaaatttcttttactatttgatcatttcatcttttccatgtagtcttttttccttctgctagaactaatattcttcaaatgttacattagttgcctgtactatcctttacatctctcatcttcactcacattttccatgtgttagtgcttttgtgttgctttttgtggtatttcttcctctggatcctctatttgagatttcaagtgtccataccctaatatatctgcagagtgtcttttattgtgaagatgtgttttattttcagaaatatttcctataaatgttcttccttaaaagttcttcctcagaggttctatttaaataaagaactatgctaaatgttttgttgctcttctttgaacagactgttggaccctcaggtgaatgattacgtgtttgttcttctcactatatctcaggtgcagttgccatagtactgtcctgggttgagaaaatggaattggaatggagatttgtgtgcactgtctttaatagggagtggtttttggactaacacctatggacagttgaaagccacctttggtagtacttttgaaagctggcgaatatgttcatcattcctgagggcaatctggacagtgaacgaacatcactataatttcaggcagcagtgaacgtgatggagagaaccagtgtctctcctgttataagccaatagcagcagcagcagcagattattagaccctatcactgctaccaggaaaaatccactttggctccttggattctctcagcttaaaagctaaagaaggcttggcttcctttccaatttctcagaaaattttgaacagaaacatgaggcatagtcgcattaacttatagggatttccaaattatggaaagtcatgcttatgcacaaccatggatcctagatacagttctttgaacccagtctactgcctggctaggaaggaaagagggcttcaaactgttggcttcattcagggtttgcctgttgtcctcaaaaaagacagaaggattggttctgtctttacaatatatctacctcacctcctctaactagggccaagccattattgtttctctcctagagcccagtaataccctctcaactattcttcctgctttcatacttacccattttagtcttaatattgtagccagagtgatctttttaaaatataagtcagattatgtcactcctctagtcaaaatttttttctatttcacttgtagcaagtcagtccttaaaatagcacaagactcagtacaatctctactagtcacctctctctgccccctccaccacccacatatatctctaacttcatctactttcttctccttagtctttcatggtttttcattggtgttctttagcttttaagactttgcactagctttctctctgcctggaatgtcattccatcaaatattcacaatgggaattcccttatctcttttgtcaaatgtcactatctcagtgaggcttaccctgaacaccccctcctccaatttaaaattaaaactagccccatttttatgctactgaattcccttaacttgctttaatttttcaccttctaacaaatgatgtaatttatttatttaccatatttattttaactgtgggcctctctgctgtaatttaacaaggttacatctttttcaatgattgactcatgcatctagaggagtgtctgacctctgatacatagtacaggctaaaataaaaagtggccacatgaataaataaatgtatgaatgaatgaatatgaagaagcttagacaatttcagccttctctcttcctatcacctttgatcctttatggaaattttctctaatcttcacaataatcctgcaatactgacattaatttatccattccactgattaaaaaccaaggctcagctaatgagtgaaatatccaagattcaaattcaaatctgtctggcttccaaccttatgtatttttgtttgtttgtttttgttttcttccccatgatccaaagctctttctaaatggtaatgattgagaactaatgaatgtagaaaagatggttctaagaatgactgtttctcctgtgtatagtggacagcctctcctcatgaaggagattaattcctcaattggggtgagaaagacagggactttcctttcatctataatatttaaactcctcaattcctgtcccttctcctcacctgggaaacatttattatcctgtcctttaaaattgtgtgtactgaagagacattggaggaaacattctaagttctttgcccttctagagtcattctctatcattctcatcacatagtcactagaaatcagtatggaacagaatcatggtgctgttgcaaaatttacaattaacagtgtgaattaacaattaacagtgctaaatttctctcataaaacagtgcagcaaaattaccaactaaaaaatgtgtcaatatttattgcctatgacaagtttgtccttcatttaaaaaattttgctttcaattcttccccaaattatcctttttttcaccataaatcacatgtttatattatagctatcaaaggaattacatgtgattttgtttaggtacttttttttttagaaaaatgattttattaaggcataattgacacactataaactgtacacatttaaagtgtgtaaattggtaggtttatgacatatgtgaatagctgtaaaaccatcaacataagcaagataatgactatacctatcacaaaagtctgcatttaccccttttcagtcttttagtttcttcctgtctcccctcatcttcaatcgctgagttatttgttgtcactatagattagtttgcactttctataatttaacataaatgaaattatatcctatgttgtctttttcttttggctttttttactcagcatatttgagagccatttatgttattgcatataaagatgggtaattctttttaattgccaactagtatttcattctttagatgtactacaatttgtctatccattcaattattggtagaatttttatttttcagtttttggctattacaaataaagcggctatgagcataataaagcatctatgaactattctttgtttgaatatatgctttttttttttaggtaaatacctaggaatacaatggttgtattacatggtaggtaaatatttaaattttaaagaatctgccaaactgttttccaatgttgtggtaatattttacattcctgttagtagtgtatgagggtttctgttgttccaccttcttgccaacacttggtatgcccagtctgttttagttttagcttctaattctttggcagttgtatatcattgtggctttaatttgaacttttctaataactaacaatactgagcaccttttcatgggcttaattgccatccatatatcattttggtgaagtgattgtttcaaatgttttgcctaataattttatttcgtggtttgctttcttattattgaattttggaagtcctttatatattctggatacaagtcatctaccagacatgttatttgcagatgcgtcctgccgttctgtagcttgtcttttcatactttatacaatctctttagaaagcaaaaattcttaattttgattaatcaaatttattatgtttttcttttcgtggtctgtgttttgatattctatgtaaaatatctatctttagtgcttctcaactgggggcaattttctcaattcccccagttcacatttggcaaagtctggaaacatttttggtcatcacaattagtgtcagtggggggttgctactggcatgtagggtagaggcaagagaaaatgttaaacatcctgcaacacacagaaaatgtcaccccctacatacatgcgtgtgcacacgctccctctccgccccgtcccaccccatgcaaaagaattgtctagtcccaaatgtcaatagtgccaaggttgaaaactctaatcacaaggatttgtgttttttcttctagaagttttatagctttttattttacacttgatatttggcatttcattttcattcaattgaaaatacattctaaaattccctttacgatttcctctttcacatatgagtttttataaatgtgatattcatatttacaaataaatatgtggttatgtgggtattttcagatattcgaatattttccacatattttctcactattgatttttctattaataatttaactgtcatcaaataatgtatttttgtactctcctcactctattgttgagtattctaaaaatttaaataagatcagttggttgttcaccttttagaaacttctacatccttacttaattttttatctactttctatcagtcatggagagagtggtattaaaatctccaactacatttgtggatttgtatatttctgcttaaagttctattaatttttgctccaggtgtttcgaagctctattgataagtgcataagcatttaggattgttaaaacctctcaatgaattgaccctgttattataatgaagtggtactttttatccctggtaatatttttcctctgaattctcctgtgtctgatattaatatagacattatatctttccttggattagtgttaagatgccatgcccttttccatctttttgtttttaatatatttgtttatttatacttaagggtttttttgtagaccatatacagtgtgttcttgcttttttaaatttactcaataatctctgcctttttgagttttttgatcattaatatttaatatgattattgatatgattgtattttaatctgccatcttattatttgttttctgtttgtgctgttctttttatgcccttttctcatttcccatcttctgttgggttgagtgctttttttacaatttgattttctatttttttcattagtttattactcttgttttcttgactgttgctttactgtttaatagtatgcacatttaatctattgtagtctaccccaaataagatatcaatttctgtgtagtataagaaacttacaacaggatgcctccatttcccctttaaactttttgatctttttatactttttaattctacatatgttataaccccaactatacattatcatttttgctttaaacagtcaaataccttttaaacattttaaactatttttaagtccttttatttactcacatacttacatttcagttctcatcattcagttgcacagatccaatttccatatggtatcattttctctgtctgaaggacttgcttcaacatattttttgactgatggtaataaagttgttgtcagttatatgtctaaaaacgtctttgtgtctttgccttcatttttgaaacatattttctctgagcatagagttgtagattgacagttttttttcgttgaacaacatccgtaaaaagatgttgatctaatgtcttttggcttgcattgtttccagtgagaattttgctgtcatctttatttttgttcctcttaatgtaatgtgtcttttttactgtttttgagatttcctctttatcactggttttaaacaatttgattatgatgtagtttgatgtagtttgcttcatgtttcttatgcttgaaaatttgttgagaatcttggatttgtgggcttacaattttcatcaaatttagaaaagatttagtcattatgtcttcaaataatttttgttttactcctttcctttgaaggctctgattacatgtatattagaccacttgaaatgtactacaactcactgaagttgtgctcttttttttttttttaagacttttctctgagtgtttcattttggatagttcgtattgtgtattcaggcacaaaagtctctttgtctgctatgtctaatctactggtaattctaaatcggtattttaaatcttagatattaaagttttaagatctaggattctgtcttttgtatttttaatatcgtttttatctctatttaatgtgttcaatcttctctctagtttcttgtacacatggaatacacttataattcagttttcaagttcttgtctgctaattccattatctgagtcatttctgggttggtttatattgatttatttgttttcctcattatgagttatattttcatgcctccttgcagaacagattggatgccagacattatgtattttaccttattagatgttggatatctacctattcctataaatattcttgaactctttttctgggaaacggttacatcatttagaaaccatttggtcattcgtctcttgcttttaaggctttttagcctttatcaaagcaacatttattctagggttaattttgctctaccagtgatttaaaaccttttttagcagtctagctaattcaccattaattagtaaaatttctactctggattttggtaaaagtaactattcctggctatgtgttaactcctgggtttattccctctaatccttttgggtggctcttttcttggccttgggtagtttcttcacatggatgtactaatcagtactcagcagagaacttaagtaggccaaggctctaaagcttctttctatgaagctcattcctgtcacatacccagccctgaaaactctagccacctttacctccctggactcccaactcagtttgctcatatcagggagatcattaagtccttcctgtgtttcctgtcctggcatcgaggcccaatgagtctttccaggtagtaagatagggcaattatcagcctcatctcatttgtttcatgtctctcaaagatcactgtctttaattaggggatctccaatgtcttaaaaacccataatttttgtatgattcttaaaattttcttttcagtcatgaagttacatcttgtccatattacttcattttagccagaagcagaagtgggtttactacacgtgatttttctcaaatactttaaattccaaaggtaaattccaaacaatactagtaaactactttttaaccctaaatattgccttaataataaagttcaaaattgatgtttctattaagaatacctcctttcttttagaagagcattgtagttggctttgactaccatagtagtataaaacctgacagttcttattcaccctctgtagttgtcaggattaatttacaaatgacattgaattttgggagttttacttttatctgaggcttctatcagaggtgtacaaaaaggaaaaaaaaggaaaaatcttccatgctgtattgcttctcattttcagccttgtaagttcatcagcaatttaaagaatttaatcaacacattttcagttttccttcacctttttattgaatgagaaactgaagcaaaacagagttcctcagtcaagaaggagcagagctggcattcaagcctgttatcctatttttgtttctcagtaagatatcagatttctatattgtttcacacttgattttttaggacttgaggtcaaacttttactagattcactgatcagtgttaacttatgttagcgctaagtaaaagtataaaaacgtccttatacaatttcagaattttaaggtaatccaactaattttattcaatttatttattttacaggtggagacataaaatttaaattgctctaagcaaactagctagataggactaaactgactattacacaaattatttttgatattttaaataaaaatgttatatggccaaattaaaaacaagctatcatttggataaagagatgtttctttctttctgctacctaatttttctaaaatggttatttgaaaaaatacctttgtctcaatttcattcttccgacttctactccatttaaacaaaataatagattagaaacataagtaaagagatttgtattatttttatcattttatcacctataaataaacaattctgctaatgcaagaaaaaatagagtggatactcaattaactgcaataatgaggaagtcatagataaaacatcattagaactaagtccagtcttgccactcaaaaaagtgtgatgcaagaatcagttgcgtaggtattaggtgggagcttgttagaaacgcagaatcttaggcccagctccagatctgcttactcggaatttgcattctaacaaaatctccgtgtgattagtgggcacagtaaagtctgagaagcattgctcatcctggttttgcagctgtgtccttcttctgttcatttatctccccaggaaaaagctttataatctgggtaattatccttgattagcaacccttataggaggtagtaaaggggacattaaagcttaaactccaaattactgactgcaaactgagaaatatcacctgcttgattccttaacaccctcccactccctagccagctctttcagaatatctgaaactagttaattttctgagcaatcaagagttgtctgtatctaagaatattttgtgattttatttgtgctttcatgttcttcttcctcctgtttctacagatttttttccttaaaaatctttcatttaaaaatctgtagaacttaaagttaattaatataatcaaaaaagttacagacgttgaactattttactatttgtagttaagttcctaaagattgtgaaatgaaccacataaattagaatttacttggattggaattatacatgtttcagatatgatcaaaatcaacacttctgaaataaaatcaaagagcaaataaatggtgtgcttgagagataatataaaatgctgaaataattttgtgatgaactttgatcagataaattcaaatatcaaattatccacattattatcttactgacagaaagcataaatataaaaaatatcttattgagtttctatatgatccacatactaagtgatgaaatctataaaggcatggtagtttggtataagtattagagtcatcagttctagactggtttgttctcaatgagaagaaaaaggccttctctgcattgtgaatttaaatattttgctgttccacaagactgggagctctaacatggttcacagggaccaaaaattaagctcagctcagtgccaggaacagattacaattcacatattccgtggaatgactgaagaaatgttgtccgtgatatttgactagttactgtcctgcactatttgcagacagcaccatctgttattattgctgaccttccatttttcatcccaaactttcaactactaaagttactaaaaagatagaaaataaataaacatatagcactatctctaaagagctacactgaaatacatatattggaggtagttctctatccctctattgcaatagcattaaattctggctatacttattttgggaggccaaggcaggtggattgcctgagctcaggatttcgagatcagcctgggcaacatggtgaaacccatctctactaaaatacaaaacattagccgggtgtggcggcgtgcaactgcagtcccaattactcaggaggctgaggcaagagaactaattgaacctgggaggcggaggttgcagtgagcagagatcgcaccactgcactccagcctgggtgacagagcaagactccatctcaaaaaaaaataaaataaaattctggctatattttacgattgtttggaaactccaactgtgcaattgttggaacctaaaaacatgtctaggccttatgccaaagtagttctaccaaaatgtatatatttatatggtgtcatatatttgattatgctttatgttccttgatctctaaatggatgcaaaccaatccataaacttcaagcaagccagcttgccaacacaaatcacaggaatcagtcaatgagcagggatgtgataattatgtgggcaagtagagctagtcagacatgggaagcttgtaccttgctctggatttttttctgtttgttttccacatctattttgtgtcccactctgggagagaaatatgtcatagagtaatttaatgctagtagcctagtgcttaacaatttagtactatatagtggtacctaagttaatgtcgaggcctgtaaaaacgcaaatcactagccctgatattctccacctgctcccacagcagtctcatatttaggcagttttttgctttctgtagttttgtgtttatgtggctttttttcttatcttctgctacctctcctttctacccctaattctaatagtattggtccatcttactaacagcaaatgaattccttgaatctcaactggagtggcgtagtcctcttagtgaagttccatctgtgacttcagaggctccaatcttacttcacaggggcttattggagcattttgttaaaacacgtgctatgcaactccaagggattgtatcagtccagatagcataggttatgctgcagcaacgtattagtctgttttcatgctgctgataaagacatacctgagaatgggcaatttacaaaagaaagaattttattggacttacagttccacatggccagggaggcctcacaatcacggcagaaggtgaaaggcaggtctcatatggcagcagacaagaaaagagagcttgtgcatggaacctcccctttttaaaaccatcagatctcgtgagacgtattcactatcacgagaacagaaagcatgggaaagacctgcccccaagattcaattacctcccactgggtccctcccacaacatgcgggaattcaagatgagagttgggtggggacacagccaaaccataacaagtaacaaataatccctaagtctcagaggcttagtaacaaaagtttagtcctcactcaccttacatgttcaatccaggtcagctatgattctaagtattttttacttgaagattcaggaagatattgctgcttctagcagaaatgctaatagtcaatttctttttttcctttttccttggaaaaaggaaagtagaatgataaactccatgttggcctatgtgatatgcatcacttaacctcatgtctcattagttaatcaagtcatgcaggcacatatggcatcaatacgttaaggaagctatgatttctcttcttcaaacagaaaggacagtgagtatttatgcataataatacactctaccatagaggcattgtggcaaataaaattttatccacctcattatgtgtaatattattcttttttgttcttgtttattcatatttatttcttcatgaaactgagattccttcaatcaagaaagtaattttattagttttgtttccttagctcttattccctgacatatagcaggcatttgacaactgtttactgaatcaattaaagataaacattattaaatcatagctatatctagagcttgctgaacattgatgtttctataataaaaccgtatgattcttaggtacaagcacttctaacataaatagccatgcactcagatgatatcctgatattatctgccaaacacatattatcgccaggtatgtggcagagcctatatcacaatcattaaagaagctctcaagaagtttgttgggagaataataaagttttgacttctgccaaaaacattctgtgcacgagtcttacaattttattttaaaaaatggttggagggagtttgtttgccttgccttttttgttagtaaaataaagtgtgtcacaggcccaaaggaatttgaaatatttctgaaaagacactaaactgtgtaggacaccacagatgaggctcccttttgccttctcaaaaataaatgtgcacagtttatcttcttgtatgattaattactgtagacttaattatatagaataaatctgtatcatgtaagagggaaaaacatctgaaataataaatgcttttaaaatgttaggttattttatgataacattatcatcataaaaacaatattattttaccttttgaaattctatcccaatacagaaagacaggaatgataaaggtaattttctatgaaatggtgtgagagcttattaaaccaatactgttttgcatttcagatagtattgtataaagagatgaatcgattttttaaaaaaaattacaacagacaaatattaaatacttatttcctatatggatataaatattaattaggtagaagtgatatatgttgaaatgaaagaatttgaattagttatgtgaaataaaatgcatgagtaaaagagtgtcttacatggagacataagtaaagtcaaagccttaattaaacaaaaacagaaaaagggggcagatctcccacctgctcaatgatgcctgaaattgagctgtgggaacataattcctttcccttaaagtgtaaatttgtgtaaaaatgactctataaaataataaaaattatctctttaaaattgcagatgactcgaaaggtagagacagaatatcatcatacccacactcaggttttctaaaatatggatgaatcatactggtgggaacctgattagtcagaaactaagaaatcagtactactacttaaaagctgtcaggccaggtgccgtggctcatgcccgtaatcccagcactttgggaggccactgctggaggatcgcttgagcccaagaggttgagaacagcctgggcaacatggggagaccctgtctgtacaaaagacaaaaattagctaggtgtagcggtgcacacctgtggtctgagctactaggaaggctgaggtgggaggatcactggaacaccagaggttgaggctgcagtgagctgtgattgtgctgctgcactttagcctgggcaataagtgagaccctgtctcaaaaaaaaaaaaaaaaaaatatatatatatatatatatgtgtgtgtgtgtgtgtgtgtgtgtatatgtatgtatatatatatataatatatatattttaaaaagctgtcaataccttctcagttttggaatggacagtgggtcatcttaaagcacaccatacttttttggagaagaagcacttacatgtctttttcttagtgatatgaatttaggatgatgattttgtagttgctattttttccttataaaagctgtctctttaatcttcttgtcaggaaatgttcagtcttctgaaaagaatagagaaaaattagcataatacctgaggagacttgaaggaaaacgggtatagaaataattgtcttttatggttgagttttattataatcactcttatggtttgagctggaccttccttaaaaggacaaaggacactagacactccccaaggaaactcatcatgatcacaggggtaggaatcagagtcaagaatgacaggggtagggagagctgggatggcaccacatgtgacgaagattacatgccactttggatctagcagccattgcaaggagagtagagctcacaatgtgatgagtcacaaccttaggagcccacatggaaaacactgttaggaataagatagtcggatttaggagtagatgagatttcctccctggaaagaccacatcaacctgcttcacaaatctagagcaacaaggaaataggagaaagttgcacagtgagtgctaagctgagtttcttttatgatttttacaagtagtagtatcattataaaatatacatacaggaaattatgcaaaataatttaagaaacatttgagtatctcataattttgacaaacattaatgttatgccaggctttcttcaaattctttctttttaaccttaagatatatttgaaatttcttcttatactcctccctggccccatttccttcattaattgttcttttttttttttttctttctggtgttaaactaatttctttgctttatttttttcctccagctttattgatgtataattggtatcttcaaattatatcttctgttaacgagaatttgatatttattattcttatatataacatattcactttattatatatatctaaaaataatgtattttatttatttttaaatggtgtaaaatgtataaaaatgtataaatgatatcaaattgacatactgatctgtaactttttttttcaagatttttctggtgtttttgtttgtttgttgtcattgttgtttttgagatggagtctggagtctcgctctgttactcaggctggagtgcagtggcaatattacagataactgcagtcttgaactcctgaacccaatcagtcctcctgctttagtctcctgaatagctgagactacaggggcatgccatccctcccagctatttttcttttttttctattttttatttttttctacagtaagaggaaggtctgagtatattccccaggctggtctggaacttctggcctcaggcaatcctctcacttcatccacccaaaatactgggattacagacatgagtcaccacacccagtttgcccttgttgataggtgaaactgtaaaattttctgttatatgactatacttatttagttctttgttgatggacatttaacatgtttctaaatttttccctttaggcgtatgagctgttataacatatgggtgaggaggatggactctgggaccagactatctgctttaaatctgtttcaccacttatcagctctatgaacatggcaaatttcttcctcttttgtatctcaatttcttcatctgtaaatgaggataaaattaggatctacttcagagggttattgtgaagctgaaaagagttactataggtaaaacactgtagaatgggtgctacataataatatcgtacatatcatacagtgatttaaaaaatcattctcatacatatgtcttatacaaaaaatgtgagaatttctctaggatacattcctaggagtgaaagtttgactcttagatcacgtacacctccaacttatgagatattgcaaaatttctttccagaggaaatgtgtatttccttcagcaatgaatgaggataattatttcttcactttctttccagtatgaaacatttttaaaaaatgtttaccagtttgatgaatatgaaatcacattttattgtggttttattttttatttctctaattactagagattgagcagcttttcatctgcttattaggtacttgagtttctccttttgcagtttgcctgttcctagcctttttgatggttgtttttgctttaattagattttctctttcttattgatttgtaggtaaccttcatattttccaaatattagtaatggttagactttccttttcacattttataaggtcacttttagtagtaaagttttaaattctaatgtagtcaaagttacccatcttttttattggagattacacattttatgtttgtttaataaattcatttgacctggagtcctaaatacaggccactacccttacttccagaagggataaaagttgatttttatattaagatatttactcacttggaatttatttttgtacataaaataacatagaaaaatgagatcattttgtttcatatgaattactgatttttctagcactatttataaaatagttcatcattttacttttgttaaaatgccaatgatcaaatacctgtattctgtttcattaatcacttgtctatccctgcaatgtagtatttaaaatggtatggttataatgataaccattttaaatactagagctttaaaataatttttttgtgtgatttggcaatgtcttggtttatcaggatgttataacaaaacatcataaactgagtggcttacaagcaacagaaatttatttctcattttggagaccgggaagttcaagatcacaggcaccagcagatttcatttctgatgagagctcatttcctcatttatagaatagtgctttcttggcagtatcctcacacagtgaaaggggtaaacaagctccctcacacttcttttctgaaggcactaatccaatcacctcccaaaggccccacttcttaacactatcacctttggggttagaatttccacaaatgaatttgggggaacacaacattttggccacagcaggttaatattcctatttttctattcttcttgattttttttcactttttttggccgttttgttctgcaatatatgttttaaatcaacccatcaagctcccagaaaagctctgccgagattttaattaggagtgcattaaatttgtagattaattcaggttcaatagaagcctttctaagccattcggattttattctgttggctaaaggtaaccagttcaggatgatcatgatcttatatgcattttagaatgatggctcttatagaaaacttgaagtagtggaagtctgatgcaacttgttttgtggatcatgttgactgccaccacaaaacaggcaaaacttcaaagaagtctaatttgttcttattcctctcagaagcctcttcctgaattcttccttacttgcctcttcctcactcctcaaacatccgtattatacatagttaatatttatgggtaaatatggataaatacaggtaaaaatgattactatttatggagcaaacactgtgttgaaatcaccttgcagggttaatgagaattctggaaagaaatataattaagcatttatcaggcttcactttgacccacttcctgtaaccaaaagtcatgtagcactagatactgacatttgcattccctttgtttctatagatgggatttctgactttagaatcataaggtttttctttaatataggtaggacttctgacattagaatcatatgtcttttgtttaagaattgtttaagatgcttttcagattccaaattccagtgaaatagctggtgccaactggtttaaagacccccaccaagaaacagaatcagcatactacagtttcttcatctccctgtcccatcacttcaccctgcactcttggatcaatcaacaatctctatacatttgccctctaaaaccctgaaaaccccccagccccaaactcctcaggaagatggatttaaggtttcctcctgtctcctcatttggtggccctatgattaaacctgtttctctgttgtattgcgtatttacttgccttgtgcatcgggcaacagacctgttacagttacagtgttaaaatctttacatgaattatttcacctacttccacccataaagtagacagaactagatttagaggtgaatcagccaggtatgtgtagattatcaatcttaagaagggcactcacaatgattggaaaaaaatgggattatggtttcagttaactcaaatgtccatactctttctccacatgttagaggaaaggggtcctgatccagaccccaagagaggggtcttggaactcacacaagaaagaattcagggtgagtccatagagtaaagtgaaaataagtttattaagaaagtaaagcaatgaaagaatggcttcttcatggacagagcagccccaagggttgctggttgctcatttttatggttatttcctgatgatatgctaaacatatcatcccctttctagaccatatagggtaactccccgttagttgtagggtatgcctctcctttctagaccacatagggtagcttcctgacattgctatggcatttgtaaactgtcatggcgctgatgacagtgtagcagtgaggacgaccagaggtcactcttgtggccatcttagttttggtggtataatgctggcttctttactgcaacctgtttatcagtaaggtctttatgacctatgtcttgtgctggcttcctatctcatcctgtaagttagaatgccttaaccatctgggaatgcagcccagtaggtctcagctttattttacccagctcctatttaagatggagttgctctggttcacatgcctctgagattttccccatccctttcttttatttatttatttatttatttttgagatggagtttagctcttgttgcccaggctggagtataatagcaagttctcagcccactgcaacctccacctcccaggttcaaggttcaaggcctcagcctcccaagtagctgggattacaagcacctgccaccgcacccagataatttttgtatttttagtagagatggagtttcatcatgttggtcaggctggttttgaactcctgacctcaggtgatcctaccccctcagcctcccaaactccttggattacaggcatgagccaccatgcccccatcccccactccccctaccctcgccacttttataagacaactgttaatcctaagggttgcagagggacaaagctccatcttctgtaactacttcaggctgaataggggcaatcatattcctgcctaactattagggtctcttattttcagggtagaggggagctcagtcagaaagcattggtatggtgagggccattcataactcccagttcagacaaaagataatatctggaagattaataagtgttcaatttaagaaaacattcagtaagcttgtcctgcattcctacacaaagagtacaacagcagtatattccacaagagtaaacaaaatgagtaaaattattccaagtaaactagattagaaggctttccatgaactgagcaactgttggaactaagctgatatgaggttgctagctgattccaatatgcccaagattagaatattgatccagatttttacatcacttatccctcttgtttcttctgaatagcatccagaaatcactggttggttcacaggaataagcagggttaacctaaattgcaaaaacaaacttaaaaacaactcatgagactagaatttaataacaagtgtgtcatagtttttgaaacataattcctctctccagtttcccatttttactaaagacaaatcatgataggacagatttattttattatacttggcctaattatttgtaaaagtgcaggaagaataattatttcttacataagcttttttgaaattggctttgatggaactctgttccttagaaggaatcttagatgagacttttttttagcgctgagccctgccatggggttgtaccctcaaataactatgagttgggaaaattcctctcctcttggggtaccaagataacccagggctcctagacctgttagaaagtgacattctttacttatcacaggtcagaaaccctgtacagggattgtgtaggcaaggtatgaggccagttctccaaagggcttttattggttttacaagtgaagtctgattccttaaaggaaaccacaccattccagtcaaagccttggtaaaatatccagtttttttcaattgtgtcctgttatcacagcaaacagatgcttactgcacttatgcaaataactatattgtcataaattaagaacactcacaaatagtttccaaattttggagaaatcaggtagagagaaacaaatatgcttcaaattttattcacagaagtatacattactcagttgttaaaagctgtaaatagcttaaaatagaagtttccatgactctgaaaaacaaaacaaaggatcagaaatggatttgttttgtttgtttttgagaccgagtcttgctctgtcacccagactggagtgcagtggcatgatctcggctcactgcaagctctgcctcctgggttcatgccattcccctgcctcagcttcccgagtagctgggactacaggtgcctgccaccatgcctggctaatttttttttgtatttttagtagagacagggtttcaccgtgttagccaggatggtctcgatctcctgacctcatgatccgcccgtcttggcctcctaaactgctaggattacaggcgtgagccaccgcacccggccaggatcagaaatgtttaaagcaaaatcacaaagattacttcagacttatttagtttatgccatgcagttaactactgttctgtttgatattcatgaatattttagctctccctgagaatccttaattttttttcatttattcggatgtcataatctccaaagttaccagaaacctgcatttaagaacacctgatagaactctatagttgactaaaaactgccttctaaagaggaccaaaacaagacaacaattgtctgtggctgacaaaatgttttagggcagcaacagtcaaagacacaattgacaagaaaatttggttatctctgtatcatacaatgattttatgtaacaatttttaatacatacactaagtcatatcaaaattataggagtttcccataattttgaaacatataccaataatgcatttatacaaatacagctcaaaaaaagccaaacaccatttcatatttgacaatgattcctgtataacttttataccaagtaagccaaatgccactgttgcattagtgcattattgatgtcaaaccaaatttttaataaaaccttagagacaaatgtatttaatcttaattagtttgaccataaggtaagattttgataaactttttataaccctttcctttacaaatttttgttaaagagtgcattataagcaagtttttactctaagaaaaaccggttgtgcttttatttcaatgtataatttacagaaaaactgtataatacccctttaactttagtcaatatgtttacacacagaatctcttttacaattaatttttcacaaaccttccaccatttgcttaagccttcagctttatactaaattaaaataatcctttaaccctttaatgtaggcaagaaaaattcacattcccatgccttcttataatcttttgccaaaagtacattctactttccttacacaacttgcatgtagaactgtttcttcagtagtctcaaatacatggtatactgttaacccttggtgacttaactattggtgaaaaccttggtaagttcaggattctaattatgcagtaggtgtggggcctagcctaggacacaccaggcagaagtgcaggtaagggctgactccagcatagctagggagtgtggctaactccacatgtccccaggccttatctagaatctaatgtctctaaagaaggtaaattgaacaattttcaaaagtcaaagaagcagtttatgaacttaaagcattaggaaacttactatctgacctgcataatttagaacaaatgtttacattttaccaataatctttaaagctgtttttatttcctaaagattactaaagtcacatgaactaaataaaaggcattatactttttacttttctggcaaaatattttatttaagctcttattatttttaaaccaattaaagctcttttatataacacacacagcacgtataaatacacagacagacagaagaaaaaggactcatcctctaagcgggaaattgaaccctgaacctgggatgcctttgtgatggcagagaccaagagaaagtactgccacttgattacaaggtcaagctcccaaggacatacaaaaaagagggaaacctcatccagtatttttcagtgacttgcagcagagtttgtaactgtcgggtttgctgggctgtcttgaaaagtgggcttacaggtgtcctaagcctgtgttctatcctaagatttccttctccattatagaacacacacagaaagacacacaaggcacatcaaaattgctacagcttaggactagcctcataagttcttttttccaattaattaaaactttgtaggagataaaccgttaattttactgttcaaccagtttgcacagagaaaaagagagagagagtaggggggtgggcgaaagcgttgcctgaggcagggtggggaaggtgaggcactcagggagtccaaaaggctaagtgctcagggagtccaaagtggggagtccaaaaggtgaggcgctccaggagtccaaagacccacccattgcaacaacactgaaaacttcaggtggctgctgttgtgaagggatttttttcagcagtcccatcactcacaagtttctccttttgggggagcagaatatcccatgatcctgtacatgcctaatcctgtcacctatagccatcagcaaagattgcaaggcagattgatccaaagagaatagcagttaacgtcccagagtgccaaacccattcttagcacagagggactttactgagaggggcctctaaccctcctaagttgggtctctaacccaaggttggtcaagtttccttgtcttttttaagaggggcctttaacccactctgtcttaagagagactctaactcccctacgttgggcctctaacacaagcccatcctttaccctagtatatgcacctcgcttacccaaagtcagccaattggtgcgtgcaaatgattttcctttgggccaggggtctcttcagtatcgtcccttctgtgattcaccagaaagatgttaccataccccaccatttacccaaagttagactttgagtcaggagtttccacactgtggttgcttctgtggtcgccagagagatgttatagtactccaccacttactggggatttccacactgtagtcccttctgtggtcaccagaaagatgttacaggaaaggggtcctgatcctctcttggaactgatcctgagttccaagaaccctcacttggaactcacacaagaaagaattaggggcaagtccatagagtgaaagcaagtttattaagaaagtaaaggaataaaagaatggctcctccatagacagagcagccccaagggctgctgtttgctcatttttatggttatttcctgatgatatgctaaacaaggggtggattattcatgcttcccctttctagaccatatggggtaactttctgacattgctatggcatttgtaaactgtcatggtgctagtgagagtgtagcagtgaggacgaccagaggtcactcttgtggccatcttagttttggtggtgtaatgccggcttctttactgcaacctgcttatcagcaaggtctttatgacctatgtcttttgctggcctcctatctcatcctgtaagttagaatgccttaaccatctgggaatgcagcccaataggtctcagcctcattttacccagctcctattcaagatggagttgctctggttcacacgcctctgacacacacatcctcatgtagctagcaaaatgtaacgccgacctgctccttctaaattgtagacaagttgcttaattggaaataataacaaaaacacatctcacaatgctgaactttattaattgaatatttaagtgatacaaaaattacatattacagctctactttctgccactaattctgaaaacagccagctgacagtgacagaaacttagcaattgcaggcagctgacattctgaaaacaaacaatgcattttgtagtctttttccttagggataaaaaaatttaactcctgtcatccaaaagactaccagatggctaaatagtagaaaggggggttttattggtgatatcaatttgcaaactagggagagacagtctctgatgtgaactgaaggtgctctctcttcgaaaagggaaagggcaggttggcttttatgcctcacagggtctgtacatatatacatttatatatacatatatattttgtatatattacaaaatagtcatatatattaatcaggtttagtggaaaagctatacatgatatgaggagagttgagcacatgcacaaatggataaatgtataggtaacatacatcctgtgtttactttggggtgggattttagcattaaaatgaggtagaatttgattatttacatcagaaggtgaactataggacacaaagacagtttgtgcgcaattttataagctggtcaaaactgtcttgaggtctgcagttgcttatcaggagagaatgtttgtaaggtcctctgcccagtcagagttgtagtggcctgggttctaaattagttaggaagggtctgacaattggctgatagctcctgttgttaaggtgtttagcaagagtgtggtctttcttgtggccatagaaatttagcaagttgccacgccagcggagccctgaaccctatttccttaactttagggtctgtcttagttggcaaagagatgtctactttggtctctcagatcacattctatattaatgttctagtctagaagtgaacaaaattgaaagacaatttcaataagctagtaatgtgttattttaatgcatgcagtaaatccaaatttttgaatttgaacttgaagtggcccacaatgcttaccctatcccaattcaacaattcagtaaaggctaaataaatatttgaagattatctgtttaaatatgcatcaaattattagcctttcttcagtatcctcgtgttcatccgaactccatagattgttactaagattatattttatgcattaattattttagttcttacagtacctctttcagataacaaaataattgatacttaagtgaagccaagtcatttgctaacatcacacagttaggaggttccaatacccgtgtattaactcaggtattaactaggtgacttttgtcacctaggttgcctctaccactaccctctgggcctcttttgatgttcaaaatgactggttccacctaatactggtttctcctctaatccaattttctactttcctgagaaagtgttcatttctttggtgatacttagaccacaaccattgcctaccagtgtgtccactggtaatcccctgaagggaaaaatttcatctataggaaagaatggaatatctgatagagtcatagataagggacagaaagttctggcattgcttcaggcacaaaatctacttgcctttgagataaattttaccatctctttgatttggttccctgagccagtaacactcttcccattcttcctttttaaaagctggtttagattattgtcacttgggaatgaaagactctagagaaattctagagagtatagaggaatatggattctgaattccgtaattctgtcatcagacagacctgggctcagaatctagttccccagcttcctgtctatatgacattggcaaagtaacccttctttttatcatagttttattattttttaaatagagtaattcttggggaattatgaggattaaatgagataatgcagacaaaatgtttgacatacagcaagagttcactaaactttagatgttattaactaataaaggcactcaaagtaaattagcaaactctaaaaccgtgagtagaaaatttgaattatgaatgctagggatatctttgtacctatagttacataggtaaatccagccacttagctatacttactaaggtataatccctcctacaattttgtctgctcattcttcattttttaaccttctaaataagatgacaaattattattttagcaggtgaagaattacatttatatgatagcaaagaaatgacttaggataaagctaatagcatttaggagaaagctgttgagtttgcataatattatttcaaatgatgtcataaatgttaagaggaaggcattgtatgatcttaaagatactgttgtttttagactcagaaatagaaaaaaaaagaaggtaaaacataaaatagtaagtagatacatgtgacaatttgtagacttcttgagttgtcacaacaataatggcatcattttctattttatttaaatactaactgtaaaaattaaattgcattttctcagaaaaaaattttgttttcaattctgttcaatcctaggtgatagttcctccctatacttgaggatagggtctttaaaatgccctctggtgagctgggtgcagtggctcatgcctgtattctcagcactttgggaggccgaggcagatggatcacctgaggtcggagtttgagaccggactggctgacatggtgaaactgcctctactaaaaaacaaaacaaaacaaaaattagctgggtgtggtggctcacgcctgtaacccgacgtacttgggaggctgaggcaggagaatagcttgaaccctggaggcagaggttgcagtaagctgagataacaccactgcactccagcctgggagacagagtgagactccgtctcaaaaaataaaaataaaaaataaataaataccttctggttagaagaattttggttaaggatcttcatactcttttgaaaaatgtgctagagacaaaaatctggagtgacctgtatgtacatattctgtgtatttttacctccattaaaataaaacaatatagttggcacataaaatacagacaatagcaacaatattttacatatcttatatagcaaaaatagtaatctgaatatttatttactactatcccttactttcttaaaaataatttttagattctcagtactctttaatttgaatgagatgtttgtaatagtgtttgactttgctacagatatgcatactaaaatgtattttgtgaaaacaataaaagtacattttgtttcattttcctccatccaaatgtttcatggttttctagtgttgccttagaaaatgctgaattctgcctccatatccaaataggttttgattaatttcttccttttatactagctgagtcttgctttccttagtctcatcttatttgttttggttcctctaaaaggcatcttacctccatccttgtttgttgggaataggccccccaaaactggccataaacaaaatctctgcagcactgtgacatgttcatgatggccatgatgcccacactggaaggttgtgcgtttaccggaatgagggcaaggaacacctggcccacccagggcggaaaacagcttaaaggtgttcttaaaccacaaacaatagcatgagtgatctatgccttaaggacatgctcctgctgcagataactagccaaacccatcactttatttcggcccatccctttatttcccgtaagaaatgcttttagttaacctataatctatagaaacagtgcttatcactggcttgctgtcagtaaatacgtgggtaaatctctgttcgaggctctcagctctgaaggctgtgagacccctaatttcccactccacacctctatatttctgtgtgtgtatctttaattcctctagtactgctgggttagggtctccctgactgtcaggcctctgagcccaagctaagccatcatatcccctgtgacctgcacatatacatccagatggcctgaagcaactgaagatacacaaaagaagtgaaaatagccttaactgatgacattccaccattgtgatttgtttctgccccaccctaactgatcaatgtactttgtaatctcccccacccttaagaaggttctttgtaatctccccaactcttaagaaggttctttgtaattctccccacccttgagcatgtactttgtgagatccaccccctgcccacaaaacattgttcctaactccactgcctatcccaaaacctataagaactaatgataatcccaccaccctttgctgactcctttttcggactcagcccacctgcacccaggtgaaataaatagccttgttgctcacacaaaacctgtctggtggtctcttcacatggacacgtgagacaccgaccgagctggttttggtccttatagatactacaataatataattttgaggccaaggtttgctttgtttcacttttattaatctgtatcaagcctttgtggcaaaatcagtacttattatgcattattttactactttttcttttcccaggccataactatcttttcctaataactctccaaaaagagtaaaccatattttatatctggttgtgaaattcttaaggtatctctaaaggtatacacaagaaaaattttttatgaggagaatttataaataggaaaaattttcttcctttccccagggaaggcctcctataattgttaaaatttcatcaattcaatgttaaatggagtgttcagaaaataaatcaatgagttataatcacttgtagtaggataataatgtgttaactaatatattttaccagttaccctacctttctctcaacagctaagtattctgctttcattgcttcagaaaaggatagaaaaagtcaatttgactgaaagtacatatcaaccacttggggggaaaagaaactttgaaataataaaattttaaaaacattactttttcacctttgagtctctggacaagatatgtgtttctataacatagcctataaatatctattgaggatcagccatgtacagaacactatgctaagcagagaataagagatggattaagacatcatcatcatattaatgatgtttactgaatgcccactaagcttcagccattgccatgcatttttacatgtgatatttcatttaatatttactgcctgctccattaagacgtagaaaagattaaataaaaaatgtgtacgcctagtgcaatgaacttgcaatgatttatatatggcttgagaaaatcaaaaagttttcacagaggggtttgaaagcaaaatcttggcggagtggagagtggtgactttgatgatagggtgttggatgaagaaaaaggtataagtaggaagaggacagaaagccaacactgaaaaaagcaaggaactagaaaatgaaacagtgatgcacagctagagagaaggtgaggaatagagagaagtaaacccggaaacactggctacacttgatgatggagggtctcatattccagtttatgacttgcaggcatctagtgcatattctgcgtggctcgctgtgcaaggactggggtggctttcttttccttacatctaatatagagacagtggaaactaatatagcaattcttccatccagaaaagttctcttgtgctccacagagcatgcttatagggttcttctgtgttctgagtgcttagtgggtacgagctatgaacaggagcaaactttttgaaaagagaaaaaaagcctttgtttctttaataaatgagtttacaattagaagattatgtaaactgtgtttttttttcttttttccatactttgttttttttgcaagggctattttattttttatgtatttttatattttgtagatacaaggtctcactaggttgcccaggctggtctcaaactcctggcctccagcgatcctcctgccttagcctcacaaactgctgggattacaggcagtagccacagtgcctggcctcaataatttttttgaactttgtatatttcacacattattgattaaattgtttaactttttcaattttgttgcttgtgttccagagatatttaattccctttaaatgcctatatgatgctaaaatggataaaagtgttatactgaatgccagaatgtaaaaatttaggagtttctcccatcattttttttcaggttatttaaatttaatttacttttttttcctgacttcttttaattaagaagaggaggaaaggagggaattttccatgagtttgaatcctacaaatgccacaaacagcttctgaagctgaagccatgacaatgaacttccatgacacaaagaagatgaggaattggaagggaacagtgcaggagaaacacagtgacattgtgtcacagtaggtatttatgcctgctatcctcatccgagataaggtcaataacttctgctggtgaagcccaagtctgctgggggctcacagcagttccatgactgtgtctgcctggtgctaagatactgtgtgcccgagccatgcttccacgaagaagcactccaaatcacaccacctcgaggatgaacacaccttgcatgttcctgaactcccacaatctctacttcactatctgaagaggcaatattaatttcttcattgagcggtgcattgccggcagatattttgtcacttgctaggaatcctggatgcaaatgacctgcctctgcattcagctcctctagaagccagctggtcctccaggtagctcctgtgtcctggccgcctatagaattattgtgctcttgaactactgcagccgccgataaattgtacacagttaccacttccgggtcagagctggtgtcagacatatcataatgagctacaactggaggtccatctggtatctctgcagtgattgtcttgctgctccctgaaacctcttcatcatcatctgatgagctcgtgcttgtcacaagtcaggtcactgtcactggtactacttactgtcctgcagcaggttgtactgcttgcagcaacctcccgttcgtgcctcagtagcctgatcctctccttgtgcttttggctccaatgacctttaacccattctgtttatcactggattgccagtttttcttggcagccatagtggatgtttcacttttagatcgggacctcctagacttgcgcccaactgtggcaccagacactcctgaagggtctccttctaccgctgtttctgcctgagagggttcattctcttctgcggaagacaacgtgtctgaatcagccaggtgatcactagaagaagggcaaagcatgcagtgattagaggagtcactctcataaacttggccagttgtaggcttgtcactctctgtggatgctgagactcagaagagtctcttctcagctccatcaacaagcagggcattgaagaaagaactgcagaatctgctacaccgtctttctgaacttgagattccagttctacagattcatcttcctccttcgctgtctcttgttcagatgtttttggtgggacttcagactcaatgagttattcgagttttcccactgcctcctctatctttgtttcagaatttcaagttaaatcatggagcagcctctaggaaatggtatcaaagatgcaacaggaaagcaaacaaaaaaacttgtaggccaagcctgggagatcagaactcagaggattgggtgccacttccttattcttacttggatctagaattcaaatttacattgtccacgtggtcaagaaaccctgcgctctgcagtgactccgtgcctcctggctcgctcagcgcaccccatcagggcacacaccatcccccaaacttaatttgaattttaaattagtattctccttatttcagtttttggcttctgtaagagaatacatcataatttattgcttcagtctgcaatttgccatatctcctaatgacattcagtagtgaattgttaaaaagaatctgtgtatctacatattgattatgattatctatctatctatttatcacaattctggaggctgtaagtctgagatcaaggcggcatcagggttggtttcttctgaagtctctctccttagtttatagatggccattttcattctgtgtcttcacgttgtctttttgctgtgtgtgtctgtgtcctaatcacttcttataaatacaccagccatattggattagggcctacatgaatcacctccattttaccttagaaacatctttaaagactatctccaaatatagtcacatactgaggcactgtgggttagatttcaacacatgaattctgagggaagacataatccagctcctaacaccaccaaagtgtatagttttatccattatggagtctcatgtattatgctttgtgaactctcttttttttttcattttaataaagtttccatttctaggatgctttgtgagttcttgagtaggcaccatgccttgcattattttgagtctcccatttttggggggtagataccggtttggaagatatgggtcttccatcaaaggagacatttgcattgaaaaaatcagataaatgacagactaattaataatttctaattgattattaattaaagttaaggaaatgtgtttgaaagatagatcccaatatatgagtacattacaagaaaattcaataagaagccgactgagtgtgaacaacatagagatatggtcatccttggagaagagttttttattagcatgaacattgtatgtgtttatatctaggaaaaaaagaaaatggacttattcttattaatactaagatatttctcagactaaataagacaatataatggttgagccaaattaattgtgttagaacctcaatcgatattccttgatcatgtaggatgttggagatatgtgcatgactctaaaatgctatcaggtagactgcctactggaaaaattcccagtgggcaacaatactgggggaaaagtaggttagagtaatgtagttgatagtaatttgatggcaagttgtctaccgtagcctaaaaagagtttgaaaaggaaatataataataataaataataataacaaaatatttagatcagatatttagattctagagtgaagaggttttaccagtaggcagatttctgcatatgtaattttactgaagaagtggctttcaaacctttgacaatttctattgggaccaggtaacgcatgtacacacacagacacacacaaggacactatttacctttctcatgtatgatgcactctaacattctccattttattcagttttgtctcactgcagtctatttcattactgtttctgatacattctatgtatttcataccacaccgaggctgcacccaggagcttgagaatcactgcatttgaaagccttttctaacaaagggtatgaagacttggaaaggtgtataagtgtccagcatatggtgtgccatatctgcctccctggagatgcccaatgtatatgagacagtcagtggaggctaagaatctgacttccagagaggcatcattacactgagatccacaaagcagtgcgaagggtcaaaaatgaaagggaactagaaccaagatagaaaggttatcagggaaatgaagcattgtacagaagagctggtgttagacagcatgaagaggaggataacaagtataaggagtaacactatcatattgttgtgtttaggagagtcaaccctgatgttagacatgttgtactcaaatctcacctttgatacttacacatttgtcactttgtataagcatctaatcattctatgccccatttaacaatctataaaatagtatctatgatttattgagcacttaacaaatgcaaggcactacagaaagtgctttccttttgttaactcatttaatattgacaccaccttaatgaggtaggcacagattttattcctagcatacttgtattttagagttgttttgaagaggataaaataacatgaaacagttcccagcactacacattcatgaaatcaaaacagtgagatgtaacgattttctgatgtcctgaacaaaaaatcaaaggaaacccatgaaattactaagtgtcacgcaacttaatatctatgtcatgagataactgcattagtttgcttatctagaaaggggcatgaaatatgataagtaaagagaaagtgagttgatggatataaaacacttattgttgggagacaattcagggcctttctgcatgtcttgtattaacttttgttctggactatctttttaatgatgtttgtataggaaacagccttggaagacagagataatgtctcccatcagggcagaggtcaggaatattgtctttattaagatgatatcgccctctaggacaaaggttaggcaagtttgctagcaaccctctttaaaacattggagttttctaaacttggtgttccttagttgtgatacaaaccgactctatgagcagcacttatgtgagtataatgtccctggagatcccggtaggtaaagaatagatgcagacttggggctcatgcttcctgctctgctataaataataaagtccttcatctgtgaccctgaagtctattcttttctgccagcatctataaaacaatggtaggctaactggttaaaaaataatactctcagacttttcataattcttgatacttagataatgcctggctatataaaaagtacacaataaatggaaacctgttggcattatgatatctatcaatttgacaatgcgtcagataataaatttaataaagcaactatacagtgcatgtctgctacatgctagtcatgatgtgaggtgctaaggctaaaaagctgaataagacagattctctgatttcatactctggagggggagatattggcacataaataattataacttgtcttaatattatggtagaaatattataaggacctagagcattaaggaggcgacatctatctctgcctaaaatgtgagatggagaggaggtatgagggaagttgcttaaggggaagtaatacttcaactaagttttaacagctgacagttagtgtgaatttgttagtcacatgtcaactataatttgttgttttaaaattattggtgtcagttaccatttatggtaggttgagttgtgtccccagaaacatgttgaagtcccaattcctggtacctatgaagatgaccctatttggaaataaggtctttgcagatgtacctaaaatgtaatttaagataagcttatgctgaaacagggtgggcccttaatccaatatgactgatggttttataagaagaggagagacaattatgaagatatatgcatggatatgttcattgcaatactattcacaatagcaaagacatggaatcaacccaaatacccatcaatgatagactggataaagaaaatgtggcacatatacaccatggaatactatgcagccataaaaaggaacaaaatcatgtcctttgcctggacacgaatggagctggaagccatcatcctcagcaaactaacgcaggagaagaaaaccaaacactgcacattatcacttataaatgggagctgaacaatgtgaacacatggacacagggatgggaataacacacactggggcctgttggggtggcagtaggggagggagagcatcaggaaaaacagctaatatatgctgggcttaatacctaggtgataggttgataggtgcagcaaaccaccatggcacacgtttacctatgtaacaaacctgtatatcctgtatacgtatcccagaacttaaaaaaataaaaaagaagaagaaatgcatggaaacacaaagacacacagaaggaagatggcactgtgatcacagaggcaacaattatacaaatgcaaatcaaagaatccccaggattgctggcaaagtccagaagcaggcagagagatggcatgcctctgccaacaccttgattttggacttttaacctccagaactgagagataaaatttcttttgttttatgtcacccagtttgttacagaagccctaggaaaaacataccatttcattattgttttccatatacttatcttcagacaaaaataaggaaagggcactgtggtcaaaaacaaaagaaatatgagagagaataataaattaaaaaaacataaattgctaaaagtcactgtatggggaggaaaacggcagctgatgaggctggaaagtaatagatggaccctagtgtagtgtaatgagtgtggcttttggatgtaacagacctgtgttcaaatgccagcttctctatttactagatgtacgatctcagaaaatttaaccaccctctctaaatttggtattattgtccgtagaataagataacaattactactttgaggggctatttggagaatttgggaaatgtggataaagctcatagcaagtatttgatacatgctagtcagtagtagcacttttagatttacattagggagattcttctgacagctgtgttgatgatggaaatggagtgggccactgccgaagtgtgggtggctggagcatggctggaagaatagataccaatgaggcagtttttgcatcagccaagatgagagatgttagaggcctgagctatatcaatgccatagtggggatacaaatgagaaaatgagtgagaaaagtgtttctttgttaaaattaatttgtcattattgaccaactcaatggaagtcgtgatgagacagcagtagtctttaaaccagccactcctacccattccttctaatttatgaaaaagagaactgatttcaggtgttttgttttgttttaattcttccagttaaggacttctattctctcactcagagaagcaggttgatgtatggaaactatctcttaagaagggcctatgctaaaatgtggctggagaaattgatcagagtgaagaaaagacttggtcattgcacatgaagaatggcagaaaaattgaaagtcctttttcacagctaaaaagaaatcaaaattaggtatcatcaattcaatattaattcaactcactatgaaaaaaacagtaagttggattactcaaatgtggtgacattgggatttgactacataaagaattgaattagaatcaccttcaaattttactcataccatagagttcttgatttcagtttaatagaactatacaaaaacattatattctgcttttagaaaaccacacaatacaaggaactcccacccaagccctaaacctaaacaaacagaaacacaggaaaactgtgcttgaagtggtaagttatttctgcaacaaagaaaagtagcagaaaatgtattcccttgcaaaaatattaaatagattttaacaatttatagattcagacacgcataataagaaatagaatttgaaatccctgtataaattttatgagtcagaacatttccctttagaagcttatatttatcacataaaagtaccttcacacacacaaccacctactcacctgcccaaacacacatgcatacacactcatactcattcatatattaaatatagaaaacaaagatttgagacagaataaataggtttatatgtgtgactgtttgataagaaaattaaacactagatgcttgaaacgcctgtaagaaaagaaaactctgaaatgacaagtagcaaaattaatttgtaacaactaaacaatgaatgtgaagtttaccagttggaaaggacagatttctaagaacacagagaagaaagtcctctcctaaaggacttttcttattccaaggcttattggaaaaactctcaggtgaaataaacatcattacaatatgatagatgacactggttatcttttggaatcagagatgttaatgaccattctgttgattttcatgttcatgatacagtccttatgaatacatgtagcataatttctaggtacatgtgttttcaaccccaaccattccagtttaggaaatagtcttcaaatgtagctgaacaaaaactgtatatgcaacaattgttttcctggtgccacctgtggatttctcttcacatctaggattctttttattggatagtgttcgtggcaaccaaactttgccctttaaagatgaatttgactttttaaacaactgtgtcaataagattcatgtctgttgaataaggttaatggttaagtaccaaaattaaacaagattttattatagagcaaaaacgcgaaaaccaaaaatcccaaactcatttatttctcatattcatgtggctgattctgaagatttatcactcaggaggcagcattaaggtaatacattttgcacatccaaatatagattacattcaaagcatatgaacaaagaaaaataatgttttggaaattgtgataaattttccttagaaaaagatgtttaaaaaattgatatttgggaaacctaccgtaatttgtatatgatagcattcatctttttcttttagaaaaagggaaaatgtgtttttagcttctgtacctgattatcacatttgtatgtactaggaatgctaaatataaattacaagggtcaatggttactgtccatttgtcactgagggtcagttggctttgatcccctccagtcgatctctccagggagcctgagccttcaccctcagttattgttgtggccctgtgaggaccatgccccactccattcttcatggcttctttccaacataatgagtctaaaatcattatagtaatagagattaattggaatagattccttgaatatttgcacttgtgctctcttgtaagggaagggtcttcatcacacagcaagggctggattttctaaggtagcagggctttgttccctagtcatgattgctaacagtattaccaagaatgattccacctattttggttggctgattttaaatataggaaacagttgacaagagagttatgcagtctggagaacagaggcaaaacctacagttctaactttagttttgtcttaaatttgacatttctgactactttccaggatcaagctgagtgatggcagaacacaggcaaaacaactctgtgtgtttcactatgctgagcctgggtgtggagataacaccaagatgcaagagggccagacagtggctcatgtctataatcccagctttttagaaggctaagatgggagcatcacttgaggccaggagtttgaggctagccagggctacgtagtcagaccctgtctccacaaaaaaaaaaaataaaaaaattagctgggcatagtagcacatgcctgtagtcccagctactggggaggctggagaggcaggatcatttgagctcaggaggttgaggctgcagtgatctatgattgcaccactgtacttcagcctgggcaacagagtgagatcctgtctcaaaaaaaaaaaaaaaaagatgaaagacatttcatatggaccaagaaaaatgagtgatgtttaaattttctaacttttgattgattgagaatttatgtatttctgtaaaaccaacatatgtattaagctggagaacagaaataatttactcaattgcttttttattgcatcataaatctattcgatgaaaacttacaatgtactgttttgttttcagttctttggagaaaaggcatatagattttattaacacatacacaggggaaccacagagtgtttatccccttactgttttttaatacattatactgtattattttatcaagaattaccaatgaacatacaaaaatggctgtttggagaattgaaaggaattcttttgtgagaatataacttaaattctagaccctcaagcaaaacttgaattaagtttcttatttctagtatttgatttgttgttataactattgttgataagtgtaacaataacctgcctatatacaatcatagtgattaacaatttaactataaaggccgggcgcatggctcacgcgtgtaatcccagcactttgggaggctgaggcgggtggatcacgaggtcaggagatcaagaccatcctggctaacatggtgaaaccccatctctactaaaaatacaaaaaaattagccgggtgtggtgtaacaaaaaaattagccgggcaactgtaatcccagctactcaggaggctgaggcaggagaatggtgtgaacctggaaggcggagcttgcagtgagccgagatcacaccactgcgctccagcctgggcgacagaatgagactgcgtctcaaaaaaaaaaaaaaaaaaaagaaaaaaaacagaaaccaaaaaaacaatttaactataagtgcacagtggtattattataaaggttaagagcttggattttagaatcaagtagactcatgttcacatatgttctttatactcaccgtatgacaaaacacaattatgtgaccttcataagccttcgttttctcacctatatctgcaacattaaaacctactgaaatggctccattgtctggggaaacacccagggtcctttgtctcgcaccaagaaaattagtgacactgacacacacatggagtggattaaggagcagaaagtttaatatgcaagaaggaagagaacagctccctggcacagagggaggagggctccaaacagaataacacaccttgcgcaggaggacaggtagggggttgggggggcagtaaggggcaggggggagcagttggttatattgagaggcttgaggaggtggtgtctgattgcatagagcccaaacagggcaaacgggattgatttgaccaggtgtgtcattcacatagcaaaaagactggccctccaagcctaaccttttattatacaaatgaggcttctacctggctgtgccatgacacctgcacatgtggggacaaagaaaagggagcaggaggctgggcgcagtagctcatgcctgtaatcccagcactttggtaggccgaggtgggcggatcacctgaggtcaggagttcgagaccagcctggccaacatggcaaaatcccatctcaactaaaaatacaaaaattagccgggcgtggtggtgtgcacctacaattccagctactcaggaggctgaggcaggagaatcgcttgaacccaggaggtggaggttgcagtaagccaagattgcaccactgcattccagcctgggcgacaagagcgaaactctgaaagaaaaaaaaaaaagaagaagaaagaaaggaggagagggaaggggaggggaggggggaggggaggggaggggaggggagggaagggaagggaagggaagggagcaggaatcaccacattgggtggacctgactcttgacagcctgcatttacgtatgcaagcctgtggcttgcaaatcaatgcttgcaagtctgttttttttccagccgctttctgttagaaatgtttttattaaaagaaaaagccttactgaggactctttgactcttttaccctttctagctgcctgaaataatattttttttttttttttttgaggcagggtcttgctctgtcacctaagctgcagtgcagtggatctcggctcactgcaacctccacctcctgggttcaagcaattctcctgcctcagcctcctgagtagctgggattacaggtgcatgccaccatccccagctaatttttgcatttttttagtagagacggggtttcgccacgttggccaggctggggtcgaactcctgacctcaggtgatctgaccatcttggtctcccaaagtactgggattacaggcgtgagccactgcgcctggtcaaataatttcttaataactcccgtaatactacttcatagcttgcttttacaattagatgagatgttagtaccgtacttggcacagcatctggaacatagttcttcataaataaaaatgattattgtttctatgttattctgtagccaactagttacagcagattttttatgccattgtacattttctttcagttttctatttttccttttcatgtatcctactttagagttagcatcttatttttctgaaataaaaaatgtgtatttctttttactttgtttatgtattaactgtgtattagcaataccaatcaactttgactgcctgaaatttgttaaaatgatattgtattgctaacaaaatgagtgactattaaaaaaggaagagtgatatgggaatcacagaaacacagtcacagttaaaatcatgtatggcagaaatgggcaagaaggactttgatgataacacttttgaagacttgtacagcttttacttctgatgttgctggcacagaatagtaacatcatatttgctattgttgccacaaacacctataggaattacgtgttggtcacattccacttgaatgaaatctcttcaaattatgtttgagtctctagcttctgtgtaatatgcatcttattggctgagacgttagaggccggaaaagcaactgtgtattatttcaggtccgatagtttggggtaggctctgctctctagcaagactcatatgatagggcattttcaaactgcagcaaaaataattcaaatgctgggtagccaaaaattgactagtgcccactacaaacaataagttttaaaatgagctatacaaagttttaaattatgcttaaaataagttttaaagaaattgatgactgccatggatggaggaatatttcaatttaaataatccatctctacaatttacttttttaggagaaatccgaatcagaatatttgtaccaaattagttacaaggaaatattgattattaattatgcctgataacattatgaatactgtagctattaaattaaaatcttattcaaatagaaattataccgattgtgtatagtcctgttctgacaattgaagcagaggaaaacttcctaactcagcctatgaggccagcataccctaatgcgtaaaaccagacacacattacaagaaaagaaaaaaacagataaatatctcacatgaacatagatgtaataatccttaacacagtattagcaaatcaaatccaaccatgcgtaaaaagcataataaaccacaaccaggtgggatttatctcagatgttcaagattggttcaacatttgaaaagcaattaatgtaatccattaatacattaataggctaatggagaaaaattacgtgatcatatcaatagatgcggaaaaaggacttgacaaaatcaaactaattcatataaaagctctctgtaaactagtaatagagttgaactttcttaattcaataaagaatatttaccaaaaacattatacttaatggttatcatcctaattcatggtgagaaagtcaatactttcccactaagatcaggaacaagtcaaggatgtcccctctcacaattgctttttagtttcattatggcagctctaacttatgcaataagataaaaataaataaaagatatacagattgtaaagaaaaaaaaaactgcctttgttcacagatgtcatgagtatgtagaaaatccaaaagaatcaaccaagaaatttctggaactaataagtgattatagcaaaattgcagaatacaaagttaatatacaaaagtccattgctttcctatacatgactaatgaacaagtaaaatttgaaattaaaaacacaatatcaattatattagcacctcttacccccaaaaagaaatacagtcatctcttggtatctgtccatgggagaatggtttcaggtccctctgtgggtaccaaaattcatggatgctcaagtcccttatataatctacatatattttaccatatactttaaaacatctctagattatttataagacatagtatgatgtaaatgctacttaaatggttgttatattatttacatttttagtgtttaattactcttttatgtatttattttttctgactagtttccttagttgtttgaatctgtggatgcagaattgcagatacagggagccaactgtacttaggtataaatctaacaaaatatgtatataatctatacatggaaattataaaacttggtgaaagaaatcaaagaactaagtaaatggagagatattccatgtttatggctacagactcaatattgtcaagatattagctcttcccaactcaatctataggtttaatgccatcccaaccaaaattctagcaggttattttgtggaaattgacaactaattctgaaatttatatggagaggaaaaagatcaagaatggccaacacaatattggaaaacaaagttggaggacagatgctacccaaaataccttatgccttactttaaggttacagtaataaacacagtctagaaccagctaagtaacagacaaacagatcaatggaacagaatgaaaactcagaaagactccccaaaatataatcaactgttcttcaaccttggcgttgctgatgacttttaaggtataataccaatggcactatccatttttaaaaaatggataagctggatttcattaaaattaaaaaccctgcactgtcaagaaaatcaaaagataagcctgggactgggagaaaaatatttgcaaaagacatttctgataaaggactattatccaaaatatgtaaagaactcttaaaactcaacaaaaagaaaacaacccaattaaaatataggtcagagtttttaacagacttatagatgtatatacatttgaaaagatgctccacattatgatatatcatcaggaaatgtacattaaaacaacactgagatattactacatacacgttaaaatggccaaaatatgacaataacaaatgctggcaaagatgtgtagcaacaggaactctcattcactgctggtgcaaacgcagaattctatagacattttgatttgacagctaggcaatttattatttaaaaaaatactcttaccatatgattcagcaatcacattccttggtatttacccacaaaagctgaaaatgtatgtccacacaaaaacttgcatatggatctttatagcagctatatttgcaattactaaaactttaaaacaaccaaaatgtccttcagtaggtgagtagataaactgtgatatatccagtttataatggaatattattcaatgctataaaagaaattagctatcgccgggcatggtggctcatgcttgtaatcccagcactttgggaggccgaggtgggtagatcatgaagtcaggagttcaagaccagcctggccaacacagtgaaaccccatctctactaaaaatacaaaaattagctgggcatggtgctgtgagcctgtaatcccagctactcaggaggctgaagcaggagaatcgcttgaacccgggaggcagaggttgcagtgagccgagatggtgccattgcactccaacctggcgacagagctagactccgtctcaaaaaaaaaaaagaaagaaaaagaaaaagaaaacagaaaagaaattaactattaagccatgaaaagaaatagaggaaacttaaatacatattactaaatgaaagaagccagtctgtaaaggctacttaatgtgtgattccaactatatgacattctggaaaaggcaaagctatgcaaactgtaaaaagatcaatcattgctagggattaaggggaagagaagaataaaaaagtgaaacacagaggatttttagggaagttaaattcctctgtatgatactataacagtgtatacatgtcataaatttgtccaaacccatacaacaccaagggcaaaccttgatgtaaactatgaactttggatgatagtgaaatgccaatgtagtttgattaactgtaacaattgcaccactttggtgagagatgttgataataggaggtgaggtgggctattcatgtgttggaccagcctgtatatgaaaaatctctgtaccctttgcttgattttgttgtggacctaaaactgctctaaaacataaaatctattttaaaaatctaattaaatgattaaaataatacatttccttgaagaagttttgattaatcaagttgtgctggtgaaaggttcataaaaataacaataacgtcacattttttgtccttcatttatcataatgcttaaagttggatgaagtctctgaaaagaggagcaatactaacacttagaatttattttgttctttatggttgtgaagatttttgcatccatttttttcttctgatttatcaagctacattctgaggcacagggaacaggagatagtttttagcatttctatttcatagacatagagcagaaacccacaatttcttcttttggcttggagtaaattaattttctttttgctatttttacctttggttgaggtcagacaaaagtttaattaatctcaaaaattttcttaacatcagtctatccagagtgcttagagaaagctgtaggatatgaacttatgtaagtcaatttatatttgttgacatctcagttaagaagatgtatggatgagaggaaaaatgaagttatttttaaaaatgagcttgagtttcatatttttaagtggcccccaccatcttgcattaccctggatcattagatatacatatgatttttttctttttatattagtggagttgggttggctgaagagtaccatcttctaaggtctagaatgctcctgactaaacctcagagaagagcaatgcagatttgattgactttcacctgttatctttcctacaattactttgatactcaactatggcttgtattttgttgacagacattctagaaagctttgctttctgtgcatttgtttaatccaccatttactatatagaaaactcaaatgaacttaaatagtttgaagtgaaaaaagctactgtatggaggagtaagtccctaaagtgaagaccttgctttgaatgtcaatgattggattttctgtttcattttccctgtatctctcaggatgaaacttgaaacagttagaaccatgaagcagaagtatcataaaagaccatttattcttcaaactcaattaacatttacatttttaaagaattatctgttgtactaccctcacctcagttttcaatctgtgtaatggcatggtcagataaatgtggatgatgctgtctttttatggatgaaactctgtatgtgtgcacgtgtgtatgtgtatggtttacaagccttcttatttatgttctctcaatcacttgtctgaatcctaaagtgttgagttgccacagatttcttctatttagttgttttgtgctgccgtcctttaagaaataggcttttttttcccattacggaacaaactgccaatgacgttgagatattgatcgaatgaaagaactattaatataacttttatcttgggatatccaaaggtcctcttcttggaagataaataatttaaaccactttcactattctttcagagtcagcactcttcttttaaaaggaaattttcctatgacattttagattttcatgtaatttttagtgacctttgaagtcgttgcttctttaagttaaatgaataaatagaattaagtatattctatatacatacacatcaacttaattgtgggaaccatggtggtagagctcttttcggaggattgttataaaatatttacacagaccgggtgcggtggctcatgcctgtaattccagcactttggaaggctgaggcgggtggatcatttgaggtcaggagttcaagaccagcctggccaacatggtgaaaccccatctctactaaaaatacaaaaagttatccggatggtagtggcacgcgcctgtaatctcagctacttgggaggctgaggcaggagaatcgcttgagcctgagaggcagggttgtggtgagccgagatcacgccactgcactccagtttggttgacagagtgagactctatctccacaaaaaaaaaaaaaaaaaaaagacagatacttctttaataaaaaaaaaattgaaaagggttattctcaaatgagaatatgtcttaactattcaacacaaagtaattagatcaaaagataggggctcaccaagagtatgatgggattttttaatttattagatggccaggctgacacaaatatattaaaaattgtagggtagagaattttgaatataaaagagtcacacaacagccattttagattccagagtttagcattgagcccagacatccagttgtataaagtagatgacataaacaactacaaaaacaacaacaaaatagcaactggtacccttatttgaaaagccaaactggagaaatagataggattttttaaaaaatcacactatgcttacttgccttgccaaattaagtgattggaggaaaactatcaggtcacactgaaagagcaaatgctagtcttacatagatttgtccctactgcattttctctcatctggtatttttcattcttactcaaaactcatttgttgtgtttttgatgacaaagtttgcatcagcatttttattcttagaagagaaattctaaaaatagtttgttgttccatagtctcaaatgtataaaccaggatatttcctttcactaaacaagtgggggagtgagtgcaattcatcgtatcagtacataataattaataaggtctcttaagccccagtgaaatatacttgaaataaaccctaaaatttaaaatactttagaactttccatcctttattatttttaaaatcagaagtcaaaacttgtcattgagtacctaaagtatgtacaaggaactgtgtctgatctcaagtgcgggcttagagacatggttctgtcactctaggtaggaaaatgggatatgcaattacttcaagtaaataaataattaaattatgacaagtttaatgtttaaaactagatttttcaggccaggtgcagtggcacatgcctgtaaacccagcactttgggaggccaaggcgggcagatcactaggtcaggagctcgagaccagcctgaccaacatagtgaaaccccatctctagtgaaaatacaaaaaaattagccagacgtggtggcatgcgcctgtaatcccagctactcaggaggctgaggcaggagaatcgcttgaacccgggaggtggaggttgcagtgagccaagatcacgccactgcactccagcctgggcgacagagcgagactccatctcaaacaaacaaacaaacacctagattttcagtagaccacaggagtatagaacaggaaaacccatcctagcccctggcctgggagttcaggaagtgttttccccttagaaagtgatgttgagtcatgaagtgtagcacctacctaggagtagcacttacttacacaaggagaaaagagtgttctgggcagaagtgtgtgcaaaggctttgagaggacaaacagtccaatagtagtgagtaaatgagaaaagctcaggagagctggcatggaaagaacatagagtgtcctctgaaaagactcagtaacatgaagcattgcattatgtaggcccttgtagattatagtaaggactttggaagagtcaggtgagagaggattgactatgctgatggtggtgaaaataaagagaaatagacaactgatacatttgtaaggcggatcaacagaaagggattggatgtggatgacagcaagtatatgaggaattgggaggggtccaaacgattccaagagcagtagttgatggcgtcagtatcagagaccaggaaaccagagaaaaatcaagtttgcagatggagatcaaaagttaaaaagtttggatttatttatttttgtgtctctgagacacatcaattaagtcattaaatataagaatttgtagattaaaatggagaaatagatttgagagtcctcatcaacaatatagtatattagtcaaggtttagtttaagctgatacaatgaaaaaaattccaaacacaatggtttaaacaagacagaaaacatttctatcttctttggcaatacagaagaaggtggtacagggctggccaggcaagtctgttaatttcaactcaaggttttatctctgggcaaagttttattacagtggctactccagcctgtgccatcatgaatggatttcagcctaaatgaaagggaaatgaagaggttgcttctttccttttaaggatgttggaacctagacatgtcacttacgctcacttagcttaggcaagaaaagtactccctgtgtttagtaacatagaattccctagcaacctaagttacagcagattgaagggcatttactgtgagcagaaatggcaagcctttttgagaaaaattgtcatgaagatgtggagagtgggacagaagctggaggatgataaagatgaagagagaggattttgatgtaattaagttcttataatataaatgataaatggatacattatgaagacattgagaaaaaggggatacttgatggtggagtaactctgtctagacaagaattcagagaatattcagagaatattttcatcctgcagaatgataggaaaggatggagacaggtgcaaaaatatttgtggacttggtggcagaattttgatgtagttccatttgctgttttctatctgtcataaaaagaaggtaaggccgggtgtggtggctcatgcctgtaatccgagcactttgggaggccaaggcaggtgaatcacttgaggtcaggagtttgagatcagcctggccaagatggtgaaaccccttttctaccaaaatacaaaaaaattagctgggagtggtggcgtgcacctgcagttccagctactctggaggctgaggaaggagagtcacttgaacacgggaggcggagtgaaccgagatagcgccactgcactccagccgacaaaggaagacttcgtctcaaaaaaaaaaaaaaaaaaaaaagaggaaggtaaagttatctgctgctgaaaatgactgaagagatggcaccagtgctcagactgcagaggagagcggaggggatttgaaaacatcatggaaggcagggcagccacgcacagatgagcaggctgtgcccgctgacctctaggggttgccattcaagcaagttttcatgagaacagtgctccctagcattctaggctaaataatcacaaggttcagtggaggcattgacatttgcagagtgtactagtggaaaactgactagagagagacttacgttactgtgaaacctaagggccatttgtagttgtcagcctgaatttgtgatatatcagctagtctatcattcattagtaattaaattgcattcctactctccactctctgaaccacatttgacttctaaaactttatcatttcatcagttatctaatttattttcagctgtttattttgcttattctatgtcatttgataaacttgttcaagaagattctactttttccttagccagtcttaagtttctttcccatttttcttcacttttatttatttttgtattatacattcatttaaaccttagttccattttttatggagagatgggagtttagctatgatgcctaggctggtctctaactcctggcctcaagcaatcctcccacctcagcctcctaaagtgaagggattacaggcatgagcggttacacccaaactaaaccttagtttcttaagggaagcaatatcttaatcttatgaacttttgttctctcatgctttccttatgtatctttcttcagtttttaaatgctcatttattttaatggcaatccatcctcttttatgctatttggtttatacagttattgttttgtctgtcttatgcattatatctttcaaaatcatctcacttttaaatttatgtttaatgtattaaatcaggaaaatagatgcaacaaaaggggccagctctgattaatgatgggtgctatgaacaaaaagatgagaaatgtggcacacatgcccagaattcttattgacttagtttatgataaacaacaataaaaatgtgcaccactaacaaccaaattgagagtttggtcctctgaaatataatcctggttttacttctatccagggactctgcagtaacttgagtagggcagaagttctgcacagcttttgaagtccaagaaatggaaaccagttgttttcaaaagtgtaataattctactgcttactttattcttacatcacagtggttgtccctgataaaaggttagcaggcagtaccaagacttgctagctcacaaaaagtcaattcagatatctgagtttaatgcactttatgaaatcctccatgtggctgatctctgactattcttctagaaaagcaatgtccttgtagggagtatgacctgattactaaaaatactgacatttattatccctctttcccataactcaatcaataagggaacagtggaaatgcatggttcagataaatgtaggtgctcgcagatttggtctttaaacttttaatcaaaatgtcaagaatccaaaatgtaaataactcaacatgtaaatgagtctttcaggctcaatatagtaatggatttggttatgggaaaaaaaaaaaaaaactctagtagtaataaacgtactccaacaggtctagaaaatggttctaaatgaaatagtctaatgaagactttttttgtgttaagccatttcctagcataagcaaacgaactctagatttgatttttatgtagatgaatacatcttcatgaaaaatatgtggactttatatgcagtcctgatattggtctttttgtagagttaaaaagtgctgtgttaagtagaatcacaattagcttcttcattttcataattaaatatcagcgatgatgaagcattcctgatatttagaataatagattttattcagtcaataacaaggaaacaaggaactttagatataattttcttttcttttttttttttttttttttttttagagacaaaatctcacttcgccgcccagactggagtgcaatggtgcagtagtaactcattatagccttggactcttgggctcaagcgatcttccctccttagcctccagagtagctaggactacaggtgcacaccaccatgcctgactgatttttaatacaatttctgtagagacaatgtcttgctttgttgttcaggctgttcttgaactcctggccacaagcaatccttctacttcagcctcccagtgtgctgggattataggcatgagccaccatatctggcccataattttcatattagcaattagctacatttactaacctggctgagataattgagcatcactcaagaagcaatctaagatagcagttttcaaattatgcccctggagaagtccaggatttctccagagatgcaagtttacatttagaagctttctaggtgggtgtggaaacatcactaactcctatcttttgcaagaaagagagccctgttttaatatctttcgactactttctcctgcatagcatttatttggagaacatgtttctcaaacaaaaatgaggtttacaaatcactgctataaggatcttaggaaatattcttttctgtagattctttgaactcagtccctgtatcatgttagatgaatagggaacactcatttagccatacacataaatgtcttaccaacccccttccctagatttaaagttagattctaattactgttgactaagtaaagtaatcccttctgcctttccacagttactgatttagggatggtgatatgtctccccctgccaccacttggagaataagataaaaaggcagctttatgaaggtttcttggaagggaagtcaatcactcttctggagggtgaaagaatccaactctagatgtcaacaagaaagcatctcatcataattccaactggcagacgttctcagaaaatgaagactgaatttagaatgcagccagcataaaggatgattgaactaacaatggaaagaactgaagaactttattacattgttgagctctgggtcaataaaccataaagcctgatctccctgaaatttcatttacattatattatgtgtcctattgtttaagacaatttgcattttttccattacttgcaactaaaatcatcctaactgacacatatattccagagaaaagagagtttgtacaaaggcacagtgttgagaataagcttgtcatatttagggaacagcaaggatgctaccatcgagttgtaaaaaagtaaagcaggagttaaatggttctgggcactaaaaagaaaggctatgattgcaaatataaatggcttaaggaggtggaagcccagtttaatggaattaaggtggtcaacgtgtcaagacaatgctggcattttaggtatagagaaattttgttgcctagttgaaaattttcaagtgaccttgggagcctgataaggatgtaggttactggcagagctgggcaaggagtgagtgattgatattgccaaatggcttatgagacacaaaacaaaaataacttgttttggaaaaagtttaagtaaaatgattattcctgttaaagatttatttaagttgagacaaaaaaattggagacagagaatttttgtgagaagtttgagttcatagggaagcttaggaaacatgaaatttgatttccagagagcagagtgaaaaatgttttcaggaaagatagggcttagataagtcaaagaaaaagagaaaaagaggggaaaaccccatccaaatctctcgctctctcttcctctatgtattctaaatgtccatatatttaatgaagaacagatagtcagtggggaacactagcagacattaaagggatatgaggcatgaagagaatagctgactttggaatattacgtaacattgtcatttcagtgtaagctgagggttttgttgtgctcaggggcataaagatattagcaaacagttttgttttttttcttctatacagaaatatatgaggagattgttatgaaaaatctgaagaaattcttgttcatccttggtcagctgtgctgtggatgggattagtttctagaatcctctcctagtggaaaaaaaaaagtgtaggagcatagttgagtgaactcaaaatggttatgctccaaaaaaataacttattgttatagatcccagagagagtcttcagccacacagaaagatttgtggctttgttctctaaacggagcatacaatattgtttttatgggcagactatgttcttttaagacaggtaagataaccaaagaaggaaaataagcttttcaaataattagcaatccttagacaaaacttgttttcctttcttggttatgttacctatttgttcagtagacagaggctcttagtgtatgaactaagagtagacattgtaaataaatattctttttctctgttaaaaaatgtgcactttaaaactgctttaaaaacttgcttgtttttctttacaaagattatgaaactacaaggtcatataaaaaaagtcatgattcaaaattagcttattgagtgaaaagaatgcatttcattaatacaactaaggaagaatacaaactgctacaatccaaagaagcacattttataaagggaattacataaacaaatattttggataatgatacaagacttggggatactaaatacttcacctacattttacagaattattttctaaataaaccagataagtgacagaataaagaaaaaactttctataataaaggtatttctggaaagcttttatttcattatattccagcttctgtttttaattataattatgttgttatcattggctcaaatatcttgcctttccctgtgaatctatgaaatatataccaatttctcacagcttaattttattttctctatgggattatctgaaatcatttctgttcttagtggcttcacatctcctagaggttctgcatcaatcaagttgtactaaattacgccttgctttgcttaatatttttattatttatttttagacagggtctctctctgttgctaggctgagtgcagtggcaaaatcatggcctattgcagcctcaacctccctggttcaagcgatcctcccacctcagcctcctgagtagctgggactaaaggagcatgccaccatgcctggctaattttttgtatttttgtagagacgcagcttcgccatgttgcccaggctggtctcaatgtcctgggctcaggcaatctggctgctctggcctcccaaagtgttgggagtataggcatgagccactgtgcccagcacctgcttaatatttgtataacttaaacctaccaacctattaacattttttaaaactgtaaatgtgttgtggacagaaacctttccttagtcatgttgtgcttctttatttaattttatagggaaataatgataatttggaaatttgcctctaaagattcttataaggattgaatgtgatgatctgtgtaaagcatttaccatagtgactctcaccaagaaagactaacaaatgttactagtgataatgaaaacaatataatgaaacaaacttaaacttttaaaattatataataatcatctaaactttggggaattgttaatatgtaatttttatgatatatatgcatataataatgcaactctaaaaattggtaacactcaaattgcatgtgcactcattaaattatttggggtttgccattgattttttactgagcaatgctatttaacaattatacatacaatagctcaaataaagtcagcctacatttcttcagaagcagtgggtaggaatgacccagaattattcattgttgatactttcgtttatatcatattgctgtccttgattcaaacttgaaagcagtttaggatactattttcgcccacagtggcaaatgcctctgatttctgctaagtgattctctgatcaaatcagtgtgagtagagtcaatttagctgggttaatgggatttggcttctcaggataagtagctatttcagtgcctatgcacatttatcttctttcacagtggttaacaggcccctaatagaatgacagatttccaggggtcaccctataaaaatatttggatttcttaacaaaaaaaaaatgttatataggtaaattgatagtaattcattagtataacatgcttaataaattataagtgtttaaaaacttatggagagcttcctttaggtgaatattatttaaagcaatagtatataaatatgagttcttaaaatattaataatcacgtagggaagttaggcccattgaatctatttgtgaagtaaagtttcagtgagagtgtttaggaaaataaaataagtgaaataagatttggaatacagtagtctccccttatccatggtttatctttccacagtccaaaaatattacagtaatttgagacatcatatttatacaacttttattaccgtatattattataattgttctattttattgttagtgattgttttaatctcttaccgtgcctaacttatgaattaaactttatcatagatatgtaagtagagacatatctcagagatattgtgagtttggttcgaaagtatcacaataaagcaaatagagtaatatagtgagtcacacctttttttggtgaagtagtctccttctggatgactttcaggtagtctctttctgtctctttgtctcagacttaaaaatacttttactttgctttttggcatgaatcgcttaatcagtcttcctgttactctgaacttttgcttttttccaactctgcctcattattttattcattaatttcacctttacagacttcctgctatctgttagctttgctccaagcattggaattctagagatacaaggcagtcactggcttcatggagatcttcttgtcttaatttcactgtaatatttaattcaagtcaattaagtaaaaatttactagcatttcctatgttttaatcatcctgaggaaaagaaagatggagaactgtctccgatcttaagaaattcataatcagattagagagagcaatatttacaaacataggaaagtgtattaaatgttgagataaatgtttttttaacttgttatgggagttttgagaaaagatctgattttataccattgagaacaaggtagagaaagaggaaggcttattactacatttgacataaatggttcatttcctcaatgtgtgcacatccaaaagagacccattgccttgttgtcgttttactggtgtaatttcccctgagaaatttaactaaagttttcattttttatatttctttatagttggaaggcctagcagtcctagatgaaagacagtggtgatatatgttgaggagtgaaggaagttggagaaatgggcacctggggaagaagcattaagtgttgattaatttagtccaacaaatgtattgaacacaaactatgccaagcactgttgtaggttttgcacatgcagcagtacacgaagcaaaccaaaatctaccctaatggaagttgtattcctagtgaataggatacttaagaaataaataaatatgcaaaaagcatagtatgccaaatgatgagggctatacaaatatataaaagattttaaaaatatttttatatctcacagaaaagagagggggatttttagagtagacctactttacatagaatagttaagaaagtcctcacttacagggtgacgtttgcacagaaacttgaccatggcaagggagtgagctgtgagagtatctggaggaagaacatcacaactgagaagtacaatgcccctgaggtacaagagacaacaaggaggtattccagggtacagtgatcaaggaaaagagaattttaaaaatgagatttacagagagagcagagagtcaaatcttgtaataacagaaatgactgtgggctgttcaaagagtagggagagagaataactatggttaatagggaatgagtcattaactcgtggtcaacataccgaagatccacatgcaagtttaggtagcagaccaggaattcaccctttccaaggacaggaattcagtctagggaatgtttaatctgattttcctatttttagaaagtaaaatgggcagaaaggacttgaatttggagtcgagaagtttgtttcttgtttctgctctgcccctaactagctatctagggctaataaattttaaatctctgggtttcctttttgtttctcctttgaaatgaagagatgttttctatatgttatgtaagctttaaatattcaattcaaggctaagtggtgagtccaacctagtgctacaaatacttactatttttagagggcccagaaagccaggtttattcttattttttaaacttttggggaatcctataaaataacagttttttctgttcatttctttgtttctgagagaaggcctattcctctggctagttttccagcttgacttctgagctcaacaaggtagaagacagaacagtgaatctggaggcattctctgagatctttgcacacaacggttcatcatcctctgtaaagggcatatgcacataatttctgcgggcaaaagcttaactttttaaatagaaaacaaataaatagttacttaatttctccattttaacatattaatatagtttatgatctacatttcagaatattttatttttttagataggatcttgctatgttgcccaggcttgagtgcagtggctcttcataggcacaatcatagctcactgcagcctgaactcctgtgctcaagtgatcctcccacctctgcctcccaagtagctggcctacaggagtgtgttgccactcttgactacatttcagaaatttagaaaccatgttcacatatgagttaatgtatagcttggtctgggttttcaatgttaagttcaagaaggacttttttctttcttattttcaactacaattttatgcataatttatcactgaataatctaagtcctgaagtaaaaatattatattatgtagatgactcataagatagaagatactgctctaattttacttagttatcctttttgacctatgaaaactggattattctcaaggccttattgatgccattgtggtcataggttccagtgcctgagattcaaccaatgagttaaatacctaagctacaatgacatccttttaaaggggccacaatgtaaggcagaaaatacaatatcaattacttattgaaactcaccatcttgatagcaaaagaatcccagagcatacctcttgctgaccctgagggtgaaggacagcattgaggaagcatctagaagggtgaagagtgaacatactgactatcacttcaacacctcattgaagagtcagtgttggtaggttggtttttccaccagatcatactagagttattctttccttcccctttaaaaatttctataccactgtgaaaggaaaatatcttgggcccccaaaaatcactaaggaagactcaagctggaaactgcttagggcaaacctgcttcccattctattcaaagttatccctctgctcactgagacagatcatatttgattgcctccattggaaaggctaatcagaaactcaaaagaatgcaatcattatatctcacctatctaagtgacctagaagctccctccttggaatcttcaagtcttcctgcctttgcttcaagttgtcctgcctttccggaccaaaccaatgtactgcttacatatattgattgatgtctcatgtcttcctaaaatgcataaaaccaatctgtaccccaaccacctcgggcaaattttgttaggacttcctaaggctgtgtcacaggcaagtcctcaacctcgacaaaataaactttctaaattaactgagacctgtctcagattttctgggttcacatcactatctagaaacccttctttacataatacagcttcttgaaactaaaaaattaatatatacattagcttttgctaataagaaataagtgaatggaaaataaagagaatatgtggatgatatgattagcctttgtgtccctactcaaatttcatcttgaattgtaatccccataatccccacgtgtcaagggagagaccaggtaggagtaattgaatcatgggggtggtttcccccatgctgttctcctgatagtgaatgagttctcatgagatgtgatggttttataaggggctcttccccctttgctcagctcttctccttcttgccgccttgtgaagaaggtgccttgtttcctcttcaccttccaaaatgattttaagtttcctgaggtctccccagccatgctgaactatgagtcagttaaacctatttcctttataaattacccagtcttgggcagttcttcatagcagtgtgaaaacaaactaatatagtggatgaaaatatgagatacaaattggcaatatttgttgattgattaaaaatgaaagatccagggaagagggaaattagcaatgatgccagatataagtggcttagaaggtgtaggtgacaataaattgaaaattgaggaaaaagctacttagggaataagagaatattacagcaatgctctaattcaaggaagaacaaagcaatgctaagttaaacttaaaataattttttttaagaattaagagttattcaaataaatgtttagtggtcaatctttttatgtctttaatgaattatttgattttttttttgtagtgagacttagctgtatcagttttcatagttagcataaatgtaattgcttctaaactgggtgaagcatgcatgagcactttggtctgatttgggtaactatagcctaggaacaaaaggtgaagccttggtaagaaaaaagctaataagaaggcaagaagcagaacacagggaataaaaaatattgtcttcagtttgaatgcaacattgcatcatttgttgcttattttgtactctgttctgcctgttgaacagttaccaaatttattctgtctttgttcccttggtaatctaagggattgtgtcatttgacattgctccagtaacagtgatttctggaagtggatatatcatttgtaaagaatctggaagctatgcaatggaagatattacaaaaggtatgttctcctgaggtgttgaagccagaacaactcccacacctactttatgtgaatctcattcctttttacctgaactatatcacctcgaaagaaaaagaaatagcttatgaatgaattgctgcagagactgttgtgaaaaaaactcccatgggaatggatgtgctttctttctggaagcgtggttcctgacctaaactcttcttactagactgctatgaaagtgtaacataagtgtctgaatgtcagttaaaactaagaaatcttgctactgagcattgcagaaccaaagtaggaaaatatattttttctatgcttctcctactgctccttcaataagcaatattttctttttagttttaaagctgctattgtttgtatcatttgatcctttaaaggggttaacatgtcaaattagtcagaggaaactaattctttctctgtatttgttaccagattggttataacgaaaatgcattagcatctaaaagttgtcaaaatcataaaaaaaaagatctagcaactaaattatttgatgttagtgcataagtttcaattaatcacatttttcactttctgacatgctaacataaaagatcatgaaaagccattattttattttattttattatgttttttaattcttattccctctctaattccaagcctaaccataatacctctgtaatgtcttaaaaatacatgtatgcatgtatgtgtgcatgtgcatatgtggaaagagagaaagagaaagatatatatcttatatactttatatatatgtaagttttggatcaggtggcttattttttaacaatgtgatccaaggttgggggcggtagctcacgcctgtaatcccagcactttgggaggccgaggcgggtggatcacaaggtcaggagattgagaccagcctggtcaacatggtgagaccccgtctctactaaaaatacacacacaaaaaaaataagccaggcgtggtggtgtgcacctgtaatcccagctactcaggaggctgaggcaggagaattgcttgaacccaggaggtggaggttgcagtgaggttagattgtgccactgcactccagcctgcaacagagtgagattctgtctcaaaaaaaaaaaaatcaaaatttataagatttaactaaagcagtgcttagaagaaaacttatagctgtaaacatctatatttaaaaagaagaaaaaactcaaatcagtaactcaaacttccactttaaaacaccgagaaaaggagcaaattaaacctaaaggaagcagaagaaaataataaagattagagcagaaataaatgacatagagtatagaaaaacaataaaaggaaataaaatcaaaagttggttatttgaaaatataacacaattgacagacctttatctagataccaagaaacaaacaaaaaactcaaattactaaactcaagaattgtagaagtttaagaacattgtaggatacaagatccatacacagaaatcaattgtatttctatacactagcaatgaacaatctaaaaaaaacttacataaataattccatttatagcatcatcaagaaataaaatatttatgaatatatctttttaaaaaaagttcaatagaccaggcacagtggctcatgcaggtaatcccagcactttgggagtccaacatggaaggatcacttgagcccaggaatttgagaccagcctgggtagcatgatgagaccccgtctctataaaaaaaatttttttaaattagcccagcattatggagagcacctgtagtcccagcaacttgagaagctaagacagaagaattagttgagcccaggaaatggagaccatagtgagccatgatcatgccactgcactccagcctgggtgaaagggtgagatcctgtcccaataaataaataaataaataaataaataaataaataaataaataaataagaagtacaagacttttatactgaaaactataaaatataacttaaaaattaaaaacaaataaatgaatggaagacaatattgtttaagacatcaatactctctaaactgatatatagttcagtgctatccatatttaatctgtatctatatccaagctgtttttttccagatattgacaaactgaccttaaaattcaaataaaaatatgcaagagactcttttcttttttttttgagttggagtctcactctatcacccaggctggagtgcagtggtgcaatctcagctcactgcaacctccgtctcctaggttcaggcaattctcctgcctcagcctcccgagcagctgggattacaggcacccaccaccacatctagctaatttttgcattttttagtagagacagggtatcaccatgttggccaggctggacttgaactcctgacctcaggtgatctgcttgcctcggcctcctaaagtgctgggatttcaggagtgacccacagtatccggctgcaagaaactcttaatagacaaagcaactttgagaaaggagaacaaaattagaggattcccacacctaatttcaaatcttcctacaaagtgacagtaattaagacaatgtagtaatggcataaaaataagcatatagatcagtgcaataaaattttaaatcaagaaagcaaccctcacatttgtgattatttcattttcattcaatgagagaaaatagccttttcagtaaatggtgttggaaatcaataaattgatgaatggatggctgagcaatatgtatcatagccatacaatggaatgctattcagcaataaaaaagaatgaagtaccaatatatagcatgaatgaaccttgaaaacaaaatatagagtcaaagaatcaataacaaaatgccacatattatatgactccatctacatgaaatatatagaataggcaaattcatagagacaggacttagattgctgccagggcctagggtgaatatatttgttagagtgagctgaccttaagcaactgtaggccctatttaggtagcttttctaagtggtaggtcttgaattccacaagatatgctgtcaggatgggacgatgaataaagtaagggagagcaaggataaactgcaacccacaacataagctggatccatgaagatggtctgaagcctgtgtcagctcttcttgcccttgacttgggttgtatggataatctgcaggggaaggtcatgccttttgtcatggagctaaaaacacacatcattcctaatacatgcagaagcaggaggatagaggggaaggtgaatcagttgcacggctgccccacaacaatgaggtgagtcagcaggtaagctatattaagcataaactgtacagtggaagccctttcagttccacccaccaaatcttaaacaagaatttctcttgtggcccaaccttagtggaaaaatacagggaagcaaattttgggaaacagttcagcctaaccaagttgaaacatgatataaccaccaaagacaccttttaaaaataagagaaaggggaatagagtgggaagatgttaaaacagtctaccaaaccataataataataccaccaataaaagtcatgtaacattaacaatagtcctgagactataatataacaatatatcatgatggaatataataaagaactcagaacagaagcatgcatatttaggaacttggtgtatgatatacatgacatcacaaacaagcagtagaaagatggattatttatagatggtgttggggaaaccactttggtatataaagaaatgagaaattgaaactaagtcctagaaaattccaaatgaataactatatatgaaaggtaaatgtgcaagactatcatttttactttggtgtgtaagctttgtatattatctaccaattcaaatttactcattgtatgaattgtcttgtacatctgtggttattttcttcaagacgagtcatagttttcaaataaatcatgactgtgttaatataacaaattccttatgagaaatcatgaattatcattagtgtattagtctgttctcactctgtgaaaaagacataccagagactgggtaatttataaagaaaaggaggtttaatggactcacagtttcacgtggctggggaggcctcacaatcatggcagaaggcaaagaaggagcaaagccatgtcttacatcatggcaggtaagagagagcttgtgcaggggaactcccctttataaaatcatcagatctcatgagacttattcactatcattagaacagcacaagaaagacccactcctgtgattcaattatctactaccgggtcaattccatgacacatgggaattatgggagctacaatttaagatgagatttgggtggggacccagccaaatcatatcaattagcatttaattttgtattgcaaatctagagacagatttacccctttgttaccattttttgtcatgtataattttaagaagactaatgtgcatgttattcgttgaattatgctctccctgcaaaaaaaaatatatatatataatgaagtcctatcccaagtagttcataatatttggaagcagagtctttacaaagactctgcagagctaatcaagttaaaatgaagtcattagaataagccctaattcaatatgactaatgtctttatagaaaggagaaatctggatacagagacagatacacacagggaagactctttgaaggcaggaagaacatgatgtgacgataagattgagggaatgcatctacaagccaagaagcacaaaaaattaccagcaaacccccagcagcaacaaggaggcaaggaaagattctctacaggtttcagagtgggaatggctttgtctaccccttgatttttgacttttagtctccaggactgtgagataatgaagttctattgttttaaaccacccaatgtatgagactttgtcagccctatgaaactaaaatagtacattataaaatttattatattaatgcatatactacaaatttataaatatactatatttaggtcttcaatacatgtacatattatctttaaaatgatatcagaataatttgaaataaacgtaaaggccaacagttttgttctgatattctctgagctgttactgaaggaagtaaaaagaaacttactcttcttgtcaaactcagcattataattattcttttaacatgtgatcctcataaaagggttaactgtaaatatattgactaaaatatatgtaataatactttggatattataaatatgtaatgtttggagattttatatgtaatgtttggggatctttaacaaggaattatacccccaaaacctccaagtataatatttttcaataaaaaatagaataattttgtcatcatgtttccaagattctcagagtgatttggaaattattacattattctcataacacctaaagcatgtactaaaagtttccttatatgaaattaatgttcaaaataggtataaaataatggaagttacaatatattatccatttaatagtacttcattagtaataagttcaaaatactacattctgaaatgccttataattctttaacctttgaagttagaaatatacattttgattaaatatatacatcagaaataattacagtgatataatccattcatcacatagtactttgtagtttaaaagtgattttgcatgccctctgtaatttctggcttataataccctatagatgtaaaacaagcataaataaaacaatgagggtactaaactttgctccgagtatcatagtttcttaggggaaaggctaaacacaaaggattttcatctcgttttttgcaaatatgttcatgtttaaaagtgtctaattttaagaatctctatgcaccaatatagcagtactgacaatatgaacaattctattaattgggagtagctttaaataaaaaagggaagtctttttctgatccctgatttcctttcacaacatatctactcctactttatctatactcctaaccaatgtccagtagtcttccaaaagtatgaaagtccaaagtgtgggcttcctacagatgagatgctgacctgaagaaatcctgtttaatagtgtagttttatttattatggcatccagataggaaaaatatgcttaggcactgaggtattctatgaactgtttaagttataacaagtaggcttctacctatataaccagtactggatgatgggtcaaaggagaaaatactagcataatcatgaacatggaaactttcccatttttatttattcaaccacagctcgagaccctaaattgaaaactcacaatacagcacataagggcaatggagctctgaagagggtacgttgctgcttggtgaccatcgggacagtagaaactaaggatatttaaacctttaggataagttgtgatacttgggctttttattctctacctcagtgatcaagctacataaaagagcccggggttccctgctgccaacatggtgacactatgttaatgaatcttgatccatgtgccctggggtttggaaaagacacagaaattgatgaccacatgttacctggaaatcctaatgacacaatactccctagaagtgccttttagcgtgaggcaaagaaacagggttattgtagaaatgaccacgacccttaaaatttggtggcccaaagatgctgagtttccctgtgggtcatgaggaccctatagaaggtaacaggtttgaatcattctgaaaggactgccttgagagcatgacacttcttcacaaaaaaacggaggaaaaagtagtacgatccagagttttcatcactaattcagggaatagagttatggaggggtggtggttgggggtgttaggacaggatataggcattaaagagagtgtggtagattaaattattatccagaaatattcactctctcttgtcctcaagttcaaggaaggcatatgttctccattgatgttgagcttacccttgtgatttgctttgacctttgaaatgacagtagatgtgctacaacatagattttaaatatgcttgtacactcactttaacccgtcctcccttatgcctttgccgttatcaagagaagaatgtgactcagaaagcccactcatcccagagacaggatgaggatgaaagagaggtggagctgagccactcctaggtaaaacaatctagattagtcaactataccagtcaaaccacagacttctaagagatcataattggttgttgttttaaacaatcgagttttaggctgtcctataatacaacaataactaattgacacaaggagatgcttcaaagatcctaagaaagtgtactgcaagagaaaaagccagatatgatgttaactaatagtaaactggactagagtttttaatacctgacaaactacagttgcaatacccacaggtgactagatagctgctgtaggttctctccaggatattgatcaaagacaggaaaggtaaaaccatcagagatggtttctagtgggatattttaggtatatgtaagtatgtatacaaattaaaagttatattttatttcctttcaggaataattgctttaaaaaggtgaaatgagagagcgaaagtagaatatactcaccccaaagtaagtcatccttccacaaaatcatccattaggttaatttattcctttagcattggtagggtagttttgataatgtatggccacattatagccctcatctactagacaataaagttacatattaattctagataagtagtttgattggatccacggtgtctttacccatgaagcaaaggtttttgcatattattaaaataactttagtaacccactaatccaattgatttttcattattttggggtaattttagacttcatgttcatatctttaaatatgaaaatcatgaaaatggtaattacataagtatagaatttatcatagctacagtaataattagaatatgaaataaaatacaccggtataaactcagtttgtctttgcaattttgatgttaatttgtttaatttactaggtttaatttactatcacctcaggagagatgtcccttacttccttgagagtggagctctttaatcctttctatttgtagtgcaccagaggtgatctgatcttgcctctagtccatcacagatggagaatccctaggaatcaaaaagtagatataattttctttccctgctgactgctgctatatctacctgggggaaaaacaaaaccaaccaaccgacaataaactgctatatggggtttactttgtccttttattgaagggtgctttacatgtcctaaagcagctccgaatagaacttggacctgtctctttgtctaacctcttatggaaggggctgtgagaggcgaagtcacataggaaaaattaatctccttggatatctgtatactcaaggataaatacattccttgggggaaaagtaacctaaaataaaagagtaaagaagtacaattgatttaaaaacacggcatctgtattggaaaaagacatattgcttcttctgtaaagctgttggctctcattagattatcctgtgccccacatctctgaacttatgtttaaactccagaaagagaaagctgcaatgaaagcaaaagaaaagcttcagtggcagttactttaaattttacatgaaacaatgaaagcactacttgtggcttttataaatgagagcaatttttgtagtacaggtgcagcacatagtgtctattcagaccagtttacttttagaatagaaaacaggcactggatcttggcacttttagcatgagtggtgctgcctttggtgcaggtcttgatgatttggcagtaggtaccacatagaaatagagcaggaatgtgaaaaaccacagacacagaaggtgataactctgataaatacttggtgagtaggtaggagacactgtcctaaagattaaaaaaaaaatactatgagggtggaatttgggggagctggcattcctgcagaaatgagagaatcaaagcaagagaaatcatctttgtttgtttaaaaatgttatcatgattctattattatgcccaggttggtgtcatctgattaaacacagtgaagctactgacttgatataattacatatagaaaatttggaaaataaaaagaaatagaagtaaagccacaaaaagctgtctgctattacatagttagaatctttggacatttaatggagaaaatagatttggatctagggaaacatcagaaccatgtagttgctactataccatatttttaaaggtgatctgtgagatcattcatttctgatttaaaagttttttgcacattgctctctttctgatgtgaactacaaagttgaaagggaacattaagaaatgaaaatttgacagatgtacataataaaatgactgcaaaagaataaataaggttacacaatgaaaatttctgatataattaatactaagagaaatacaaagagcaatttaataatcatatttagatattttaatataggcaagaaagagaataggttattctttgtttccaatatgtgccaaaaaatgatatagctgaaatttctatccatgtcttcctgcctctaaatctattgcttttgccactccacaggttgcctcagagttgctgaggtcactcttattctctcatgtttgctcagacctccacttcaagaacaggtgatttgcttcacttcaaacaattttttttgttttattatttctgaaagtttcagaatgaataaattgaatttttaagaatgatcaaatgcacaaggtgatcttgcttttcataacttaacagattcttatatgacataaataatatcaacttatttatatgcattacaatttttaaatttatacattgtgattcgttaaagattattgcaacctatagaatgatgttgactcaaaagactaaataagaaagattagcaaaaaaatttgaaagggaaaacacacatttttgttcctttattcataaaatgcactctgtgtcacaaatgctatagtataagaatggtgtttaaaccaatcacttatgggaaaatatgaagggtagatgatgcacataagtaataagaaagacacagagaaaaaaatagcagtatctttttcaaatatttattattagtgtctggcgacatgcttggggaaaactctaatagaacttatttgcaaatttagaaatattaaatctattataaagccagatctacacagatacaattatttctatccttagggataaatgaatctttgcttaatggtttcataaaaaatcattttgttcaacttcaagtcttgtataaacagatattctcaagtagagataataatgggagctttttaatatacttttatgtacttaaaaaacgaaatgcatatttctgaagtaagccctcagtgctttagcaatagagtattgtataaatgaaaatctactttaaatgaaagcctagcagaaatatattagctcaagggagtatataaaatgttcatgctgcctgttgaatataaattttataatggaaaattaattttattgctcagtcatttaaatgattatttatattgtttatgataatggcaaattattataaaattttagcatttaggacaatacttacatatcaataaaatgtgacatttatcttgtatgttaacatatacatatagtacaataacaatttttaacagacatatccaaacttatccatgcgtgcattttcattagtcattgtattttcttcacagtcgacaaaacttatataggaaactctttgtcttaccttctaagttttattttattttattttttctaaattttaataaatacaagattaagaacaaaaaatggatcaattattcaaaacacagttttgtcctcatccaaaaaagaattctcaatacctttgggctgagaataagatattgcagatgattggaataagtttatggtttccagggtggttaatttacaggtaaccttgtagtttccctctgcctgactaaactttaggcagccttccttctgactctaggtcctacctccctttccttagagcattttatttagaaaatctgtaattgtaaattatttctccacccttttgagaagtaaatccttttaaaagcctctcatcagttttacaactcacgaatttctgaaggatctgtttgccatgtctttaaaatataaacattaagagagatagcaccccatctcctactttctatgggagggtagtggcccaacttgggtgggtgactgctttgctcaaagttataaaattacttctttttacgaaaatatgagaaagtttacttttcttttgggtaagatcagttggcaacacaaattgcctatgatcttcatccctggcttttcaaaaactctcctggcctcagtttcaatgcagttgagttcatacgataggtaccctttatccctagtttgactttccatagtttcagttacccacgcacagtcaactgcagttcaaaatattaaatgaaaattccagaaataaagaatttgtaagttttaaattacatagtgttctgggtagtatgataaaacttgtgttgagagacaagactagctgggtttcccaggccgactaagaattcctaagcctagctggggaaggtgaccacacccacctttaaacacaacacagggcttgtggcaggtaataaagagggctcactaaaacaccaattaagttaaaaacaggagctaaagaaatagtcaaatcatctatcatctgagagcacagggggaggaaccatgattgggatataaaccccaggcattccagcccagagggggcaaccccctttgggtcccctcccattgtatgggagctctgttttcactctattaaatcttgcaactgcacgctcttctggtccgtgtttgttccgtctcaagctgagctttcgcttgctgtccaccactgctgattgccgtcgtcccagaccaccattaacttccatgcctccggatctggcagggggtccgctgcatttctgatgcagcgaggtgcccattgccgctccggtttgggctagaggctcgccattgttcctgcatggctaagtgcctgagttcatcctaatcaagctgaacactagtcgctgggttcctgggttctcttccctgacccacagcttctaacagaactataacacccaccacatggcccaaggttccattccttggaatctatgaggccaagaacccaaggttagagaagaaaaggcttgctgccatcttgggagcagccacggccatcttgggagcagcccaccaccatcttgggagctctaagaacaaagacccacctgtaacagtgtcacccagcttcatcccacccaccatgtgaatcactcctttgtccagtatatgcaccttgtatgtgctactcacccattagtcccctagaaaccatctcagttatctgatcaactgtcaaggtaccccagtgcttgtgttgaaataaccctattttacttaataatggccccaaagcacaagagtagtgatgctggcatattgttataattgttgtataattattagttattgatgttgatctcttacagtgcccaatttataaattaaactttatcattggtatgtatgtataggggaaaacagtagtcatgtaccacataatgaagttttagttaatgaaaatgcacaatgcacatgcacaatggtggtcccataagattataatgggggcctggtgaggtagctcacacctgtaatcccaacactttggagaccaaggtgggaaggtcgcttgaggccagcagtttaagaccagcctgggaaacatagtgagaccctgtttctaccaaaaaaaaaaaaaattaaaaattagctgggcatggtagcgcatgcctgtggccccagctatttgggatggtaaggtgggaggatagtttgagcctaggagttccaggtcacagtgagctatgatcaccccactgcactttagcctgagtgacagagtaagacctgtctcttaaaaaaaaaattattatggagctgaaaaatttctattgcctaatgttgtagtgcaacacattacctttactatgtttaggtacacagataccattgtgttatagttgcctacagtattaacatgttatatagatttgtagcctagaagcaatagactataccatatagcctgaatggtagttggctattccatctaggtttgtgtaagtactctctatgatgttcctacaacaaaattgcctattgacacatttctcagagtatatcctcctcattaagcaatacatgactgtatttacctaaagggcttgatcctgtctgaggtttcagcatccactgtgggtcttggaacctatcctctgtggataaggtggggagaagtcttctgtactgtattctggtctctctctattttattgcaatagcattcaatgaaatctttcttgcctgtttaactttggtgttgctttctcagaggacaaatttttaaattcattctctccatacttacctacacatctattatttctaacatactacttaaactttagttagatgagtttgggaacttattcaaaatgattctcatcttttatttttctgtcatatgcttatggagcaagtaatgagcattgatgaaaaacatcacaaaacaatgtaattagttccactttgaaaggatgctatttttttttattgagttttcacagtgtgcacacctctattcagtggctttgtttaaaacttttatattatctatatttaccttaaaatagctcagtatggaccaacagcacaatatttttaactctccctttactattatgaaatagaattcataaatgacctacttatacaaataattttttaaattgaattactgcaatatagcatgaaacatagctgtgacataaaaaagagataaaagaaaagttataatacagctaattgcattgtttttgaaaaaaggtcatgtaccacttgtgctagaaagcataatgaaatagctaaatgtttcaccgatgtttaatattaccatgatggcaacagtctcaaatgcagactgatacagggatgctgtattaatgattcaattagtacaaataacattgctattggtgacattgttttctgaaattacacgcaattcttgataaatacttgaacaatacaaagtattgtcccttgactcacatgtcacttgcaatattgaaaaattaacagttcccaaacacaatgcagaaacactttatatttttatataaggcagggatgaagcctgggttcagatatgtataaataagataatcgcttactagaattgtctatcaggtagatcatttggaattgtgtgggattcaatctgattctgctttgtaagatactgtcctaagtcatgcaactctggccctcaatcattgagcactcaacaatgatatttgctgcgactgacttcaatcaacactttaggaagtgtttaaattttaagtaacagaatgagttgtttacaattcaagggtgtttaattagcatttgaaagactttaatcaaaggcccacacttcagccacaagtatagcaagccattcaattagtgttatcttaatctacactagagaatttgttaattaacataaggaatggtaaaaataaattttcattatctaaatgagagttgtacaagatacatgattggttaaaaacaaaaagtacagttatcattaatgagatctaaaaatctgaggagctcagcaagcacactagttccagtgacccattaagacttgtccctttcacttgctagaagattttgtctcttgatccaactataaagttagatcatcctaacttgtccccttgtgaagcccctttcacagcaggctcctttctcttgtatccacctgcttcagcaacttttctgcaagataagcaatcctacgggaccgccagatggttacaagttcctgatacctagtacagccacggaaagagaacaaaagcctcttattcctgatgtagcttccccattctccagccaatcaacacccaaagcccaagaaaccacaggttcctgcctgaagctaggactttatccacacgtgcagctaggctcaaggtttagcttacagtgaacttttcctcattttgatagtagaaaacacacccctaggtgagattttataagctaatgatgcacgagatgtgtgttgggatatgcagatgctaagcccctccaccaaccacaggtccacctttgcataaattgacttcactagtattttatgaatgaatatgtataaacaactcccataaaacaatggccataaaaggaattccttttaaggaactagctgctgtctctccctctgagcagcccactctgcctctcagagtgtactttcactttgcaataaaccttgcctactcttactttgggcttgctctcaaattcttctgtgtggtaaagtcaagaacttgagttggcctaccaagaacagttggactgcctaaaaggctaaacagctaagacttcatctagtttacattaacatgactttaactatttttgaaccttctaaacatgcaataattcagcctgagtcttactgtgatggtagcatacctcccagtagtgaggttctaggaaaggagaactacagctcccactggcttcaaattgttagctgctgtcaaactgatatgggtacagttctcatccttggatgtccagtggattcacctaagaagctctaaaatatattgatgctgaaagacccgaaggaattctggttaattggcctggtgtgtctgagcattgaacttttaaaaactcccctggtaatttcagtggtaaaagttaagaactgctctcctatgacctttcccacatcatctgattgaaaacattttcctatttgtacaagcccaggtcattctttcattttttttttcttttgaaacgaagtctttctctgtcgctgactgcggtggcacaatctcggctcactgcaacctccgcctcccaggttcaagcgattctcctgcctcagcctcccaagtagctgggattacaggcgcccacaacacctggctaatgttttgtacttttggtagagatggggtttcgccatgttggccaagctagtctcgaactcctgacctcaagtgatccacttgccttggcctcccaaagtgctgggattacaggtgtgagccaccgcgcccagccccactctcaaacttttaatacttaagtaatatgccatctagttattgggggaagagaggattttcaatgagagtacttttgtttgtcttcttttttgcctttaggtttctctgtcttcatctgtctatatacccgtctatggaaattggaattctcttccttgccagagcaaacacacttattgttgtttggaattagactcacctttccctactgtttcaaacacaatgttacctagaatttggttcatagcatcagtatcacttgggagcttttaaaaaatgtagagtcgcatgcaccatgtagaactcccaaatccaatctgtgtttttaacaggttattcaagccatttgtatgcacttaaggtttgagaagcatttcttgaaggcattactctactaaatagttattagttgcatctctagtctctcccttggctgactctgtttcactaaaaaataataaataaaaattattaccctgaaataccatcctcaatgccttccttccctcccctcaaacagataaacaaacaatgatgaacaaacacagttctcaataatatagtcatacattcatttactcatttatttattaaaaaaaattattctctaataagtattgactgtgtcagacattctctgtgcactggaaatgcagtggagagcagcggagacatgggctcttccttaaaagatttttgaataaactagaggagacggacaattaagtaaataattaatctcaagtttgattattcctctaagagaggaagcatatagtacacatatgcacatgcaatgagatcatattcattagttcaagaaaactgaatggaagtgacatttaaaatgaatcatgcaggatgagtaaatgaaagcaaacgaagttgggagtaagggttgtgtgaaaggaagattcgaggaataaagagcagagtaggattgagggtacaatgacatgcctgagtagctgaataagcatgttccattatacatttattccttccttattcttgtaaacaaactctatattgtaacaattttttatgtttcacttattccataaattctttcagtctgccttctagtgccaacactctatttaaacacaaaagttatctgtgcccacaaaatagtgaaattcactagtattttctcccatgcttattcctttaatgtgatctgtgtagcagagtgcctggtgtgtaaaacttgattaaaagaaacagctggctgggcgtggtggctaacacctgtaaccccagcactttgggaggctgaggcaggcggatcatgaggtcagagtttgagaccagcctggccaacatggtgaaatcccatctctactataaatacaaaaaattagccaggcatggtggcgcacacctgtagtcccagctactctggaggctgagacagaagaattgcttgaacccggcaggcagaggtggcagtgaaccaagatagcgccattgtactccagcctgggcaatagagcgagactccgtctcaaaaaaaaagaaaaaaaacacacacacaaaaacaaaaaaacccaaaaacaaacaacaaaaaaacccccagctatacaagtctcctagatctcttcctataaaagtggagcagaaactccctttttatcagattgtttgttattcaaagaggaacttaaggagttcctgttttaatattagtattagtattagcattattactgtgcctattgctcagggaaaagtttgctgaaattttttgccttcattaaattccttggcagacaattaataccaggacaacaagtggatatattggctttcaaaattatcatgataaaatgtgtaaatgatgaaatctgattaaatggttaaaatagaaatcaattggcttgcattttattttttccccacatcagcactgtatttcagaggcatcactttaaaacaatttttatttcagttcttttcctagttcctgctagagctctcaatagaattcttatgcctctttcccataatttattaacaatatacaatacagtaattccctactaaagtatgtcaagtttgatccagttacaacatctttacctcctctccttcctctcaaatttgatagatatatcagttttttaacaatttgttacatttgaaaatttaaataatatgttcatgcttctatttcttttcccatcaacttttgactttacatcttggttttgtttttgtatttcttgtttttgaggttttagagaccttctgcttcctccacatctcttcccatttttcttcttgctaatatgggcaatataccacattggtaacatctatactgtgttctgtaagataatgaactgttcaataattgcatttaggtaaattctaaaagttgagaaatctactaaccacattactaacattaatatacatttatatggatcttcatataacctagtttcatgctgattacatttccttctttacactttcaacacctcaataattcaggcggtatttttctgccttttctttagcatgtttggatactttcaaggccatacccttgcttaaattctgttttatgtttatctgcctcatttaggattttaccttcccttcagagatacagatagtaggttaggtgttaatgtctatatactttttctagttaagagcactgagtctcttctggaaaatccaggagctgttctgtgctctgagatcctactaaaagtcctgtaccaaggtgaaatcaattatgtggaatcttaagtttgcctattccgtcagatcacataaaaccttggaaaagagcaagccatccctgactgacctatttctggtgagatcgtgtcctggctaagtaggactttcagattcaaaagttcagtgtttttgttttgttttcctttatgtgctatggactattaatgcattcttcagtccaccactctccaatttaaggatgttattgagaagtcttagcattttatcacatcaactccttgtctgaacgctaattccaaaatgatagtttcagcattaacagcccagaaatattatatcagattcttccctttcttttctgagttactaattttcatgttttagggtgtgaggttttagtcttttccttagtctgcttctgtgtgaattttagctgatatattacgatgtattttcaaaaatataatttggcattagagtgtgaagaaatcattttctagctcaaagaaaaaccgtggcctacgtggagacctgaaccagcaaagtgatcattgcaatattggttaaagtttgttttcagtggcagtattctatttcagcaaaaaaagaaaggttacctaaaactggagtgcccaggctactgagatggatttctaattttcatttcacctggtattttaaaaagctggcctgtaatttttgtttgagtattgacccagggttcttttagtctttgaagggaaaaaagagttctaaagaaaattgcttgtcctgctaattttgcctggagcatttaatttgagtgttaaatggaatgtgaccttatttgtatcacacccttggtgatgtagtaatactggctctctctatgctatttgtggtagatgaccactaacttgttgcaaattctttctcccttggttttgatacatagtattagatattgtctcccttattttttttttgtcttttttttcttcccatctaaatgcagtaaccctcaataactaggctttaaccctctttatttcttgttgcatactttatctttggcaacttcaaatttccaagatttacactaatttaaggggttttaacgcctcataacaaaaccaactcttacctatatttctctgatttatttctgttaataattgccacaacaactctttttgatcaccatgtttctagttccttgaaaataaaaccttggagacgtctataatttctccctcatccttagttcacattaaagtagacacatatgtgactcttttctgtagccttacatctaattagttgtcaggtctgtttatttcagtatcaatgttttttataaattctcttatttccattctgtcatcggcctaaatcaggctataaaatgttttacttttattatgtaatcacttatgattaaatgtcatctctcatggtatgctttcctcaaactaattctcttctatgtgccccggaaatactatccagcttaataattcaaaggaatagctctgatcatacagcaatactctcctattgagaaattatcactaattgctcttacaatattattttctgaagcattctttcaaaatgggtttcaatagttaaacaagtataaaatctttgtataaatacaattacaaggtttctttactagaaaatttctcagagccttttattcactgggtactggttgttgttttgttttgttttaattattgtagagtaactcgtaatactaatgtttcttggagaacccatgagaggatgtatgcctacagaattgtagcagatttttaacgacaatattttttccagagtgcacagctaaactatatttcccatcatcccttgtatttatataaagtcatgtgactgagttctagccaatagaatgtgaaggagttatatgtgccatttctgagccatgatttttaagaatggtgcaatctccacagtgtttttcccctcggttggtagtatatggataagggtggggccctagaggacaattgcactacaaaataagaggcgacggtctctgagtcactatgtggaggagagctgcctgccaaccagcgacttccatcttagatggttatgagaatgagaaataaacttctattttgttcaagctgttgtatatttcgattctatttgttttaccagctagcacaaccccaatagataaaggtatgaaatttaaattctttagcctggaaatgcaaagttctttacaatatgggcaccaagtatcatttagaactacttctattgaataacaatagcatatattcttatagtgggcccaaactatttattcatgatagtgcttctggttacaacgtctcttttttcatttaaattttttgaaatttagactcagcttagatgttactttctttttttttgagacagagtctcactctgtcacccaggctggagtgcactggtgtgatatcggctcactgcaacctccacctcacaggttcaagcgaatctcttgcctcagcctcccaagtagctgggattacaggtgcgccccaccatgcctggctaatttttgtatttttagtagagacagggtttcaccatgctgaccaggctggtttcgaactgctgacctcaagtgatccacctgtgtcagcctcccaaagtgctgagattatatgcgtgaaccactgcacccagccatagatgttactttattaattctaacataaaaaagaaacatttgttactagtaaactcaaactttggtttagctttattttaaatgagtgaacattgagatcttttcaaagtgtggtcttcagggtcagctattttagaaccacttaaagtgctgtgcagaacctaggtgatccctctccttttctgtgacatcttatggctctaagtctaactccatctccctctctcccttgtagctaaggtctaaggcctgaatatgatttgggttctgctaataaagtgtgtcagtcctctgagcccaagctaagccatcatatcccctgtgacctgcacatacacatccagatggccggttccttccttaactgatgacattccaccacaaaagaagtgaaaatggcctgccttaactgatggcattgtcttgtgaaattccttttcctggttcatcctggctcaaaagctcccctactgagcaccttgtgacccccactcctgcccaccagagaacaacccccctttgactgtaattttcctttatctacccaaattttataaaacagccctacccttatctcccttggctgattctcttttcggagtcatcccgcctgcacccaggtgaaataaacagccttgttgctcacacaaagcctgtttggtggtctcttcacacggacgcgagtgaaatttggtgccgtgactcggatcgggggacctcccttgggagatcaatcccctgtcctcctgctctttgttccgtgagaaagatccacctacgatctctggtccttagaccaaccagcccaaggaacatctcaccaattttaaatccagtaagcggcctctttttactctcttctccaacctctctcacgatccctcaacctctttctcctttcaattttggcgccacacttcaatctctcccttctcttaatttcagttcctttccttttctggtagagatgaaggagacgtgttttatctgtggacccaaaactccggcgctggtcacggacttgggaagacagtcttcccttggtgtttaatcacgcagggacgcctgcctgattattcacccacgtttcagaggtgtctgaccatgtggggatgcctgccttggtccttcacccttagcggcaagtaccgcttttctgaggggcatgaaccccccaacccttctctctgtgtctctaccccttctctgcttttctggggggcaagaagcccccaccccttatctccgtgtctctactctctcttttctctgggcttgcctccttcactatgggcaagcttccgccctccattcccccttagcctgtgttcttaaaaacccaaaacctcttcagctcacacctgacctaaaacctaaatgccttattttcttctgcaatgccgcttgaccccaatacaaactcgagagttgttccaaatagccagaaaatggcactttcaatttttccatcttacaagatctaaataattcttgttgtaaaatgggcaaatggtctgaggtgcctgacatccaggcattcttttacacatcggtcccaccctagtctctgtgcccagtgcaactcatgccaaatcttccttctttccctcccaccggtcccctcagtcccaaccccaagcgtcactgagtctttctaatcttcattttctacagacccatctgacctctcccctcctccccagggcgagctaggtcccaattcttcctcagcctctgctcctccaccctataatccttttatcacctcccctcctcacagctggtccggcttacagtttcattctgtgactagccctccccgacctgcccagcaatttcctcttaaaaaggtggctggacctaaaggcatagtcaagattaatgctcctttttctttatcccaaatcagatagtgttttggctctttttcatcaaatataaaaacccagcccagttcatggctcgtttggcagcaaccctgagatgctttatagccctagaccctaaaaggtcaaaaggccgtcttattctcaatatacattttattaccaaatctgctcccgacattaaataaaactccaaaaattaaattctggccctcaaaccccacaacaggacttaattaaccttgccttcaaggtgtgcaataatagagtagaggcagccaagtagcaacatatttctgagttgcaattctttgcctccactgtgagacaaaccccagccacatctccacacacaagaacttccaaacgcctaaacctcagtggccaagtgttcctccaggcccgcctcccccaggagcttgctacaagtgccagaaatctggctaccaggccaaggaatgcccacagcccagaattcctcttaagccacgtcccatctgtgcgggaccccactgaaaatcagactgttcaactcacctggcagtcattcccagagcctctggaactctggcccaaggctctctgactccttcccagatcttctcggcttagcagctgaagactgacactgcccgatcgcctcggaagccccttagaccatcacggatgccgagcttcgggtaactcttacagtggaaggtaagtctgtccccttcttaatcaatacagaggctacccactccacattaccttcttttcaagggcctgtttcccttaccttcataactgttgtgggtattgacggccaggcttctaaacctcttaaaactccccaactctggagccaacttagacaatactcttttaagcactcttttttagttatccccagctgcccagttcccttattagaccgagacactttaactaaattatctgtttccctgactattcctgggctacagcaacacctcattgccgccttttcccccagttcaaagcctccttcacatcctccctttgtatctccccaccttaacccacaagtataagacacctctactccctccttagcaaccgatcatgcaccccttaccatcccattaaaacctaatcactcttaccccgctcaatgccaatatcccatcccacggcatgctttaaaaggattaaagcctattatcactcacctgctacagcatggccttttaaagcctgtcaactccccttacaattcccccattttacctgtcctaaaaccagacgaggcttacaggttagttcaggatctgcgccttatcaaccaaattgttttgcctatccaccccatggtgccaaacccatatactctcctatcctcaatacctccttccacaacccattattctgttctagatctcaaacatgctttctttactattcccttgcacccttcatcccagcctctcttcgctttcacttggactgaccctgacacccatcaggctcagcaaattacctgggctgtactgcccaaggctttacagacggcccccattacttcaatcaagcccaaatttcttcgtcatctgttacctatctcggcataattctcataaaaacacatgtgctctccctgctgatcgtgtccagctaatctcccaaaccccaatcccttctacaaaacaacaactcctttccttcctaggcatggttagtaaggtcagaattcttacacaagagctgggaccatgccctgtagcctttctgtccaaacaactggaccttactgttttagcctagcccttatgtctgcatgcagcagctgccgctgctttaatacttttaaaggccctaaaaatcacaaagtatgctccactcactctctacagttctcataactttgaaaatctattttcctcatacctgacgcatatactttctgatccccagctgcttcagctatactcactctttgttgagtctcccacaattaccattttttcctggcacggacttcaatccggcctcccacgttattctagataccacacctgaccctcatgactgtatctctctgatccacctgacattcaccccatttccccatatttccttctttcgtgttcctcacccttatcacatttggtttattgatggcagttccaccaggcctaaccgccactcaccagcaaaggcaggctatgctatagtatcttccacatctatcattgaggctactgctctgcccccctccactacctctcagcaagccgaactagttgccttaactcaagccctcactcttgcaaaaggactatgcgtcaatatttatactgactctaaatatgcctttcatatcctgcaccaccatgcaagaggtttcctcactacacaagggtcctctatcattaatccctctttaatgaaaatacttctcaaagctgctttacttccagaggaagctggagtcattcaccacaagggccatcgaaaggcatcagattccattgctctaggcaacacttacgctgataaggtggctagacaagaagctagcattccaacttctgtccctcaccgccagtttttctccttcatatcagtcactcccacctactcccccgctgaaacttccacctatcaatctcttcccacacaaggcaaatggttcttagaccaaggaaagtatctcctagccttagaggcccattgtattctgttgtcatatcataacctcttccatgtaggttacaagccactagcccctctcttagaacctctcatttcctttccattatggaaatctatccttaaggaaaccacttcttagtgttccatctgctattctactacccctcagggattgttcgggcctcctccctttcctacacatcaagctcagggatttgcccctgcccaggactggcaaattgactttactcacatgccccgagtcagaaaactaaaatacttcttagtctgggtagacactttcactggatgggtagaggccttccccacagggtctgagaaggccaccgcggtcatttcttcccttctgtcagacataattccttagtttggacttcccacctctatacagtccgatagcagactggactttattagtcaaatcagccaagcattttttcaggctcttggtattcagtgaaacctttatatcccttacggtcctcagtcttcaggaaaggtagaatggactactggtcttttaaaaacacacctcaccaagctcagccaccaacttaaaaaggactgtacaatacttttaccacttgcccttctcagaattcaggcctgtcctcggaatgctacagggtacagcccatttgagctcctgtatggacactcctttttattaggccccagtctcattccagacaccagactaacttggactgtgccccaaaaaacttgtcatccctactatcttctgtctagtcatactcctattcaccgttctcaactactcatacatgccctgctcttgtttacactgccagtttacactgtttctccaagccagcacagctgatatctcctggtgctatccccaaactgccactcttaactcttaaagtaaataaataatctttgctggcaggactatgctgaatctccttaggcactctctaattagatgtcctgggtcctcccaattcttacacatttaatacctgtttttctccttctcttattctgtttagtttttcaattcatacaaaactgtatccaggccatcatcaataattctaaatgacagatgtttcttctaacaaccccacaatatcaccccttaccacaaaatcttccttcagcttaatctctcccactctaggttcccatgccacccctaatcctgctcaaagcagccctgagaaacatcgcccattatctctccataccacccccaaacattttcaccgtcccaacactttaccactttttcattttatttttcttattaatataagaagacaggaatgtcaggcctctgagcccaacctaagccatcatatcccctgtgacctgcacgtacacatccagatggccggttcctgccttaactgatgacattccaccacaaaacaagtgaaaagggcctgttcttaccttaactgatgacattgtcttgtgaaattccttctcctggctcatcctggctcaaaagctcccctactgagcaccttgtgacccccactcctgcccgccagagaacaacccccctttgactgtaattttcctttacctacccaaatcttataaaacggccctacccttatctcccttggctgactctcttttcggactcagcccgcctgcacccaggtgaaataaacagccttgttgctcacacaaaggctgtttggtggtctcttcacacggacgcgagtgaaaaagtgtacctatataacagagggacaagtaatatttctgttggcttgtgttgatgccaattgacacacatgctgtgaagatcaaacattttggtagtggttgggccctgcattctgctagttcattacccctttcaatgatggtacctgtggtgtggagtggcagcatttgaaccactggattgtcagccactgcaataatatattcttgaaatcacatgtccagtggcagtcccctgattatcactccttaattaattctaagtattttggaaatataattttattaaaatgcctctctgtttaaaatggctagagtcgtttctatgtcctacactaaatctagactggtacaaattcctagattctaccctagactatggaatcagaaaatatgtagatagaaaccttgtatctgtgttttaacaagctcttcatgtgatttacgtattttctaaagtttgagaaccactaacttagatagtccagttttctttactttctctcctatggtatacataaatgagtacagttagcattacagaaaaagagtgaatctgtcagagaaagaccaagacatgacttaggcctctaaaatatgttgacttcttaccatgttttaatagcttaattcttttttgtgcacatgcccatctgagttaaatttaaaaagctcaaaaattccattgttaatgcttttgttgtttgaccttagaagctttgaaaaataatgctgacaaagtcatactagttgtttttttataacaatatatatgatttatcattacatagttttattttaatgtaatccatatcttacagaacaaaacagtaaataatatattttatggattgaattgcgcccctgccaaaaggatatggtaaaatcctaaccactggtacctgtgaatgtggctttctttgaaaataaggtctttgtagatatattcaaattaatataaggtcacagttgattagggtgagccctaatctaatatgactggtgtccttaagggaagagaaaacagagagactcccatgggaagatgcagagacacagacacagagggagggcagccatatgaagatgggagcagatatgggaattgtgctgccacaatgtaaggaatccctggggttacaagaggcagaaggagatgaggaaagatccttctctagagactttggagggcacatggccctgcttgtaccttgattttgggctcctatcctccagaactatgagacaatacatttgttttcagccactcagtttgtagtactttattatggcaacctgagcaaactaatgcaatattcaatgataaaaaaacaaacaaacaaaagcaattttttcatagacgatagcacatgtttcagtatctgaatatctttagtcactaacatttgtttttctacctttctcccttgaatttcatgtaaaattaactacagttcttttcatttcctttatatgtggctgaagaatgttttcattatcttgtctccaggaatgtaataatcaaatatcaacttctcatagttggtaaggatttcaaatttataaggagaataatagaaataattctagagaggctatgaaataataaaatataagaacttgagtcattgaaattaaaattaaaagtgatgaaaggaatatgagttggtatcaatgtagtttttcatatattctatatgtataattaatatgtgttttaaaaataggtatgtcttattagaactcacttttctttaaaaatggaatactttagacagtgtcattacaattaatctttgtattaagtattacacgtttttgctcaatcagttgtgaattgtgttgaaagcgattttcttctttctcaaaaaataaataatatagtgaataatttgtattttaaacatatttaagtggattcaagttatttcttcaataatgtcatcttcagtgatactcagatattctttgtgagtaaagaaagtgttttgttatatttagcaaaactgaaattcatatgggagggccttgaacctgagagtctgtgtatcacacagcagagaaaaaatagtttgagagatgcaatatttttacaatatttttctaaaaatattatctctactatttaaataatattttatgtaaatgttaaataactttgaatattgtagaactttcatggtatgtagtaatatatgcaattccatcaattgtcattgttaagaaatgttgtatattgatttattcacactataattaactttgagaaaagcagaaatgtaaagtgataacactttattgtaaaagaactaaaaaaaaaaaaaaatgcctattgatgtcaggcctctgagcccaagcctgtacgtatacatctagatggcctgaagcaactgaagaatcacaaaagaagtgaaaatgaccagttcctgccttaactgatgacattaccttgtgaaattccttctcctggctcagaagctcccccaatgagcaccttgtgacccccctccccccacccctgcctgccagagaaaaaccccctttgactgtaatttcccacaacctacgcaaatcctatgaaatggccccacctctatctccctttgctgactcttttcagactcagcctcctgcacccaggtgattgaaaattttcattgatagtgagccaagatctcactactgcactccagcctgggcgacagagtgagactccgtctccaaaaaaaaaaaaattttattgctcacacaaagcctgtttggttgtctcctcacagggacacacatgacatttggtgccaaaacctggacaggaagactccttcaggagactggtaccctgtcctcgtcatcactccgtgaggcaatccacctatgaccttgggtcctcagacccaccagcccaaggaacatctcaccaatttcatatcgggtaagcagtcttttcactttcttctccagcctctcttgctacccttcaatctccctgtccttccaattccagttctttttcctctctagtagagacaaaggagacactttgtatccgtggacccaaaactccggcgccagtcatggactcaggaagacagtcttcccttggtgtttaatcactgcagggatgcctgcctgattattcacccacactccactggtgtctgatcactgtggggacacctgccttggtcattcacccacattcccttggtggcaattcaattgtggggatgcctgctttggctgctcacccacattgcagcccagggctgctcaccactccccttctctgtgtctctaccctctcttttctctgggcttgcctccttcactatgggcaaacttccaccctccattcctccttcttctcccttagcctgtgttctcaagaacttaaaacctcttcaactcacacctgacctaaaacctaaacaccttattttcttctgcaatgccgcttgaccccagtacaaactcgacaatggttccaaaaagccagaaaacggcactttcaatttctccatcctataagatctgataattcttgttgtaaaatgggcaaatggtctgagttgcctgacgtccaggcattcttttacacattggtccctccctattctctgctcccaatgtgactagtcccaaatctttcttctttctctcctgtctgttccttcagtctccaccccaagctctgagtcttttgaatcctccttttctacggacccatctgagttctcccctcctccccaggctactcctcgccaggctgagccaggtcccaattcttcctcagcctccacttccccaccctataatccttctatcgcctcccctcatcacacccggtctggcttacagtttcgttccgcgattagccctcccccacctgcccaacaatttcctcttaaaaatgtggctggagctaaaggcatagtcaaggttaatgctcctttttctttattcgagttatttcttcaataatgtcatcttcaatgacattcagatattctttgagagtaaagaaagtattttgtttagcaaaactgaaatttgtatgagagggccttgaacctgagagtttgtgtgtcacacagcagagaaaaaatagtttgagaggtgcaatatttttacaatatttttctagaaatattatccatactatttaaataatttaagtaatcattaataactttgaatattatagaactttcatggtatgcaataatatatgcaattccatcaattgtcattgttaagaaatgttgtatattgatttattcacactataatcaactttgagaaaagcagaaacacaaaatgataacactttactgtaacagaactaaaaaaaaatgcccatcgagacatttttcagcctctatatgacttaccaaaacattagtgtatttagttttctttgtaacatctaactcttttaaagcttatttttaaagtcagaaatgtttgcttcaggaataatttctctccttactctgttttcaggcattatatgtattagtctctcaaaaccttgaaaagagaggtattctgaagaaatatgtcttttctaatatattcatatataattcattttctctcttttatatatccaaatttttattggtataggtttctttaatagggagactatacatatttccaaaaagccttaagaaattaataaaattaaggagaaattactaacaaaatttcaattttcttttaattttttgaaacaatattctacgttaaacctacataaaagtgaatcatagagaattggcataattcatatttttattttgaaatcttttattgaaaaatagaaattgtatatattcaaggcatataatgtgaagatttgatatacatagacgttgtgaaatgattgccacaaccacattagttaacacatcaacttatgctgtacattagcttccccagaatttattcgtcttatatctgaaagtttgtaccttttgggaaacacctctctattttccccatcccttagcccctgacaaacgctgttctttctattcctatgatttcaaattttttagattctacatatatatgagatcaaacagtatttgtctgtctgtgtctggttcatgtcatttagcgtattgctttcctggatcatacatattgccataaatgaaggatttttttctttttgtggatgaataatgtgcattatatgtcctcattttatttatcctttctgccatcgatggacgcttaggttgtttccatatctcggcgattgtgaaaaatgctgccaatgaccacaggagtggaaatatgtgcagatatatgagacactggtttatttatttttgcctatataaccagaattgggattacatggtaattttttaatctttttgaggagctgctacactgctttttacaatggctataccagtttacatttttaccaacattgtataagggttttcttttctccacatcttttcttacctcttgtctttctaataataaccatcctacacaggtgtgagatgatatcttactgtttcagcaattatttttttggacatgagaccaaaagcacaggcaagaaaagcaaaaataaggaagtggaacaactcaaactaaaaaacttttgcacagcaaagaaaacagtaaaattgaaaaagccacctatggaatgagagaaactatttacaaacgatgtatctgctaagcggttaataaccaaaatataaaaggagtacttatgactcaatagcaaaaaccaaataacccaattaaaaacatgatcaaaagaccagaatagacatttttccaaagaaaacatttacatggccaacaggtacatgaaaaggtgctcaatgtcatttcttctttaaatgtctgatagaatttaacaattaagtcatctgagactggtgctttccattttggaagatggttaattattgatacaatttctttaatagatattcaaatagtctatttcttcttgtataagttttatagattgtgtctttaaggaattggtccattttatctatgtgggaatactattgtttataatattcctttattattttaatgtccatgggattaattatgatactctcatttctaatattcataatttatattatttctcttttttgtttgttattttgctgggagatttatcaattttgttggccttttcaaagagttggctttctgtttcatctatttatttcctattttttatttcattggttacttctccagtgaaaaatgatcaagatacatgcagatgaggtagtgagttagtggaagagaaaattattaaagggaaatgataagattgattttctagtttaacaaatgaaatcctatttataacttctccttgctttctaagaagagtagatactgttaattggagagagtttccagagcaatatgattggtgtggggatgtaagtactagataggagctggggaacaactctttgtaataagtagagagaaattcaaagtccctccaacaaaatgcaacataaaaaggagactggagaaagcaaggccaggccacatgctacatgagcaatttgaaggaagttagaatccttggtggcagcatggctacaaagaaatttggagaaaaaaatttttaaaaggatttggagcctgctttgggctgttggaatattctatttcacacaaagttatcaataaattacacagtttactaatgtttaagatagggaacatgccgttgagttgttcatttgtgctataaaacaatttttaaaaacagtactatattttagtcaatgatatatttattgtaagaagtgtttagatgtagagttccactttatgcaacattggactaagtaatgtatacaaaccatccacatttagtttgattaatccacatttggattatagcttattgtttcattgttctatgggactctgatatttacccattttaataaataaatgtgtttttcaagcaagacaaaacaaacatctaacaataaatttaagattcatgagaggctttatcttttcatatgcattacaaaatacatttattgtgattttaagacacctggatacatgcatcttcagcttacaagatttaaaatgcagctgaaaagcaaccaaataattttttctgaaatcaggtatttttttacatgagaaatattggacatatctagaccacattcctcatattccactccatttatctactgacattacccttcctactagaatcttccattttctgaggaacttaatattgttgaggcagatactgtggttaggtttcccaaagccatttataactcctttctcttatcttcctttatacttctgactgagaaggcaaattatttgacctctcagtgtccatcatagctacagatggccatatgacatagttttggccaatgctgtgtagatacaaattctaaaagaggcttttattctcaaataaaaagacaaagttccacaaggataaggtctcttgtactttccttcctagttttggccaacaatataaatatatctagaggagcagcagttgtctggtgacctaaatgttttgatgacaacaggctaaaaattgtggctagtcaactgtaaaccaacagcaagaataatttatctgtgaaattatgtaatcttggatctctatgatgatattcaatatttagtggctaagtcaaaaccttaacatctggtaagtgcaaaaattattataaccctaatatcaaggaaggtactatgctgccattctatattaaaacaaaattaattttagctttggaataattttcctttaagctcaaccctttctaattctaaggcttctgtggttaataactctgccattttactagacaggcctcaaaaaggccagttatatcctagactatggtgaaatgggtgaactctacaaacactgagttctcacagttgaatctacaagggaccatcagttaacttaagggcagtcagtccactggttggccacctatccatggcaaccgagacaagaaatagcaattttccttcttagacatttaactagtttgatgaaaatgaaaacaagttagcaatgagaatgtaagctaagaagaagtcataggtagaaagtcaggactataagggattacaacaaatcataatttctaaaaagctgaaattctgcttcagtggaaaaattaatagtagaggttgagatatcctatcataaatttacccaaagaaggactacaaatttagctgagcctcatcaatggtggagcatggagtgaaaattttagagtcagtatttccatagattccagttttattcaggtttcatatttctctcagttcatgttgttcagctttgattgttcagtattttataaatttgcatgtccatacgtgtaatttaagattcttttggttacaaatgacttatgtaaaaatatgaatttatcgtggtacacttaggcctattatatattccattccatcaaagagttgggccaccagacaggggaaaagcaaaattttataaaactttccttaatatgctaacattaatataacacaggtcctgcaaaaccagtctatcatttagtttaaaattatttattcataggaaaaaatatttgattagtctaccttttttaggtgtaccattgatgattccttgggaagaacaaagatgtggggagtgacacccatgttaaaagagggtagtttttggagtagatggactggaaagagaatttagtatgtatgcaccacaatgttgattcttacaacttctaaattatttgagatacgttgacaagtttttttgttatttgcaaataaaagagtcaaactaccctcagcattaaatttgaggcatttacacatggtggcaataatacatcttcatatttttcaaggagttatgaaatccagaggctctccaacctgtagtctcaactgcccaatcagatttccaacttgaagattccaagaattccagagcatgttatgagtggctgaatatctggtcccaagtgaggtagctgcatgctaggctagtatgtttagataatttttctatgaactttgttaagctaattttatttgtaaataaccaagcaaaaatcatagctttttccttagaatgacagaacgagagaattatctacacatttccttatagctctaatcatcatttaattcctaacccttaattccttgagcaaattcatgcaaaatccccattctatttagttggtctcaatacctgcattttcgaaaatcttaccaggcttgttcttgagtatttaatggaatgatctgctctaggtctgtatgtactaagaagtctagatatttctcagatgcaaacacagctacttcctcggcttattgggaaggcatcttatgtgatctgtaaataaaattcaaaacgtattagaatgattaaaggagttttctttaagtaaccgaagaaaataagtttaagtaaagtgcactttgcctcataacaatgttagtaatattttataccttgttatctcattagtatgtcttatcaatgctttaaactattaattctttgttgagaggtatgtaagcagaaagtgaaattttgtaaaccctagaagaaaaattccaaagctcaaacatatgtataaaaggaaaatttattttgcttttaacatttgttatattttagaatgccaaatgctgattcggttagtcattaaaagccagaaagcttggcacgtggctcacgcctgtaatcccagcccttagggaggctgaggggggcagatcacaaggtcaggagtttgatagcagcctggccaacatggcaaaaccccgtctctactaaaagcatacagaattagctgggcatactggcaggtgcctgtgatcccagctacttgggaggctgaggcaggagaatcatttgaacccaggaggcggaggttagtgagccgagatctcgccattgcactccagtctgggcaacaggacgagactccatctcaaaaaaaaaagtcagaaaaagtgtgttctggagttagcagatctgggaatgactatgcaaatacaaagacattccaaaagagatataagccaggggttgcattcaactgagtcaaccttttcgacatgattttattgaaagatgactcaactagttattgctaagacaataacatggacagtttcccatgaagattggtgtgatactgtttggaatagagacacattaactaacttttcattagtataaagagaaaaacaaaatgcagcaaatgttctggtaagaggaattttatttctggaatattaattaaatagcagagtaatgattagaatgaagggacaactgataaagtagttcaaaataatcccttcattatggcagtttactttagaataatacgttgggtatacagctttatggaaacaaaataaacagttctcgataacataaaattatgacattaattcactgtaaaggcctcttgtagcttggaagtttataagaaagttaaacagttttcagtagtgcaggtttgtgtagataatttaataaagtagaaataatcttaagaaaaatgctttatgtatttattacaaactaaattaattaatgaaaatctttcctttagaacatttctgttgaccaatattttatctaccacattttggaacttgctctcctgtatgtattaataataaatccactgtatgaagccctgattccaagtgtggcaatatatgagttccctaatataaaggcaaagctgggattatattaaatttcgtttttgaagttattgttataagacagaatgaaacttttgtaatatttatttttctcatttagtcatttagaaataagaatttatagagttttaattttgtaatagatccaaattcttgattataattaattttcagcaataagattcacttctatttgaagtgattaaaataaaagcttctttattaagattacaaaccttaatagattcaagtactagatatgtttatttggatttgtttctaaggaattaaatgtcactgagagaacaaaggtttttttgttgttgttgttgttgttttgttttttacatacttgccacagttgagcagaacccgctaaatgaactccattaccaatgttactaatgttattttgggtactgattttaggtgattataaaataaaacagtttagagaatgtttacactattatttcctttacataattcatcttattcaaattgataattgtcctttctaacaagaaattaaattgtgcagatattattgttagaaatattggtatcgttacttacctatccacaatatcaaacatcaaaaaataataaaaccgagcacaaaaaaggcatacacattgaaaagagagaaatacagccatctttatgtatagatgaataattgtctatgcaaataatcctaataaatctacaaaaagaaaacacaaacaaataccaacctccttgaactaataagtgagttaagcaagggtgcatgttaccagatcaacatacaaagtcaatccactcctatatactggttatgagtatgtgtgaaacatttacgattgctccactgaaaatgaaaacttagttacaaatctaataaaatatgtaaagaatcctcatgctaaaattttaaaatgataatgatagaaaatttaaaaaatctaaataaacgacataataagagacatcctatattcatggattggaacatattaaatgtgtcacttcaccgaaaattggtctgtaggcttaatgcagtccttattaaaatcctagtgagttttatttagacatagacatagacaaaagcattataaaatttatatggaaaagcaaagaaactagagtagttaaaaacagttttgaaaaaggttaataaagtgggaggaatcattgtatctgctacaattgaatattactcagcaaaagaacaaactattgatcaccatgacacctttgatggatctcaaaggaattatgcggagtgaaaagagccagtctcaaaagtaacatgctgtaaaattacatttacatagtattcctgaaatgccaatattatagaaatggaaaatagaccagtgcttgacagaggtcaggatcaggagaggaagaaggtggctgtggctataacagtgtaacctgagggagctctctgatggtgttgcatgtgatggtgttggacacaaatatacacatgcaaacaattacatagaactaaatatatatgtgcccagaaatgattgaatataaaacaagtggaatctattcagtgggttttagtaatgttaatttcctgcttgtgatacgataatatagttatgcaagatgttgccactggggaacactgcatgaaggctatggagtatgctcatgctctgtattatttcttataactacatataaacctacaattctctgaaaagaaaaagtttttaaaaagagaccaggtgcagtggctcacacctgtaatttcagcactttgggaggccggggcgggtggatcatgaggtcaggagtttgagaacagctgaccaacatggtgaaaccccgtctctactaaaaatacaagaattagccaggcgtggtggcgcacacctgtaatcccagctactcaggaggctgaggcaggagaatcccttgaacccgggaggcggaggttgtagtgggctgagatcgcaccattgcgctccagcctgggcgacagagcaagactccgtctcaaaaaaaaaaaaaaaaaaagtaagaaaaagtaagaaaacattgttaatgaaatgtattttgtaaaatatgaggtccagcatggatgctattttttgcctttaatattttagttaaaaggtcctgggccgggcgcggtggctcacacctgtaatcccagcactttgggaggcagaggcaggcagatcacgaggtcaggagatcgagaccatcctggctaacacagtgaaacccattctctactaaaaatacaaaaaattagccaggcgtggtggcactcacctgtagtcccagctacttgggaggctgaggcaggagaatggcgtgaacctgggaggcggagcttgcagtgagccgagatggcgccactgcactacagcctggacaaaagagcgagactccgtctcaaaaaaaaaaaaaagtcctctaagagcagatgatattggaaaaggatttttaatagggcaaattctattatagcaatgttaaactccatctatttctagaatgaactatgcgatatcctcatttattattaagattagattatctctggcgatcacttaactatgttttcatgagtatgctgtagcctttctgataaatctgaccaaacctaagtattttatccattgctccttaaagtgggtgatctccacaggtagtttattatgtttgattgttattataatagatttcattctttatcctgttaaagttttaggtacctcacttgcccccaggtactttgatagaaatggatttcatgacagtcatatatgtattatggttatgttctcatttcattagtatttgttctatacatgtgatacagatttcccccactgtaaaacaacggagtaagaataggtattgtgtactttctttttactctttggtgaaatttaaattggtctaaaggaatgcccacattatttaatttgaaaaattttacatgttcaaatatcccttaaaatagaaagttatttaagcttacaaggttaaaataggtatttatttttccagttgcaaaattatatttagaaaatagtaaagaaaaatcactcttaagccactcattcagaaaaaaactgctgttcaccagcatggcacatgtatacatatgtaactaacctgcacaatgtgcacatgtaccctaaaacttaaagtataattaatttaaaaaaaaacaaaaaaaaaaacagaaagagaaattccagagcacaaaaaaaaaacacaaaaaaacattctaaagattaccttaatatattttacaatacttacatagtgtatgttaagtgtatgttttatgccatgtgttttatgcaccatgtatgtgtcttatgcatatgtgttttatatatacacatgtatatatgtgttttatatgtgtgttttatatatacactttatatatatacatatatctatgtatgagattttaaaaatataaatatatatatacagtagagacaaagtgtacagacattatacttgaaaatttagccctgccttaaataattaataatatactattgtttataacataaacaatatgttataaacaatagtatattattaaatattttatgattttgataaatagatcagtataaaatgatttttaggggtgtaattaatatgaaaatagcatgtatctaactaaaataattagaaatttacatggtgcccaagtgtttgctactttaaagaatattctaaggcataccattgtttatgtattcattatacagatttataagtgaaaatatttatttggaagattgttttgaattgatgcattttcttatgctttataaatactctaatattaggctgggcatggtggctcacgcctctaatcccagcaatttgggaggctgagggggtgggtcatttgaggtcaggagtttgagaccagcctgaccaacatggtgaaaccccgtctctattaaaaatacaaaaattagctgggcgtggtggcgcatgcttataatcccagctacatggaaggctgaggtaggagaatcgcttgaacctgggagatggaggttgcagtgaaccaagattccaccactgcactccagcctgggcaacagagtgagactccatctccaaaaacagaaaacaaacaaacaaaaccccccaaatactctaatattaaaacatttcaaaatctttatgttagagaattaatacatctgattataaatatattaaagtcacttttctttgtgccaaatatcttgcacaggccatggcaaagtcatgagatgatagtgaataaatgaataaatgaatgaatgaagcactcctgtctacctcattgagttctatactttcagatggctagcccttatctttaggcctcaatttcctaacacatttacaccagctctccagtccatcatttaagttagctttgcctctagtatttagtttcttctttactagtggttttctaccccacttgtatatggcttctgttattgtagcctttcagctactagtttgggataaaaaggtgatccttaaaaatacatttgaaagataacaaacataaaaccttgagaatatgtttggccaccaaatacattcttaagttccaatattttaaaattcagaacatttttacatatcaaaagactacatagaaagtaaaatttcacattgcaagcaaactttttcagtacattgcaagataaattactgcagtaaatgttagtgactcagtttcgttgttaaaatatgacaaggtaatagttgcacatgtaaatgtgaaaagattttctttcaaggtctgaaaaaaggaaataattttattcacattagttcccttcctgtttttactaccatcatttcaattcagggcttgtttctgcacaggatagagtaatggcctcctgttttccttccgttcccatttattccaccctgtgcaagactgtgaagttattctttctaaaatagaaccctgataatttaacccacctgctaaaaacaaacaaaatgaaaacagctaataactcttcactgactacagttcaaacttgtcaggctgaatttaaggcactcaatgatctggattcctccacctgcttctccagattcatttctcgttattcttttccatggatgctgcacttctgccaatctggacaccttgatgttcccttcacatattttgcatggtcctgctttatacttcttactctgtgttatttttaccttctttcgatttcttgatttccaccttttcttaaaattccgcctcattcgtaaagcttaccatcagctagctaccatttatgattgcttattgttttcgtgaatgttcattatagtttagtatattttgccttcaactaacaaacaacaaagtcaaataataagaaaattatacaaattatactttgtataaagtattttattactgtatctatcaaggaaaccactgtattgtaagcaccttgaagtcaggttttgtgctttgctttgttttgttttcctgctttgtgttctctcacctccaccgctcttataactatcatattatattgcacaaagtatatgtagagtaagtgtttgagaaattgaatagagccaccagaaatagttaaattgagctatttcagtttgcgtcggaataagggctaacattttctttctcagtatagtggtttactaaatttaaaatgtgttgtgaattttaaagtttggtaggtgacatgtctctgaacagagcactgtggccttgggttcacattggcatttggagctggctaaacctacacatgccagagtgtactttcccgcctgctgttccagctgaggctttaatgttggacttttaagctgagccaaacaggtaggggaaacgattgccagctatctgatactgtagagatttaggccagatggaaacttgctttaaaaatcaaaccagtttcagtcataccaacatgagctttcttggatgtctgctttggagacattatgttattatcatcatcatcatcatcatcatcatcatcattattactaaagtcagaagtcactaaaatattgtattacattttcaaaaatacctgggaggtggatacaagaatgtcatggtaaaaatactgatcctggactagaaggagtagaaaataataattgtaacttgtgttattttccctcaatgatctaaaatctggaggtgaaattctttaaaagtacatcataaaggcagctaggagaactgatgtggtagctccaaatggctattttgttagaggtagtaaaactttttcaatgtaagtgaaatgatccagcaatcagttcctccaggacttttcctgaatgtttacttttaaagaacatttataccttctgtagaatgtaaagggaggatggacacatgatactcagaatagtcaagtcactttacaagaaaaaagacaagaagcaggctgataggaagtatgaaaatactgggaagtccttaatggtcagacaatataaattacgaaaaccacagatagctgatacccagccattcaacagaacccattaagacatgattatggagtcatagtcaaggactcagtttgactgaatgggagctttataaatttttaaactactatcttcttaattattgcattagcctacttgaatgtgagagaaattatctttttcttatcacaaacatctactgggaaaacacctgctaaatttcaatagtctgcaattttaatgtaccataatgtagtactattatgtccaacaatgactgtttcctcttatgcagttatgcagatgttgcaataaatgatcaacattggactatactgtgtctaatgtccaagagtaatagaagtaaagacagtcgatactccttaattatgaagcaagctgtttaaaatttcaagacatttctgatcaaccacataaggcaaacttccaatttattactcctgcattttgaatcagaactctggagcaattcaatgcaagaagaaaactatctggattttctcccttctccccatatcttttaaatttatgcataattataattatcttcctcctttagtgtcttcattaataaattaccacaaatgttatttcaattttcaacatttgctaataaaaaagacagttttagttcagagagagtataactgctcattatataaacaggattatatttaatacgcaataatgttctttgttattgataacaattactcagagatcctgtaagcataatgaactctgtaagtaagagtggattgttttattctctcaggaacttaaattcattcatttattttctcatcattaagtatttattttgtagctattatatgtcaggcattatctcagatgatagaaaaacaaggaagattaatactgaattcttatctctcaggagcttaccatctcaaataaggtggcaatcatgttaataaagtctgtatgagggagaaggaagccaaaggaaagagtttaagagttttgacagcatttaagagacacaaataaatagagtcagttttcttttttatgctgttttttttcccccacacttaaaaaaaaattctcacatccgtttcacaacttcttgacttgagaaaactctacagcagttttatggaagcatttatgaggagctgaaagggtacagtgtaggatttcacatgtggggatacacagagtggaataaatatatttcatgggctatacctcagagttgcaagaaaactaatgtaaagttattaatgctagaaaaattcaaaatatattaagcaaaatacctattaacttacaataggacctttttttttgtagccaccagaatactagatgctccctcctacccctcaaatcactgtgctcctaaaaatagagcatctgaaaggccaacttggcaatgaggtgaacagatacagtgaatatggaaatatcagggagaggtgagcagtcattaggtatattttatccaggcaacaactaaactttatatattgtttatgcctcagaatagaagattcttctttaatgttcttcatttattctttgttagaagaataaatttctgttcatgatatacagatttacatttcttatggacacaggttaaaataatagatcatacaatctctggcttcttttttctaattaatactggatccttcttcccagtatcttgtgctcttgaagaacatagcagatatgttcataaagagtctatatggaaaagaatgaggccaaagtaatgaattttaatgagaaagtttcgtacaaacaaataatagtactgttctgatgaaccttcttatcgtaacatatttttttcttcagacaggttgcaatataactgctactgattataaacattatccatttctagaattgattaagctacagcattgttcttttgttatgattaggctaaagctggtgataactgagactgctttagttactctgatggaagttttctctttacctattttctctctgttcttttagggtgaatcatttccgtaagtggcttattacatttggtagcaattattcttgatttcatttttcagtttgtcaaagttctaggaataccttactttgttaaataggttttatgacaatcatgtcttttatattgacactgctctcatttcatttacactttatgcatgcagtgtgcatatgcataccatagtggaactagctttagttggaggacattttgcatgctttcctgctgttcgttggcacaatttaaattggtacattaactaaagagtaggcattggagtaagtgttatttgagtgacatggcatctaataaactctgaattgcttatagtagatgtaagggcaatgcctgcttctgcccttaacacactgtcaaaacttgggcaagttcctgcaattgtccacgtttaagtatttttgtctgtaaaagagcctaacttgtctccaagctacctctggatagctaccttctagtatctcagaggtcatttagagcagtaataatgtataaaaatgtcctgtggtgggagaaatatttgaaatatttattctatataaagattataaaaattcaagggggcaggggaaatgcataaggaagaacaaagccaattaaaaatccccctgttaaccactttatgagtgttagagtaaataagtaccagagctccactgagataaacaggaaggacaaggaaattttcagaaagctcacacacacacacacacacacacacacacacagagagagagagagagactgagagagtaagagagacaagctgtccataagtaatgatcttctaacaaagaataaatgaagaacaggccagtgatgattagtacataatattcagcaaatgagaaatgattggaaaattttcttctgctcatgtgggatacagcagcttagaacatactactgctcttcatgccttctctgagaagatgattaagggcctggtaatgtttagtcacacaaatttatccccaaaaggttacctgccaacatactaataatgatttctccattggataatccacaaaactatggtaaaaatttatgaaatactcttcctttgttctgaggcgaaaagaagtgaatggacaagcacactatatgccactgctttacaaataaattgcctttcattttaagtgactggatatcgtaagtgatagatttagacataatttatagtagagagaactaggaagacttttttttttttttactcttggattctgttgagttctagaagtattaggtagaagcattcatggatttcctggagagacaacagctatgggactcccaacttaaccagagatatgagtgacgggaagacgcaaaggtcaggccgagcatagatacatacaaggtataaaaatgaagaaaaacttcttggtgttttggctctttggggtagtttcttgggtagggcttctaccaccacagctctggttgaactttaggccctatgtgtcagctgttctctctgcttttacctttctactgcttactcagtgaacattccagaatagcaatatactgttacatttggataaatattttatccaaagtacaaaatggaatgaatatactactaaacactggcgttaggttattaaatttataacatgttttaaaaattatactacaacaaataactcatttaagacatctattgtctgaagaaaagtcttcaattgtaaggtcaaaatcattttgtttaatgcaaagaaatctagtcatgatcagagataaatgtaaagtcatacaagagaaaacaattgtttactcagcttttgttcaaattatcttatgggttttattacagtaatttgtatacagaacatttatagatttgacttagaacagacttctccatacattcaaaaaatgtacaattccactaaaacttgtattggtcaactttatccctaattagaagaaaagtagtgaaatatacaataattctaatattatttctgctctctagattgtgttagtctctaatattgagtgaggtcatcagtgtttgaggtttacaatatacagaatggaacagatgacatgatacttgaataggcattggtttaaaaaaaataatatattagtgtttgagaatatgtttccaaaggaatgtgtaccaaaatgtgtttctagagtggaaaatccctcagttggtcactctatatttagaaatatatttgacaatgtttttgtcagtaatgctttgactcaagctgagtcaaaattcgtttcatttttagaggacatgaagaacaaaataaatatagctgattacataaagcagggtttccctagtccagaaagcctaaggattacagagaggctgataattgtctacactgtgtgtgcacctgcactgaggagagaaaggtgtgaatataacaagtgcctgggtattatacaataactgaaaacccatgtccaggtaaagagaaatccaaataaacatctggatcggtttacatgcagacatgctgctaatataagtaagtttctatcgtttatcaactgagagttaaaagtagctattaacatttggatacattcataagatttagaccttgttatccctcgaattagtcatattggtaaagtgaaagcataaacattttatggctttctcttatatctttgattgaatgagatagaaaataagtgttataagatgtatagagtaagtctatgagaagggtagcacaagtccctgcaattctcccttttacaacttagcaactacctgatccaaggcatcactgttctccactggagcactgcatttgccacctgattgtaggctccctccatcaatgactccttctactccatactccagacagcagcaagggtgagactccttgagtggaagagtgaagccctccataaatccatttcaaaaagaaacaaaaatactggcaaaattgtcagaatcagaactctgctcctacttcatagaaagctatggcaaaagggcctttgtagatgtgattaaggtaagtaccttaaaatgaagagaatatcctagattatgcaacataatcatgagtctctaaaagtagagaacctttctgggctctggtcaaagaaatgtgacagtagaagaaagacatgaagatatgcaaactcactgctgaatttgaagatggaggaagaggaccatgagccaagtaatgtatactgcctctgagaatcaggggaaagatgcaaagaaatggattttcccctagggccttcaggaaagaatgtggccctgctgacaccttcattgtagccaagtgagactgctgatagacttctgaaatgcagaactgtaagataacacatctgtcgcttttaaacctgataaatttctggtaatttgtcatggcagcaatagaaattgaatatattcatgtaaccacctttgacttctttacctctgtctgatttattcttcagatatctaataatttgctttaaagcactttcttcaattcatttttcaggtagccttgcctcagtgagaccctccctagccattgtgtctaaagttgtaaccccttcacttccaccccaaacagtttctaggctgatattctgttttatttgtctctttagcactaatctctattcctaatatatgatgtatttactttattaattttgtttactgcctgtctccacttctagaaggtagctccatgagagtagcattttcatccctttttttcttcacaactttacctccagcatgtagacatgagtctactatgttgtattcttaaactatgtttaatgaataaatgagtgtaaagtagatgtagctgctttttcatgagacaagccatacttatatactcatttacttatagtttttgtcagtctcttctggggtgttagattcataagtgcataataatttgtcgtcttctcagctacaagtgtctcaaatgagaattactttaaaataccagaggaagagactctttaaaatgctaatattctctttataaaaatacaaacatgcacaaccattggaatatagttttcagataattcatggacacgctgaagcccattcttaagatccatactggtgtatctattagaaacatataattcctaccatagtgaacattgtaaatgcgtggcatcacttttgagaacttgaaaataaaatccttattacaactgataattgaacacagggttaaatgaatattaatagatctgtgagacatggaaagccctcttttcacaaacataaagaaatgtatgtgtgcattgaccaaggaaataagagaatcatttttgccttatatgaatgctaaaaccattttaatagtttttcttttcctgatggtagtttaataaagctttctttttataaattaacacttatctctgtacttttttcacttactaaataaattgaaatgcataaaatgttatagaaaatatactcacttgaaaatgtcattattgtctaattatgaaataaaattgaaaaatattttgtaacttccagcagtaattaaaatttttgctacatatcagacaacagacagaccaatggcacctacaactttatcaaattttaaaagctcaatagaaaagtctgtgaaatatgtaaatttgcttagatttgcttccttacagacaaaaattcataggacaacagtaatttgaatgtaagaaaaatggtaaaaattaatttatccacagttattatttaattcttactaaagtcaattaaaagagtcacaattccctcactgaacgatatttgctatctgtttaaacatatgagaagagatactaatgcatacacaaagtgcagtttacagctatccctgaagatatcttagtaaaaagactcttggctgcatatatccaatagttattaattctactattgttacccacattagccagacattatagtgccttctctctgacatgacactgtgtcaggcactttacatatataaagtgaatattattagtccccattttacagatcagaaactggagcttatttagttttaaaaatgtgtccaaatttatatagctgggagtggtagagctgagatttaagagctactgtccttaccactctcttattgccaggacctcctggttatttccacagatgacttctattgtttttctccttagttgatcttgttataatggactttgtcttctaaactgcttttcttagattacatttttcccatttggtattaatcagacataaaccagagccaatcaaggcttctgatgagcatgacttcaagggtgctgatatgttatcattggttacaatccaaaagatttgatattgtaatcattgtgtgtgtgcagtgttttttaggacaagtataccttcccttgggcttttccaaataatggagcctgagagtccccactactttcatggcccccttgatgtgtagaaacctcaggcttgtaatacccaaactatcacaaatgctaaatgtaatcaatgttgcttttatgctatggatttggagtctaagagacaaaaacctcccacccaactgttacaaccctgtccaaccctcaagttattatttctgtgcttgccatgtatcagaccctgggctaaatattaggactataataatcagcacatgagatccctgttatcaggacgcttaaacacaaatgtgggtgagagtctcaaatcaaatatgacacaaaatatacaattgtacatacttatgtaccattaaggaacgatctcagacagtagacaatataggtacctaccctaatctgtcagttcagctaagtcttccctaaacaggataagttaactgagggtgcagggaaatccaggagagggactggcagtctcaagttctgaggctggagcagactttgacatctgagaaagtgaaaaaagagcagcatagctaaaatacagaaagcaaaggggaaagtggcataagatgaagtaagagaggtcagaagggccttataggctagtttaagataaatctaatttaaagcaagagcaatagaaagccacagaatggttttacacagggcaatgacctaatcatatttgcatttttataaaaacaccatttccttgtctttgaaaatgtggtgtgttttttttttttccgagtagataaaaagagaatttgaccaaaaacatttgatcgaacacaacccagtcactttaagacaaaggagagtattggttagtgagtattaatcactcctaccattggttggttcaaaatgaatttcaacttttaacattccagaaaaatgtgaataaacatgtccttgtaaatttgcataattacaagtatattccaagtatcatgagagaatttctaatttaagtacaatgccatctatgtttggtactgcatttctgagtaggatgttttttgcacatttcccataatgaatttcagagctttggttgagatcttgttctcgtattgttttccagtcatatgataacatcactgaaagttttactcatcaggaaaatatgttgcactatttgaagaggcagagggacaaggatagacatgaacatatcctgatgcaatcattaatttttctttcaagaaacccttgtttaatattgaatatgtatcaacagggtgagatgaaaaaagaatagttcttcctctttctctttctccttatactcttgtttttcttattcagaaaggaaaggacaaacatggttccttagaagaaactgtaattttattccaaaacatttcatatcatctaaaattgtgaaaactatcaccagaagcaagaaatacttggtagattttgccagtctaatgaattaattcactgtgaagtttatggttatattaattttatgtatgaaaaaaaggaggtttgaagatcattaattagtgcataattcaaaagaggaaaggttgtagggccagtgctcaccccttatgagtatctactgaaaagctgtgtgcctaacaaaagcttgagtgtcaagggactccaggtgaagacagtctcaggtgagtccagacaagtaattctcagccctggatgcatattagagtcatcaggaagttttataacataccagcagtggggatggtcaatatataagcttctctgggtttgaccaagagaatcactaactttaagactctccccatacttccaaaaatgcagttagatttgagaatccctggttcagacaaggattctttattttaattcaatcttcctctaccttcatcacctcacttttccaattgttttatttcctgtagtcattatttcctttaaagctaaaccttacagaagttttggacaaagaaacaaaggagagagaacaattcgttggatgctgagtgctattatttacaattctttttcaaaagctttattaaagtataactaatatacaaaaaatgcaaatatttactgtacacatttggatttcacctttttttgttgttcaacctattgtcactagacttgccatctcaccctggattactgaaactttcttccagtttctttatttctctcattaatattatatattaactatgcagttatattcaagtagacttttacctgccagtgtactggtaaaaaaaaaaaaaaacagcatggtttaaatttgtgtactgcaactgcttctctgctttcaaaacctgtccttatatattttatactgtcactattgccccagtgtcacagactcagctccaaccttcctgctcattcttatcatggaggatttccttttatgcttccttccctgttgccttgatgggcctatcatcctcatttgcctttctctttctaaaacccctctcaattcctatcttctctatgaagctgctattattgcagcccacactgactgcttcctttttggaggtactaattttgtgtattacatcacaagaattagaactttattgttttctaatagttttataaatattgggcccttcatactttgttttatactttttgacagcagaaatcaagttgtatatttttaagttatgtcctccacatcttctttgaacttccaaactccataaatacttaatgctaataaatataatccatgcccttttgtaatgcatcgtacttattcatgtaactttttctggagtcctaaaatcttccttagggatacttctgtgtttgtctcattcttgcatacttctaagggtattttcattatactatattgtaatggtctatttgtccacttcctatatctgctagattgtgtgctttttgtggacggaagaaatgtcttatgtgttccctgtcactttaatgagttgcttttcttatgtccttgcaatgattcacgtatgcattcctctatataccttcatcatcttctacgtcttccatcacaacacttaatataaatacaactttaacatctctttcacacaatacattgtaacacaatgcttctcaaccaaggatgtttttgaaccctgggggacatttggtaaagcctggagacatgttttgtagtcaaaactgagattctattgtcatctaatgagtagaaaccagggatgctgctaagtgttctttaatgcacaggacagagcctccccattacaaataattatcccacccaaaatatcagtagtgacaacactgataaattttggtgtaaactcagggaacaagcactatgttcatggatatatggctagcactcagaactattcctgccacataatagatattcaagaacacttgtgtaattgaacaatgaagcctaagcagctcaactgagtcctctgaaaaaaatagcataccatgcttattttatccctccatcaatccatccattgattcacatgtacatgttgatcacttcccatgtgtgacgcaggccaggcatgggatgaggcaataggtatgcattggagactatatatatttgtgtgtttgtgtgtgtgtgtatgtcttacactcaaagttcttctatataataataaatacagataagaggcaatttcacaacactgtatgtacactgataatgggttttctgaggccagcacaaaagaagatcatcaaattcaaacttggggatcaccaagggttgagttttaaagccaagatttgcaggataaataaaagttaacaaaaaggggaactagagaaagactatacacaaaggattagaggcaaaaagtctttccatattcctagaattgtaagcaattggggataggtcaagtacagaatacaacagaatcctaaaaaaatgaaagatttggaaggataagaagtttggactttttatatgattagaatcatataattctaatagcattatacaattttaagcagttattataaaataacatatatgtaaggtattactgttatttttgttcttactgctaatgtcattactagtctttgaaaaaagattggggagaggacaagaaaattgaaaataatataaaaattcttaatgacatttatttaaaatgaaatattcagtcatccttaaataatgttaagtgtcattttactttgtctgtttctcttctacttctgtattttatgcagttatgtctatttttaaagaaaactggagctgcctataatgctttattggacaaataatacttcactgtgaaacctttccccaaccacagcctccacgagagcatccaacaatgaaaaatggtaagtatgataatctaatctaatttgattatatcttatcaatggaggtggaagtcaaaaatagaggtaggtgctgcaggattcaggtagtagaatgaaaagtttaaggcaggagttatttacaaaggctctgctgattctttctaggtcactgtaaaagaaaaagatgagcttttctttaaagtccagaagtggaaactacaagatggaaaagtgttctgatcctttttttgaggactttcatttaatttcatttctggtgttatgaaagctgaccgtttcatttctggtgttataaaatctgctgtccctagcagttttacccttctgttggttttccaccttcctaactcatattttcagatggacaaaaatgcaatcatacattactttttgcataccacttcaaagtttaccaaatgttttgatctgcattttcttagcaaaatgttagagggttggttttcaccaagtttcacttactcaccatcttattttctttagtatagaacttcacattgtgaaaaagagagaaaaagaagatcagtgcaattcaaataatcagcaattactcaggaattcttacctttatcaaagtactcattgccaaaaattatatttggtttttaattatgtatataaaaatacataacaggatttagtcataaggacagctttttattatttgccccatcttttggccttcatgatgggcatacttttaaaactaagagctcaaaacaaatttgtttttctatctgttcatcaataagataatctatcattcatatgtatctgttaagacaggtgaggcctgtagcattattttttaagcaagaaataaattattttggttttaagtgaaaatacttcatgctagtaatgaaacaaagcaaataaattgtgagtggtattttcttagtgaaatgggagtatttttctgattaattatttggaatctgtaatagagaaacatattgttttgaaaaataattgcacaggtgaaagcaataacaaaatcttcattagaaaggcaaggggaactagcagcagaggaaaactaaagaaattcattgtgcttgagactaacctatttaagaaggagaaattgctgacacatctcttcaagaggatcatatctcatatatttggaggatgaaagaatttgcagctaaaggaattagctttaggctgtatttaaatctcacaaacagtctcaatgccatgtgtacaattgcaatatcttgtccaaagtacatatttttttcccaatttttgagaatacaattttatactttgagtataattttctcttttatgtattttttcaaataaactttatattttagaaaaaatgttgatatacagaaaagttgtgctattagtccacagtgtaggattctcatatacccacactgtttccccacttgttaaaattttatattagcatcttaattttgttgcaattgatgaaatgacattgatacatttttattgactaaagtccatactctttattcagattcccttagtttcaaacctaatgtcctttttctttttccagaatcatatccgggataccacaatacatttagttgtcatgtctccttgtctccttaggtgctgcttgactgtgacagtttcttttctttttctttttgtttgtttgtcgagatggagtcttgctctgttgcccaggctggagtggagtgcagtggcacaatttcagctcactgcaacctctgcctcccaggttcaagcaattctcctgcctcagcctcccaagtagctggggttacaggcaccaaccaccatgcccagctaattttaaaaatatttttagcagagatggggtttcaccatgttggtctcaaactcctgacctcaggtgatctgccgccttggcctcccaaagtgctgggattacaggtgtgagccactgcacctggccgatggtgacaatttcttatactttccttgttgttgatggctttaacagttttgaagagtataagtgaggtattttgtagaatgtctttcaatttggatttcgctgatgttttccttatgattagattggggcttgtggatttgggggatgaagaccacacaggtaaaataccatttttgtcatagcgtagcaaaggtatatactatcattgtgacttactttgaacacctggttgaggtagtgtttgtcaagtttgtccattgttaagcttttctttgtttctctctttccattctgttccttttggaaagaagtcactatacacagcccatacttaagtgaaaattacactttattttcttgagggcagaatgtctagataaattattgggaattcttctgtatgggagatttctattcatccaaaataaaaaattattcaatcatttatttgtatcagtagggactcaggtgtttatttactactatgggttataatccaatactacttcatttattttcttgctcaaattgctttagccattgacagctctttcagttggctcttgtgttcctttggcataatcccatcatcgtgtttaaattttttctttgtaaatttttgagcacttctttactttatggcaatataaggtaccataatctcatttttaagttttctgcccctgttgtagaaccagccatttctccaaagagcctggttgcttttgcttttattggagaatggtgttagaaaccaaactctaggcatgaggggttctcatggctactagagtgttgttgcctccagcctttctcagctgacagaacaaaggaatacatgtgtatatacatgtagctataaatatatatataaaccatctgtgtattaagctaaacatattaataagtctgtagtaatgtcttcaattccagtccattaccacataaatcgttctaccctcttctctttgcttacttgtaatcttctgctctaaaagtgaaacacctggcttctatcatctaccatttatttactaattgttcaattttagtatatatgtatagttctgtcattgtttaacacatacccccgtgaagattaaatctgtcagctcacatattatccatatatacaatttattttgcctttagccatacagattccagttatatgcaaagtttttcagttcagcacttttttctccacccctttcagtggggttctttcatatatttgtaatacagtcagattgttttatcacagcctacattccatcctacaatactttgacctcctaaatattttctaaaatttgcatacattaagattctaacttctcaggtagcctgcaggtttttttcttttctttaatttgttacccatatagttctgtttatccagagtggttttttcccactcactgtttacttagcaagatcctattcattcttcaggtcacacttatttcagtattttagaaaagggtttccttgacacatcactataaaatacttcttttttaggtccttccatatattcctggcatttttctagattttttttcttctatacactgctaaatgaaaatttccattccaattatacacaaaaatacaaatgaaaagctatacattttcttttaaatattcactttaaactttgaagttgttgcccaaccttactatctgtttatctattttaactcagagtgagggcttctcagtgttacaaaatccaattatttctctatttgttaaatctttttgaaattttgatcaccaagaccagtaaatgcttctgggaatactatccaaggctacgtttgtatacaaaaaagtcaagataaaatattcagtcaagaggtccagtgaacttttttcagagattttatgtactaagtttaatggtttaaaaataaaacattagcacttgacagaattacatcactacaaataaaaggaagaaatcactttctttggcttttagatcaagctaataggttttagtaatacttatgaatcttattcttctgattttaactttgagatttttcccttacttttttatgagaagaaagactacatttaatgcagcagcaagaggagggatatatcctgaatctgagtgataaaatcacatccataaaattcaagactgctgatgtagggacaaagtttatctcaccccttccatttcatagtcacattttgtgtccagttttgtatagcatctctccttcaaatgtgatggggtagtctgatgttaacttcagccgcatatgatgaagatagattcctctcatgatttttccaatctttttcctacttgtagaacatcccactaattagatgaaaaagtgttgttttgctgacaactcaaggaaggacagaaagtgattttcaatgcatctcactttgattggcatacacatttggtggtaaaatcttgttgctttttttatggttccccctagattctcttcccatgtcaccctcagcactgtcttagatgtcatttactctagaactatttctgttactatcacttcacaagatagtttttcaatactgttctttttaaacatgccccttcaatataccctcgtttctactgtcaaaagtattctagcatgagttatttttaacatattacaaccaccctaacacctggaagtttatctctagcttcccatttcactatacattcagttccagcttcttattttaagatcaaagtcctgctaccaaatgatatgtatttcttcccctttactttctatttccaaacaattttctgaacctatttccaggaaacctattgtcactttttctctactctcattttgaatttttcccataccaaaacaatgtcatatgcctggggttatgttcctgtaaacacaaccagagtccctgaatctttatctttctctctctctcagtctctttttccctctctcagtctctttctccttcctgaaatagtgtctaacatttcacctatttcagaaaacctttctagattgattacaaaatctttctagattgatggatggaggggtcctcctgaattggaaggatgttcaaatattggtgtttaaaaatccacacatttgtacattacagtagctttctacctttttgtcattgttttaaattgtggcctaggaaataggaaacatatttttattactcttgtatgataacttgccaagtttaggcatgattttgcatttttggacatgctattaaggttatcattgcttcattgtgaatgcatctattcacagtgtaagaggaaattttccattgtgagttatcatttaatggtgatatgaatacaacgatttaagcttcttaaacattttaaaataagatgtgtatactatgaaaatgtcatttggtttcaaatctttgtcttatctttggtgtcttattgattagaaggtcaaaataggactcgtaaatttacgtatcatatattagcttaattacatgtttctaatgtacaatctgctggattttattggcagggtatatcacaacttttaatgagccacatcttgcaccagtccacactttgaaacagaaagaaagcaagtaattaaatcaggtttcctacatttaaacacattggactgattagatactttggtttaattttctgggaaaagatagaaagttttaaattgaattagttatttacattgtgtttttcatttatgtgaagggtaaatttattatggatattaaaaagaaacttagcatgtctttgcctttaagcaaaatatatgaatgtttgcatcatatagaaattgactgcatatgtgcatgtatgtgtatttttaaaattattgaattccccagatatttaattaaaaatgcatatacatttatatattcattagattctcaaagagggtctgatcagaaaaaattcacaataatatatttattttagtcacttattttccttttttactacttaataattttaataaagtggtaagtcacctagttattaaaaaacaatattttgcatttgtatacaaatgtataaaataatatctgtatactatcaccatatttatttattttcttaaaatttatttggtggaagatgaggtaaaaatgcatgtgtaaactgtacatttatagtttacatatatattgtttgtaagttcatcaagatatttatatatatatatatggggttaaaatgttaataatgcagtctaaacttaaaaatgtgtaagttctgtagattttacaatgtaaatagaatatttaaaatggaagggatatttttccagtattcaaaactattgcccaattaagcaaagtagtcattcacattactgacaaacacagaaaaatattagcccaaactgttcatcattactgaaaaaaataacacagaatacatgttttattgatatgaataacttattactccaaaattactgctctaaaataatacttgtttcctttttaagtctttctgtatatcaactgctctttatatgtgatctacttttatatttacgtgtaattatatatgtacttacacatttaaagacaattcacacatttaaagagccatcttcttcccagttccactgaccattattaagatttttaagtttttacttacataattattgactgctttctttactgtattatcttggttgggttctctactgaaacatacactccaagtacatatcgcttttctaccagatcgtcttcaggctagagttgggaaattccttaaagaaccaaaaaagcaaacacacacacattcacactgaacagtatttgtaactgtgatatttatttaaaaattcacaatagtccataggaatgatttataattcatttggtgtattaaaattttatttaaccttcaacaggtgaaactcaagcttcgaaatgtagaaatctgtagtgaacatgtttcaactgaggataatttggagcagggccagtggggattttattttatggtggtggcaagagaggagagtctggtggcaggcaatgagtatccagctgtgttggcaaagttcaaatattcgcagccccagtggtgatagctgtgagcgtccatctggacaatggccaagtgctatgcaatctgtgtttggctctggacaccgctttgtattccagccttcctactggttctctcgtttccctatgacattcctacatttatgcataggttaactaaggtcagaatttggtttacttttttcatttaatatcaaaaaacattgatttgattaattgctatattttcacatttagggcaactaacatcccatgccagatgagagttttctcttatattggccactactattctgcctctcaagattcctattcattctcctttctgtcatataaaaattaattttaaattaaacaatgggatcttgaactgaatatggagattcattgggattctatatctgtgagatataaaagcatagtgagtctctggacaatgaaacacctttgccatatatggttatccaaaggaaggggcaatattattttccaagctgtaccaaaaacatatgttcttctctaaaaaagagaatagttagaatcaacattttgattgacaactaggcataaaaggagttagttctgtattaaagtctttctgttctttagtacagctcaacttttaaaaactttataatatcctcatcatataactatttcatgtccactgttctaaatattaatgacattgaaaactaaccatttgtgataaacaaatgtttcctgagacaaaagagactttactactattacataaaagtttagtgagcatttgcaaatcgtcaactatattcaagataatactcctgtttatgttcagattcaaataatcaatccttttaactagtaaattaggcattttgttccaattatttgtttagtttaaacagctgcaagtctttaataaaataattatttgtaataggaacctgatgagctggaatatcagaatgtgccattattagttgtagacattaactctctttttgtctaataagtaagggagtggacttattctcttaacagagagagcttgatgactggatgaaatgtcgaatttccattttcaaatgagcagtttctaaggtaggaaaaaaatattgcacaatctaaccatattctttggtattaaacacatctcctgagaacattgagagaaaagaccatatttgctaaaaatgtataattcaaagctgggaatgttcattaaatagagttaaggatattatccccaggtagaaggagcaaataagaacatggatgagagaaaagcctggattctgcagtaaaatagaaggaggacaatcccagagggaaagaaataatagctatgttttaattgctcaggggacagtggttagtggggtctgtaggtgactttggattggagatttcatttgacccggaccctgatggaaataggtaatagtaattaacactttaacactttgcagtggttacaatgggctaggtattattctatgatatagctagatgatagatagatagatagatagatagatagatagatagatagatacacacacatacatgtgtatgtatgtgtgtatacatacatgtgtatatatgtgtatatatatatacacatccatatatgtgtgtgtgtgtatatatatatatatatatatatgtccagtcacttaatgctcacaacaattctatgagtttggtcctattagtattcttaatatacaaatgaagaaattaaggtaacaagacattaagaaacttacacaagaacatacagctccaacagctagtcatatagactggcttcagcaccagtacctttcattctacagcccattctcagatcaattgctctacccgcagctctgctaaaggggtggactttacaggtaatgtttctgaattattaaactctgcttctgtttcatgccttgagagggaggtaaggaggtgaacaaagaatagtaatttggagctttgtgcaaatattcaagctgagccagtgagattccctcttatgagtgggaattaaagaatgcacagagagtaggccagtgagcagcagagattgcagctcaattgtcatggtatagagaagaatctgaagaggccctggtggccatgggcagaaaataaaaataggctcaggaatctggctggcagagaaagaattgagagaacacagtagagcaatggggagccagagacaccatgagagagaagtagacagagcagctcatcccattccaggcagcatgtgtctttataattaatacaagagagaatttgagagtatatatgtttctgtgtaactcttatcattagttatatcgttgggagcaactgggagttttcaaacagaaggataaagtgatctggcagatgatacagtataaaaagacagcagaggatgcagattggaaagggaaaaactaagagcaagatgttcactatagaaggttatggctatagttgagataaaagagtaatttcattaaaaatggatcagaaaatgattatgaagacttatctgacttcgttctcatgccaacttattcattcactcatttgctcatagattcctagaaataagttcttgacaaactattctcctcttgtctttctcgttataagcactatccttaaagtcaacaaatttcaaatttttttgtcaacatacatttactactatgccagtttctgggaacactaagataaacatctaagttcttatcttcagtgagtacatacactgtctagtgaagatgtatagactattaacaaacaggaacagattattcatagaaggggcaacattcccaaactaacaaaatgtggaaaacttttaaaaggagatgatactgaattagaagctggaggataagttgtctaacattctgaaattcgttgacttcgaggatagtgcttataatgagaaaaacagcaggagaaaagtttatcaagaatttctttctaggaatctatgtgaaaatttgttgagatgggggaggtagatgacgtggaacaccaataaactattttcttaacttttcttttatttatttatttattattattatactttaagttttagggtacatgtgcacaatgtgcaggttagttacatatgtatacatgtgccatgctggtgtgctgcacccactaactcatcatctagcattaggtatatctcccaatgccatccctcccccctccccccaccccacaacagtccccatagtgtgatgttccccttcctgtgtccatgtgttctcattgttcaattccaacctatgagtgagaatatgtggtgtttggttttttgtccttgcgacagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatagctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcagttctctgatggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagataagtaggttgcaaaaattttctccaattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatgactagccagttttcccagcaccatttattaaacagggaatcctttccccattgcttgtttttgtcaggtttgtcaaagatcagatagttgtagatatgtggcgttatttctgagggctctattctgttccattgatctatatctctgttttggtaccagtaccatgctgttttggttactgtagccttgtagtatagtttgaagtcaggtagtgtgatgcctccagctttgttcttttggcttaggattgacttggcgatgtgggctctttgttggttccctatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatatgcaaacagggacaatttgacttcctcttttcctaattgaataccctttatttccttctcctgcctgattgccctggccagaacttccaacactatgttgaataggagtagtgagagagggcatccctgtcttgtgccagttttcaaagggaatgcttccagtttttgcccattcagtatgatattggctgtgggtttgtcatagatagctcttattattttgaaatatgtcccatcaatacctgatttattgagagtttttagcatgaagggttgttgaattttgtcaaaggccttttctgcatctattgagataatcatatggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattgtcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccattccgtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttataagtcttgctagcggtctatcaattttgttgatcctttcaaaaaaccagctcctggattcattaattttttgaagggttttttgtgtctctatttcctttagttctgctctgattttagttaattcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatttatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgctttttttgttttccatttgcttggtagatcttcctccatccttttattttgagcctatgtgtgtctctgcacgtgagatgggtttcccgaatacagcacactgatgggtcttgactctttatccaatttgccagtctgtgtcttttaattggagcatttagtccatttacatttaaagttaatattgttatgtatgaatttgatcctgtcattatgatgttagctggttattttgcttgttagttgatgcagtttcttcctagtctggatggtctttacattttggcatgattttgcagcggctggtaccggttgttcctttccatgtttagtgcttccttcaggagctcttgtaaggcaggcctggtggtgacaaaatctctcagcatctgcttgtctgtaaggtattttatttctccttcacttatgaagcttagtttggctggatatgaaattctgggttgaaaattcttttctttaagaatgttgaagattggcccccactctcttctggcttgtagggtttctgccgagagatccactggaagtctgatgggcttccctttgagtgtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcgtcggctcctgaggcttctgcattcttcacgtagttctcgagccttggttttcagctccatcagctcctttaagcacttctctgtattggttattctagttatacattcttctaaatttttttcaaagttttcagcttctttgcctttggtttgaatgtcctcccatagctcagagtaatttgatcgtctgaagccttcttctctcagctcctcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaagagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccgggtctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgggcttcctggctgctttgtttacctaagcaagcctgggcaatggcgggcgcccctcccccagcctcgctgccgccttgcagtttgatctcagactgctgtgctagcaatcagcgagattccatgggcgtaggaccctccgagccaggtgtgagatataatctcgtggttcgccgttttttaagccggtctgaaaagcgcaatattcgggtgggagtgacccgattttccaggtgcgtccgtcacccctttctttgactcggaaagggaactccctgacccctcgcgcttcccaagtgaggcaatgcctcgccctgcttcggctcgcgcacggtgcgcgcacccactgacctgcacccactgtctggcactccctagtgagatgaacccggtacctcagatggtaatgcagaaatcacccgtcttctgcgtcgctcatctttaattttcatattaagttttcatatgaagttgtcctttctgacaataattagccaatagttttatttgtttttatatttattcttgctttttgataataaataaaaccagcaatatgtaatacttgtgttgtctacttattataggatattagtctaaaatagattgtggattttttagatatgttaaaaccaatggtagagctaatttattcactataccatataataaaaacattttatctgccagaaacttctttgtctgtggcttagaggaatattatagtacaggctttgttgatacaataatagcatatgatctgtagcaagattgtatatgctggaacacagtcagaatctatttgtggaatcaaggcaggatcaatgagctcagcaaagagcttattctattattagtcattttcttgataagatgagagagaggttagacacagtggtggcataattgtgtctaaaatctacttgcttctcatgaaagattttaaattgagtgatttattctaataagctgtaaagaaagaagcttaaatataaatatgaaggtgagataactcataaaagtataatctacggagatgagtgtttattttcatgaaaataaattagactatattttgagactatcttaaaactgctagactactttaaggatgactggaattcgtctttcagaggaagatagaaaaaattataatggtaagagttccttcatttggccatttcagattaaggagattatgcattttacagtagataaagttgttggaatctaaaaatataagaaattcagggagatcttccaaaaaccataaatttgaggggaatacttcactaatacagcagttttcattgttagaatttccaaatggaacatttgctctggagacagaatccaaagattccctttcaaatctattatgttagaatttgttttaattattttgaattgcttaaaaattactttaaaatcattttattcagtttcataatgttttcttcttgatatttaagctttatgatagtttaaggagcttatgaaaacatggatacatttggaattaagtatgacataaggaattatctaattcagcattaacttaggtaaatttgggatcttcagttcatttgccaaaggatgtgtactcctctaaggtaaatgaaaaaccaatgtccaggcaacagaaatatgctacattatccagatatacctctgagttagctacttttggaggattaacaaatttttttcaccttttggggagagaggatatgtgagaatttgttagttttataaaggtgttagcatatttcagctaagaaaatggtggagtctccatagtaacttctgttttaggcaaagattatatttaaaatatttcacataatgtcctgaggaatcagaaagctcacactgagcgaagagttcatagacagtgatctgggctacaaacagacctcagaaatattgcagattcagttctagaccactgcaataaagtgaacattgcaataaagaaatccacacaaattttttggttttccagtgcatataaaagttatgcttacccggccgggcgcggtggctcatgcctgtaatcccagcacttcgggaggccaaggcgggcagatcacgaggccaggagatcaagaccatcctggctaacacggtgaaaccccgtctctactaaaaatacaaaaaaattagctgggcgtggtggcgggcgcctgtagtcccagctactcgggaggctgaggcaggagaatggcgtgaacccgggaggtggagcttgcagtgagccaagatcgcaccactgcactccagcctgggcaacagagcgagactccatctcaaaaaaaaaaaaaaaaaaaaaaaaaagttatgcttaccctatactatagtttttaaagtatgcaataccattatatctagaacacaaaagtacatatcttaattaaaaatattttattgttataaaatgctatcaatcatctgagctttcagtatcatactctttttgctggcagagggttttgcttttatgttgatggttgctgactgatcagggtgctggttgctgaaggttggtgtggctgtggaaacttaaaatagcacattgaaatttgccaggtcaattaggttcttattttcatgaaagatttctttctggtacatgatgctgtttgacagcattttacccacagtagaacttcttttaaaattagagtcagtcctctcaaaccctgctactgctttatcaaacaaatttatagaacatactaaattccttgttgttattttaacaatgttcacagcatcttcactgggagtagagctatccaaagaaaccactttctttgctcattcataagaagcaactcttcatccattcaaggtgaacacttagagacacgaaatgagcatatgctgttggaaaaatggtaggggtagatgtgctcaacaaagtcttcccacaagaagcacaataaaacaaggtaggcctgtaatgccctgtagtatgaccctggcttgctttcttgcatcaatattgcaattttaaaactaaaacaattttaagaaagcattctaagagataacatctcagttttcttcgtggatcttaccttcttgaggcaatggtaggagtaaccctgagctatatagattccaagaggcagaggaactgatggagggacccttaaggaatctagaaactccatggagagtattattttgttgctagaaactgcagtgtgtttgtgattttcaaccacaaacacatgctgtctgggctcaggacctcagaggtaggtgtaggaaactttaataatatattaaactactttggagagctccagaatccttccacttattcagtttctgatatgagtcaagaatacaactgaggctgggcacggtgggtcacacctgtaatcccagcactttgggaggccgaggcggcggatcacgaggtcaggagatcgagaccatactggctaacacggtgaaaccccgtctctactaaaaatacaaaaaattagccgggcgaggtggcgggcgcctgtagtcctagctattcgggaggctgaggcaagggaatggcgtgaaccccagggggcggagcctgcagtgagccgagatcacgccactgcactccagcctgggcgacagcgagactctgtctcaaaaaaaaaaaaaaaaaaaaaaaaatacaactgagccaggttctggggttttgaacttggagtaggggagacaaataactaaaaagcactattgttctcatggggtatcctctttagagcctctttttttcagcgtcccccaatttatatggctactaatattgtttggttctgcgtccccacccaaatctcatgttgaattgtaatcctcacgtgtcagtggaggggcctggtgggaggtgattggatcctgggggcagatttcccccatgttgttctcgtgatagtgagttctcacgagatttggtggtttaaaagtgtggcacttcccccttcactcgcttgcactctctcctgctcccacatgtgaagatgtgctcacttccccttcaccttctgccataattgtaagtttcctgaggcctccccagccatgcagactttgagtcaattaaacatattttctttatgaattacccagtctcaggtagttattcatagctgtgtgagaatgaactaatacagctactcttccatatcctgtggttcctgcattaataatccttctctcagaagaaaagaacccagaactccctatccctcacctcaccccttgcattagaacacatggaatgaagctggggcctaagagtaggttaatagagagcacactgctgcacctgcttccaatcaacaggcacgtgagactcctaactccttataggttgtctctctcagctcaccagaatttccggagcccaagagctgtgctcgtttagactgaaggagaaaaagcaggaattagggttatgactaaaatccctttttatatgagatattaaaggaatgtcatcttttctcttttttctcttattttaccccagatagttaacataaacctttctgctctgacaaagatttactactctgataagtgcattttacttttaatctaaaatgtttcttaatgaaataactgactagtgtcagaatgaagacactttaggttttattgctatatcttgatttatctacttctagctgtgacattgattgatgtttataaaatccctaagcctctactggcaactatgctctttatcttagagcatataatcaaagaggtgtgggtaaaattacgtaggaagaaaaaatttcttgactttaaagaaaaaattgtgttaataatggcgatttatatgcaagggaaacatttgagcaaacagaatttttttctctgatgttttaaaccccaaactttgttttaatattttttccttttgctttctagcctgccagttggctacgtgggtatatcttagtatccatgttattgttagcacaatcatagatcactatttgattgactctgttattccacatggcaatagctgtgtgattgtagccttgtattaagaatctagtcattttatattcttagaagttctgagataaagcattgaaaggtcggctaagcatcaatcatttaaaaagttgatagttgcattagtggtattcttaatagagtgttcttttgaagacacacttgtgatcatataccacctagatattaaaagcacagctattggataaatgtactgacaatgaaattccaacagctataaaaatataagccccttatcaacagccaaataaactaaattatgttctcggttaggtcatttgttttcctgttcattcattccagaatttggagccaagtatctgaataacattgcaacagagccatacaattatagtcagtaataacattcttaagataattaggtgaaaatctatttgtggtaagttgtaacaaagcataattatactgaattttaggataggtagaatataaacttaaagttttctattctctttcaaattgatgtgataacaaataggagaggcaacttgaagttctggtttatagttaggacctgtttgccagttaagcctggacttgagttatgccctggttgtaaactccctcctctccaagcctcatttaaaagtattggagtaactctgggaagtcctgtgaaaaactgggcaaagcgatgaactctgatccatacttacttctgataaccaggttaccccaagatggtcagaatattctgctcttcaacgagaaaaatacctagtttctatcgaataataatcacttgataactattggttctatattcatttccacttttccttattctgaggacttatttctttacttcaatttagctctggaaagagaaggaagagccatcttaaattaccactcttggcaacttttctggacaattaataactacatggtaaatttcaaatgccatacatcaagaatcctgaaaactggagctaacccaaagtcctgtagtttggactctggaggccactaagataactgatggtgttacttttataaaactccctctcaagcagccagtcatgaatcaggaagatgggaatgtcaggctaccaggacgttcaagtctgccagattaccagataagttgagccataaagaggaaaaaaatccacacattaggggatagaaaagatagtttataagccaggaacatgtaaaaccacagatgatatcgacaacttctcagagagtggtagcagaaaactacatgttgttagagtcaggaaattgttggagatatgaaaaggaggcagaacagtacagcatagaataaattttgcaggtagttatttgcctgcattttatattctttttattttttctgcagtcttctgtacttcctataggatgccaattgtgtatgctcccagattctatgggatatctcattttgctagactgccaggatttgaatcttggcatggcaaattattagttgtataacccctattcaagagtcttaaatagttttatatagaaacttaaggtactttgtttccttctctgtgaaatgggtaaaatgataatgtgtccctcatagagtaattataggtgttaagtgaataattaatcaggtaaataatttggaatagtgcctggctcatcataagtttccaataagtggtggctatcattaatatttattattgctgttaatagctccactaaaggataggtattcattgacacatcatgaattaatattaaaaatgtttaccagtcctgtattatttaccaaaaatattgttttgcttactctgtaatgatgaaagtgatcaccattaagaaaatttggtgattcatttaaaaagtatttattgagtatctattaagaaatacattatgaaaaatgtggaaggaagattttaaaaaatgaataaataagaaacaatgctcaaagacattatttcttgcaatttaagagccaatcattattattttaaacaaaagctactagtgagaagtgttctataaaataaatacagagaaactttctttcagatagtgtaatatcagaaaaacaagtttcataacaaggagggtatattctcaaaaatgtatagatttttccgatttatgttgtgcaaaatatttcacagatttcaagatttgtattttgtcagtttctaggggtcgcttaataatgatgtggattcattaaggagaaatcaaagtcacccatagaggtaagttaaaagtcttaaaaataagtcctatgagaaaagctaaaagattgagattattgagttggaagaactgatactatagtatgaattaaaaagtaagcaaagattccttcaacagagatgatagccagtcgttgacttcactgaggattcaacaagaaatcagaccttgaacagggatctgtacataaaaaaagttcagtgagcaaagtaagttcactgacagcagtatggaggatttgggtcatatctctgacagtgatttcttttaaacactgaagagactggaagtactttcagcttagaactgataaattcatcaacaattagaatgtttacagttggcaataactaaaaagccagcttgaacttgcccaatttactggctcttgtaacagaagcagatcatgcaaagcctgatctagtggctcaatgatgtcactaaaagcctcatttctatctctgtgatttaccttaaaagatactggcttcattttaggtggagaccaatgcttctagggctacagttttgtctagttatactcagggtagaaggaaacaggaaaaagaagtcttgattggattaacccaagtaacttgctccaaaaatggagctgagaagattcagtttcccttctccaatagaaagaaacctagaacccttaggaaagagttagagtcaatgccaacaaaatactaacaaatgctccaaccaggtcctattatgcagaaatgaattttaatttttgttcagtagttttagtaaaattgtatgtaatttaaaaaagagaattagataaacccctactcttgctgcaaaggtatattaatgtactctatgattgaactctaaacctgtgacaagctaaagggtttaatggaaatctgaaagatactatcaggagacctggggtctagccctgtctccagtacttgctaatagtcaaaattcaccaagtcatctattttttcattccattctaaaatgaatatcagcttttgccttttctccttaccaaatagtatttatcaagtgaggtaatacatgagaaatactttgtaaactatatcattctatctaaaattaagaaatattgttgttctaactaaacattagaattttgccattgtctagtctaaagattaccttgaaatgtattttttaagagcttgctgcactaataatatagcttgtcaaggttttatttcctatgagttgttggagacattcacttccataaatgaactccacatgtagttactaaatgtattgtgctactgttagttttttaaataaatttataattattaataaaaaccacactggccgggcgcggtggctcacgcttgtaatcccagcactttgggaggccgaggcgggcggatcacgaggtcagcatcaagaccatcctggctaacacggtgaagccctatctgtactaaaaatacaaaaaattagccgggcatggtggcgggtgcccgtggtcccagctactcgggaagctgaggcaggagaatggcgcgaacccaggaggcggggctagcagctggccgagatcgtgccactgcactccagcctgagcaacagagcaagactccgtctcaaaaaaatgaaaataaaaataaataaataaaaaataaaaaccacactgtatatttcctctttagaagggattttagtgcctattcttgcatcttgttactttcgttctttgtgttaggtttaaaatatagcacaatgggaaaggttagaggtaggactcttcttcaataaaggtttttccataattcagagcttaagaaatgaaccagtgtcattgtctaactgaagttcaataccaaataattcacagaaaggtaatgagccattttagactgctatttgaatacaatctagttatataaagccatataatttgtattacaatatatttccatcatttcaaattttagtttgaaaaatttgctttttaaaatcattttaggcattataatttataaagtattaatttaaaggattattcttagaactgttactggattattcttagaactgttactggcagttgttaaaaatggaccaagcctagatttctatttgtctctgcttacctatgccccattacctcaatatcttatccccccaattcaggtgatgttaaaaatatgtcctttatattatgcaattatgctttaaaaagttagaaattattatgtttctatttgacattcaccactctgtattagctcatttcaaaaagacaaatgctagaattcattccttctttatgccttaacctttatttttaaatgtgcaagatattgtactaaatgagtgtagatattaaattttataagaatcattcctacctttctggctttcaaatcagcatagatataagacacaattattttcaagatatgtgataagagtggtagcaagcacaggggaagtgaggacaaactctgaggaagcaggcattgtttccatttttaacacatgagaaagagctcttgcagacagtagatgtttatctgggcagattcatatgtggcaatctgagtggaaagtgtattctcaactgagaggaggttatgagcaccttcagaggcaggaagatatgttgaatgtcggtgtggactcaccaactggtcaccagctggtttaatttggccttcagggatattttgtttgttctcaatcataattaaaattctttagaattattgccaacattaaaaagcaggaaagttctctgtttccagtttcttatgaaaacgtgaagatttatctacattccatattctgacattcttacagcctcacacaacaattatttagagctgagaagctgctgcttcactcaaagggagaaatcacctttcttctctaaaacaaagggtttcttctttcatttaggttacttgattcagttctgtaattgacttagttgtccctagccaggattacaaggttaattctgtgtgatggagtctgatgtctttgttttagaaagtatttgaacttgtaaaatatattgaaaataatatatgttccatgaagaaaaatatcttgaattcattgctatatggagattaaagatgaagttttctttagatttaattgaatttgtattttaatttatattgtgttcattaacactaataatcaaaatggaaccttgtttttttaagctccattgttaaacataatttaattagtcagaaaacatttttaggatgtcaacaattttagatttgagataatatttaaccagtttggtacatttcatactcttgattggttgaccaaatatgtgtttaatgtgaagatattgggtaagctatgcttttataatccaaaatttgaatgttataaaaggaaaatggggagtttcacatatcttcaaatattttcacgccaaaacaaaacgaaatgaaacaaaaataccactatttttctcttatttctcagcatcaggagaccagaaagaaatttagacacaattaatctctttcaggattaaaaaaaaaatagaaaagaaaacaaactgtggggagttggcctgcatttgatcgattttgtcttgtggatagactctgacgagattatcttgcctgctgtttctttaaatgtgcaacagtgaaggatcatgaagagcagcatgggctaaatctaatggattggtaaccaaatgttaactccacagacatgattaataaatatttaacgggtaaaaataagtgaatgtaataatacattgaagccaataagttctactgctggcttagagattatcaagacagagtttaagtaaaaatgttctactcagtattctttcctttttttctccttcctttcttcctttcctttcttttaaatatttgtagaaaattaagtttctctgtaattctcatagttaatgtagggcagtgtttgttttgtttgtttttgtttttgttttgagacggagtctcgctccatcgcccaggccggagtgcagtggcgccatctcagctcactgcgacctccacctcccgggttcaagcgattctcctgcctcagcttcctgagtagctgggattacaggtgcccaccaccacgtccggctaatttttgtattttttttttttttttttttttgagacggagtttcactcttgttgcccagactggagtgcaatggcgcgatctcagctcacagcaacctccgcctcccaggttcaagccattctcctgcctcagcctccggagtagctgggattacaggcatgcaccaccatgcccggctaattttgtatttttagtagagacgggtttctccatgttggtcaggctggtgtcgaactctggacctcaggtgatccgcccgccttggcctcccaaagtgctgggattacaggcgtgagccaccgcgcctggcctgtatttttaatacggaaagaatttcaccatgttggccaggcttgtctcgaactcctgaccccaagggatctgcccaccttggcctcctaaagtgttgcaattacaggcgtgagccaccgcaccgggccagggcagtgttttacatactactcttacaaaaccaaatttgctttaattagaaactaaacctttcatcttacaatatgtaagttaagttcttctaaagttcaaatgtgtatttagatcttgattttcacatgtatttgatgtgtaatctcaggaacaactacttagaataaatttcaaattagtaatatataataatcaactctgcaattagtaatttgtttagctatttataactcataatgtactgtaactcacaatattagctgttcttttcaatgcttaaccagaaaaagtagttatttattctaaataaataagccccttttttagtataaaattcaatgccatgcagatgtcactgcctactcttaagttgttccacgattctcataaattatgtatttaatttgcccaccaggtcattgttgagatgttctctgtaattagtgaagatatttaatatccttagattttttcaatgttgaaaaagctattatttagtattttctgtgtgtcagatatttttctaatcattttacatgaattacttttaaaataatctctaaaactttatgattaatttacctttactaactatgtacatggggaaaaagaaacatggagaatttaacttgtttgatagggacaaacagtaagtagtggaacaggatttaattccaggtgatcttcacctctaaattctgctagtgcagactagaatgatctcctcaatcgtatgctagtgtagatgaggttgacatgctttttctttctcagaagtactaaaaatccaaatgttatgctgagctaactctgcaaagcaatttttaatattctctgtccttaacagtggtgtgtgaaggactcataatacacgtcttttctgatgtgccctctgctacgggttagcaggaaatgttagattattctagaaataggtcacagttgaaagcaataaagaaacattctttagttctaaattatgcctattgccataactgaggcgcaagagaggacaagacacttgaccacagccagataagtaataagtggtggaccactggcatgtttcccgtaattttgagaagactctgggaggtttataacagcccagtaagggaatccaagagacctccaacatcagactttctaacatctgagatggtataaaggatgctcagcagcctgcctgaagaattttgaatatactgcatgatagaggcaacactttgaaatggccagtgacaggatcaatcaggacacctgtactttcagcaggcagaggggtcaccctgagccagccacataactacgcatttttatagacagatcctcacatattagttgactctccttcctttcaacactgttcccaaaatggcacaagtgaattctgaatgaggaaaggactatagtatttgaaataatagtgagtgagaaattttcacaattaatggcacataccaaaccagatttagcaagctcagaaaacccaaggagaataaatacttcaaaccaacaaactaaaaaacaacaaaaattcaactaaggatttttttttttttttagagtcttgctctgtcaaccaagatggagtgcggtggcatgatcacggctcactgcagcctagacctcctgggtctcaggtgatcctcccacatcagcctcctgagcagctgtgcaccaccagacctggctaattttgttttgttttgttttttgttttttgtttgtttgtttgtttgttttttggtagagatgggttttttccatgtttcccaagtcttaatctcctgggctcaagcaatctgcctgccttggtctcccaaactgctgggattgtgagtgtgacccatcacacctagcaaaaaaaaaaaaaaatcatatttacactgtaaaagacaaagtcttgaaaagaaaattatatccagtgaaagtatcctccaaaaccaaagaagaaatactttcttatacaagcaaaacctgtggaaatgcatcacttgcagatgctgcctgaaagaaacgctaaaagttcttcaggcagaaggaaaatgatactggtcagaaacttggaactacatatagaaagagagagtatcacaaaagaaataaaggtaaaataaaattgtgtatttttcttattttttattgctctaaaagatagctgtttgaagctgtaatagtagcaacatatagctaattacagtgtatggataaacatgacataagtatggataagacagacagcaatgtcaccaggtcgagagagaggactgagaatactgttatgagattcccacactacacaagacatggtatagtattctttgaaggtgagttcaaattattttaaagtgtgctgtaaagcttagggaaactactaaaaatatttttaaaggattataaatgatacagcaagaaggaagataaaattgaatcatatagaatgttcaattaaaactagagaaagcataaaatgtgagggggaaaaaaagaaaaagtagttgtaggtatcattttacattcccaccaatctgttatgagaggtccagtggcaccacatccttgccaatactaggaatgatcagtcttttgaaattgagatactgtattaggtgagtggctcattgagcttttattttttctttgatgtctagtgatattttaggattatttcatgtgcttgtttaccatttatatttcttttgtgaaatgtatgtttagagcttctctcttcattaaaagttatttccttatcgttgagttttggaagttccttatatatttgtagatataaggcctttattagatctggatttgcaaatattttctctaaatctgtggcttatatttccaatccattaataacatttttggaaaaacagaagctcttaattttgttgaatttaccaatgttttcttcttttatgcattatgtttttggtgttgtgacaaagacatttttgctaaaaccaagattacattttgttctatcagtccattttatggactttcaattctattccacttttctatcttgacaccaaaaccaccatgccttcattactctaccttgaaaatatatctctacatcagccatttaagttctccatttttttcccaaagttatcttggtccttctaaggttttttttgtgttttgaattttcatttgaatttttttaacttttattttaagttcagggatacatgaataggtttgttatataggtaagttgcatgttatgggatttggtgtacagatttcatcacccaagtaataaccatagtagccaatggtagttttttgatcctcaccctcctcctactctccaacctcaagtaggccctggtgactgttcccttttttgtgtccatatgtactcaatatttagcttccatttataagtaagaacatacagtatttggttttctcttcttgtgttatttcacttaggataatagcctccagctccattcatgttgcttcaaaggacatgatcttacgctcttttatggctgcacagtattccatggtgtatatgtaccatgttctctttatccagtccaccattgataggcttttaggttgattccatgtctttgctattgtgactagtgctgcaatgagcacatatgtgtgtatatctttaagacagaaaaatttatattccctcgggtatacactcaataatgggattgctgggtcaattggtaattcttttttaaattctttgagaaatcatcaaactgccttccacaatggctgaactaatttacactcccaccagcagtgcataaacattcctttttctccacagtctcactagcatcttttattttttgactttttaataatagctattctgactagtgtgaggtagtatctcactgtggttttgatttgcatttctctatttatgagtgatgtcgagcattttttcacatgctcattggccacatgaatggcttcttttgaaaagtgtctgttcatgtccattgcccactttttaatggggttatttgttgtttgcttttaaatttgtttaagttctttacagattttggatattagacctttgtcagatgcatagcttaaacatattttctcccattctgtaggttgtctgtttactctgatgatagtttcttttgctgtgcagaagctctatcgtttaattaggtcccagtagttattttttgtttttgttgcaattgcttttggcatctttgtcatgcagtctttgtcaggtcctatgtccagaatggtatttcctaggttgtcttccagggataaaaaccctataaaaaagtttttggttttatatttaagtctttagtgcacttgagttaatttttgcacatggcacaaggaaggagtcctcatcagttttctgcctatggctagcaaattatcccagcaccatttattgaatagggagttctttccccattgcttgctttgtcaattttgttgaagatcagatggttgtagatatgtggcactattttagtgttctctattctttttcattggtttatgtgtctgttttcacatcagtgccatcatgtgttggttactgcagtcttgtagtatagttcgaagtagggtaatgcctccagctttgttctttctgtttaggattgccttggctatttgggctcttgtttggtttcatatgaattttaaattaaatttaaattttaaaatagttatttttttctaattctgtgaagaatgtcattggtagtttgacagaaatagcatgtaatccgtagattgctttgggcagtgtggccattttgacaatattgattcttcctatccatgagcatggaatgtttttctatttcttgatgtcgctgattcctttgagcagtgttttataattctcattgtagagatctttcacctccttggtttgctgtattgctaggtattttattctaattatggctattgtgaatgggattatgttcttgatttgactctcagcttgaatgttgctggtgtataggaatgctaccaatttttgaacattgattttgtatcctgaaactttgcttaagttgtgtattagatgaaagagcttttggatagagatggtggggtttcctaggtataaattatatcatctctgaagagagagagagtgattttctctctttctatttggatgccttttatatctttctcttgcctggttgctctagctagtacttccagtactatgttgaataggagtgatgagagtgaggatccttgtcttatgctgattttcaaggggaatgtttccagcttttgcccattcagtatgatgttggctgtggatttttcatagatggctcttattattatggagcatgtttcttcagtgcctagtttgttgagggtttttaacgtgaaaaccttttctgcacctattaagaagatcatgtggtttttatttttagttctgtttatgtggtgaataatatttattgatttccatatgttgaaacaaccttgcatctcaggataaagcctacttgatcatggttgattagctttttgatatgctgctagattcagtttgctagtgttttgttgagtatttttgcatctatgttcattaaggatattggcctgaagcttatttttttgtgtgtgtctctgtcaggttttggaatcaggatgatgctggcttcatagtatgagttatgaagcagtctctcttactccatttttggagttgtttcaggaggaatgataccagctcttccttataagaaattagaatttggccgtaaatccacatggtactgagctttttctgattggtaggctttttattactgattcaatttcaaaatttattattggtgtgtttaggaattcagtctcttcctggtttaatttctgaagactgcattaatatgtttccagaaatttatccatttcttcttggttttctagattttgtgcatagagatgtttgtaatagtcttcgagggttttttgcatttctgtggggtgaatggtaatgtcgcctttgttattcctgattgtgtttatttggatcttctctttatttattagtctagctagtgacatgtgttgcttattaattctttcaaggaactagctcttggatttgttgatcttttgtacgtttttttgcatcttcatttccttcagttcagctctgattttggttatttcttgtcttctgctagctttgggattagtttgctcttaattctctagttcttccggttatgatgttaagttgttaatttgagatctttctaactttttgatgtgggagtttaacactgttttggctgtgtcccagagatgctgcacttaacactgctttggcatgttctagagattctggtatgttgtatcttttttcttattagtttcagagaattttttggtttctgccttaatttcactatttactcagaagtcattcaggatcaaggttgtttaatttttatttaattgtatggttttgagcaatttccttaacattgattcctatttttattgcactgttgtctgagaatgtggttggtatgatttcaggtttttttgaatttgctgagagttatttaatgctcaattgtgtggtcgattttagagtatgtgccatatgcagatgacaagaacgtaaattctgttgtttttaagtggagagttctgtagatgtctattaggtccttttcatcaagtgttgggttaaggtcccgaatatctttgttagttttctgccttgatgagctgtctaatactgtcaatggggtgttaaagtctcccactatcatcgtgtggttatctaaatctcttcacacatctctaagaacttgcttgataaatctgggtgctccagtgttgaatgcatttatatttaggatagttaggtcttcttgttgaatttagtcctttcccattgatgtggtttgtccgtgctgtgtctccgcccaaattgcatcttgaattgtagttcccataatcctcatgtgtcatgggcgggacctggtgggaggtaatgagatcatgggggtgatggttttataaagggcttttccctctgctcagctctcattctctctcttgctgccctgtgaagaggtgccttctgtcatgattgtaagtttcctgaggcctccccagccatgcagaactgtgagtcaattaaacctcttttctttataaattacccagttccaggtatttcttcatagcagcatgagaacggtctaatacaaccattatataatgcccctttttgtcttttctgatctttgttgaggtctgttttttctgaaattagaatagcaatccttgcttttccctgttgtctatttgcttggtagatttttctccatcccattactttgagccaatggttgtcactgcatgtaagatgggtctcttaaaaagagcatactgatgggtttcactacagccttgaagaatataatgactgtgtctcagggatggtcttcttgtgtagtattttgcagggattctctgcatttcttgaatttgaatgttggactttccagcaaggttgggaaaattttcatggatgatatcttgaaatatgttttccaagttgcttggtttccttccctctctctcaggcatgccagtgagttgtacataggtctctctagataatctcatatttctcagaggttttgtttattcctctttattgttttttcttatttttctcttactgagttatttcagagagccagtcttcaagatctgcaaatctttcctcagcttgattagcattagttctaatgctaatacttgtgattgcattattaaatttatatagtgctttttagctctctcagattgattgggttctttcttacaatagccagtttgtctgtcagctcctgtatcattttattttatgtcttagattcctgggattggattttgacttactcctgtatgttgataatctttcttcttatccatattctgaattctatttctgtcattccaaccatctcagcttggttaagaactatttctggggaactagtatggtcatttggaggtaagccgacactctagcttttcaagatgccagagttcttgccctagctctttctcatcttcgtgagctgatgttccttcaatctttgaggttgttgagctttggatggctttttttttgtaaatcctatttgatgtccttgaaggtttgattgtggtgtaaggtgagttcagttgactcgctttatttctggaggaatttagtggggaaaggatcagttcaggactcctggactgcatgctctaactctgggtggtgggtattgggtcctagcttggttctatcaccccagagcctagaaacctgctgtgctgaaggggccaaggttccctgaccactggtcacaacattccaatgggtagtgctaaccaaagcactttacggtgaggttggcaacaggatccattctcattttcacctgccaacagtagtggtagtgctcagtggcagtgcagtggggtgctggtaggtgcaagagtgctgacctctgtgcaggtgctcacagcagccacaggtgtcagcatggtgcaggggttcagggggccccagcagtatctgtgtgcatgttcacagttgcagtggtgttagcatggaggcaaggcattgatggacatgggactgtgtgtgccatctgtgaatgtgtttatgtgattggcagatgccactcagggtgggagtgggtccagtgctcccccatgtagttttgtactggcagcagtgttggcactgggcaaagtgctggcaggcatgggactggcagtctctatgcctgcaaacactctgatgggaatggtggcttagtggggagctgggagagtagggtgccctcatgccagcaacagtggcatggcgaggtgcacatgcacacatgagctggcaggtaaggggaagaaaggttcacccatgcacacatgtgccggcaaagcaatgtagggggtggctgccggcgagtacatgtaggcaaagagcatggtggagattctggtgtgggagggcactggctggtgtgcatgtctggtggctgctcggctggagctctctagtggtcaagtaaggactgccagtgcaggagctatgatgtgggcccccaggaagcaccccatctgggcattcgaggctgcactgcaggacaagggccctgggagagatgagcagactaaagggtgctcatgttggactgcacctgtctcatcagcaggactgccttgcactgttcaggtcatacagtttgactatggctatagtctattagagaacgaaagtaggccttggaagatatgcttctctggctgtgctccactacagaccctctggcaccaaatcctctgggctctgtacaggctggagttttgactctgaaacttctcaaggcagctcttcctgccagctcaagcatccaggggggttgtagggtctcctgctgccagaattccagaggcctgtggccagagcaggtggctctttgcctactcaccccttctccaggagtccttgggggctaggaaggagtcccagagtgtagtagccccatgcaaggttcccagcatcctcccccttcagcccagcatttgtgtcttcccttcatccactctcaatgcctttcctctgaagatctgctaggagtgcaccagtctgcccaatgtcctggtcccttggtggcagatgttactcccaactgcacctagtcagccatcttaccccgttctctcccatttgaattttagaagcagaatcttaatttatttttaaaaatctactgagatttttattgtgattacactgaatgtatcaatcaattttggaagaattaatttcttaatattgagtattttgattcatgaacatagtagatttttgtaaggattatcagtttatatatgatttatatagacttctacgcgtctaatcagaggggttttatatgtctagttttctaattttttaatgtgaagtcataggactttgatttaattttttgggcttattttctatgaggaaatatcataacttttaggaattcataccagatattcaatatttatgcaaaatactaaatatcaaaattattgagtgctttttttggtctggcttctagtcatattgtttgatattgacttttaattttgtgttgtttgcctcctcacttggtttagtaaaataagcacagacttgagtgaaaagaggtaatttagaatcttgggtcatctacttattactctatgtaggctaactttcctagcaccaaaataaaggtatagacatattcccctagaaaagttaaaagcactaaattagatataactgagactgcatccccgaagctctagcatgtaagagacactccatagacatgtttctgtgcatttgtattttagctttattctctttttaaacatttgataacttttttcctgatagtgaaaatctactaaaatcatgatttaaatatagtaatcatccttctttcttcacacctctcaaatttaactgttatattgagtaccgattcttttaagtttaaaattatttttaaatatgaagcaaaatttatcacaggattaatccctggaaaacttttctttaaattagtcataactacttgtcataacaattgtatgactaagagcacaaaagtaattgtgtttgatcaatattttttccattactgaattcaagtcatcaatgccttaaaatatatacttgtatgatacacagaatcactgggcaagagagagaaagggcactactacgtaacaggcatgaaaagcccaagtgctgataactcataaaaactttcctttttctcagttagtcatcatgtaagtgtagctttctttataaaaaaaaatttgatcgtgttattagaataaagttggcaacttgctgatataacatggactgcactggcgtttatattctgcatagtcatttctagaaaagtgattaaaacagtgattgaattaaaattttatttcagctggctttattgcaataaaaagtcactatatttcctcttattacttttttacctaactcatttttagatgaatatacaggaatttgtattaaaacaagaccgtactattgaaatagtaagaaaataaagtgaaaaacttggagaatgacaaccaattctgaaataaaatactgtaggtattatgatgaaaaatttgccctgaagttattttgctaaggcacaaataaactacgatgagaaaatatcaagttcttgaaactttgtttgcttgactgagaattaaatctctatatttgttccagggtaaaaattaagtctctggactctgtctatattaaaatatggattgacattaattatttaataattcaaagtttcagaaatgctaaacatattgtacagtctcatttctaacatcaaactaggacataccgacagtggtttgttcttatagtcgtgtttccaatagtactccttttcttttttaaataataagacaaaggaaacttatttccttgtataattggtaaatttgatttttttttttgtctttataaacaacctgcgtgttgcttatgttatcatccatgacagtagtgggtcagaaaacaattttttaaagtcttgtcttgaaattggcttttcttctgaggtaacagtggtttgaattacagcataatttttccatagctattttatttcagtactgtttgcagaaaaaaatacttttgagtgggaaaaagaaaatgaccatagatttgattgggaaataatacctaagaaggctaagagaaaccagaaaaaaaatcattgtgttccaaggattagaaaatgttcaaagaatataagacaaaataagtataatactgtccataactcttaactgatcaatgtgacagttggtccgtatatcttccatatctgtaagcccagagacaacatgtactcagtgaaagctacgtatcaatggtcacgtttggaaattttcagcttttcttaataaattaaaacctaaggcctcataggctgacactaaaagtgtaatcttcttgtacagagatggtgaatgatgcaactcctctgttctcaaattgtccttttggaatttcttattgccagcaccactgtcaagtttatctcagtgtagttctccccttaaacaatcaggcttggccctttccatctcaatataatttacaaaagtaaagtatcagtcagagctgaaacattttcattcacacaacttcaaccgcaggaatggggtaatatgactgcacctggtaccttaagtacacatgttatctgaagcaatgcctatggagagcatgaaaacacgtgggtgttcttttaaaaatacgaaatactggccgagcaccgtggctcacgcctgtaatcccaacactttgggaggccgaggtgggcggatcacctgaggtcaggagttctagaccagcctggccaacatggtgaaacccatctctactaaaaatataaaaattagtggggcgtggtggtgggcacctgtaatcccagctactcaggaggctgaggcaggagaattgcttgaacctgggagacggagcttgtagtgagcagagattgtgccactgcactccagcgtgggagacagggtgagacaaacaacaacaacaacaacgaaacttaaatgtacaagaaataatttttaaattttaaaggtgagaatttttgactagatatagggctgggttcttaatttactagtacgtaaataatattctaagttatttcagttgcataaaattggttattggctctattttaagagagctaacaaaatctctctagttcaactatgctatataattatattaatacagtatgatagaatgaaatatttttataaagagttttatagagaagtagtgaaactttaggtgtacataatctctcttcaagatgcatttatttccatttataggaaaataatgaatgcattattttctgcattttatttttttggaaaaaagtatggaattaggccaatacacatgagaccatgtcttctttgggaattttgagattacagttagtgttgccagataaaatgcagagtttccagtgcaatttgaatttcagataaatgatgaatatttttgtgagtataaatatgttccaaatattgcgtgggatatatttatacaaaacaattgctcattgtttttcgcagattcaaatttagctgggattcctgtgttatttgctaaatatgccaattctagttttaatgcaattctaagtgacttgaatgatgagccatttatgtattggtttctgtgtgggacgagttgtgacaattcaaacttctcagagcctgcaagttttcactatttggtactctccttctgtcaaactgcatacttcacagggtgtatcccaggtagtgtggttctgaaaagtcaggccagcacctagcccttgttaggtaaccatgatttctcattaagacacatgggcatgtgcagtatcctgtacaacatggaagagtgggaatcttttgcactgggaagctccgagacttcctgatttgggttggagtaaaagagtattgtcaggaagtgctgaagaggttcctttccccttttgcctgagttgtttatcagtgtctggttggtaaatataaatatgtgaaagtagttgtgcaaatcttctggagttaaaagaaagtgaatggggaaaaatggacattttctgaattacacctttattcttctatgaaaagacactaaaagcagcaagaaataaagagcacttagtttcaggcactactgattatctccttgatttctttagaaagctgttactgatttatgtcaacaagggaagcaaacacttcattttatttaatcaaaggctttccttgcattcattctcctagtcacttaatattttacttggaacttataatatataaattctttaccttattacttttcccattataggtccaaccctgatgttaatttctaaaagaaaaaaattgtttaagttttattactcattctgactttgaacacttttccagaaatgcaattaaattggtgaatgtttgcaatgtttggttaaccaaaatgggagtctctaagatttttggatttgagttggttttaaaattgttttcacagaaatgattacttattaatttatccctctgtgtgcataagaatatcaatactgtccggccttttcattatattttcatatatatttttccttcataaaattatctggaacattctttaattccagttttgtggaagtatcagtctctatcagaatgtattaattaaattgctgtctatgaaagtaagcaaagatcattgtcatgataaacaaactatttttattttgaggctattcattgaaactagcccttctcactagatttgcttatttattgtattgttttaactctgtgcctcatattctgcattcttcactggctacaatttatctgtgtcattttctgtatccttattatcttttttaatctctttatatcggagtaccccagagcttagacccagatgtccttttcttttctttctctgctctcatgcgctacatgaaactttcaattccatggcatctaattgccgctaagttctgacaactctcgattttatctgtacccataaatgttctccagaaatctagacatatatccaaatggctattaacttctcaacatggatgtctagcagacatctcaaatttagtgcatcctaaactgaattatcaattcccacacactctacataccaaacttgttcccaccacaatgttcctgtatttcagtgaatagcaccactatctgcctgtgtactaaagtcaaaacccctgaaaaggattcttgaattgtctttctcttcatatccatatcctatatgacaagttttatgagctacatcttcaaaatatctcgtagaaccagtcacctctcaccatgctgaccactctcaccgtggctgcatggattactgtagtagctttccccttgtactactcttgcttccagttttgatgatccccagcaccatgtaatctactgtggcacagtgatagccagagaacctttaaatacaacaataagatcaaattatcatctgctctaaaccttcagatggttttcttttgcagttcgcccaaagtctctcctgtgtcatacactgtctggcctctgcctgtctctctctgattcatgttcaactcctgggcctttgcttcctgtgctttatgctaaaaatctcttacacaaaattctctgatccagccttatttataatttgctacacttgatagtacctaactttatatgttggttcattaaaaaaattttttattgtgttgtctttatctgttcttttattactcaatgatctagttctagcctatatttctaattaattacaacttctcatcacatgaacttctgccaaattaaaatattgcatgacagtagaacatcatgtatgcttttctagcttcatacattttctctttatgttcagtttaactttctttttgagtttttgtaatgtgctatcaccatttagttttatattaaaaagctaattatttgataaaggcctttcctaatacaatacccctcacatccatccagattcacttgtggaacttgctatattattattatttttttgaatgctgtcaacatgtattttttattcctgaagttgagaatccacactgttcatctttttatcttctgtaccaccatttcaagtataagagacagtcattacatgtttagtgaataaaattctgcactttcttgtcccatgaaagtggtctgcaaaagcattttttggctacaagtcctaataattttacttaatcattctagtttgcaaacttccactgctttttacatagttaagcatatgtttattctcaaataacaaatctcctaaaatagtgcatgtagaatattttgacttcaattgttatattgtaggatatcaagctactttgaagcaatctgacttatgagtagaattgaatttttgaataagaacaatttttaataacatttttcaagattttgctgatgatgtttttgagactttttcctccttttattcatttccttctaagatacttaaattatgttttggagacaatgaaatgtctaataacgatttatgagaaaattacttcttcttgcaagtcatattgctagaagtaatctttttctcccttccagcagaacattgggcaccagtgaggtttaacaagtacacctctagttttatggcacttacatgaaatatgaatttttggcttatgttatagtgtagtagtccaaattaaaaatattccaaagacattttatgcctgtaatgcaacaatatattaatctgttttggtactcttttaaaactactagctgtgaagttaactcagctgctgaaatttccccccaaggtgcttaattctttactcagagatcagttatttcagatgaattttgaaaaaagtgcttaatgtcctttttttttttctgagaaactgttaacctattttaaatcaaagaaacaaagcaagaaatagaattctgctcactgatataggatatctgtgacgtactgaagaatttggaggaactctcatccctacaatctttacatttccagatttgccctctaccgtccctcagcaggaaatctgtgaggctccatcccattgtgagccttgtcttatatgtagagttggaatgtcttatgtaaaactgaaaggagaagccaactctaaagtgccaagtgttgtctatcaagtctgccaagacctctcccaagaaccactgccacagcttattgagcagcttatcagccactaaccatgcacttctcactttaagatggatgtacttctatctttctgaactatgcccttcagaagtaaatttagcattcatctgttggtgagttcttccaatttttctttgtttgaaaatatttattttattattgttcttgaaagatactgtattagtccattttcatacttctataaagaaatacctgagactgggtaatttataaagagatttaaaagactcagagttccacatgtctggggagacctcacaatcatggcagaaggaggaggagcaaaggcatgtcttacatggtggcaggcaagagagtgtatgcaggggactgccctttataaaaccatagatctcatgaaacttattcactatcacaagaatagcatgggaaaatcccacccccatgattcaattaactccctccaggtccctcctatgacatgtggggattatgggagctacaattcaagatgagatttgggtggcgacacagtcaaaccatatcagttacttttacttgatgttgagttctaggttgtcaattatttattttcagtacaagctgaatatctcttatccaaaatacatgggaccagaagtgttctggatttcactttttttttcagattttagaatatatgcatattcataatgaggtaccttgggaatgagactcaagtctaacttctagttacttagttttgataaatttaggtatattttctagttccctttaggtaagtctaatcagtttgtcatctttgagttttttatttcaacaattatacatatatattttcaaaatttttatttctaaatgatcttattcgtttgttttgaaatctatcttgtaattttggattatcttttttatttttcatgtttcttgccaatgcatttcttgtttctttaaaaatttcatatatatatgattgtattgtttatctctttaacatttttatacatatacaattaatggcaattttttgggctggctgtttctcaaaaaatgattttctgataaatttgactatctttgataaaagctcatattggttgttcttaacatttgtaaaaactgaggcctaaattgaagattatttcatccagtaaaacttgcttttgcttctttgtgagacaggcagtatcatcaatctgagaccctaaatttaaatctaaagacatctcctttagattccttggctcaagctagcagactggtcactccctcctcttcccttaagcaatcttgatattagaattttacctacacttctactgtgcttcctactccaagctcagatttcaactatttttttgcctcttggaagttttctctacttccatctccccaactcagaagtacaacaaaatttattattttatccaagttctatccacttttccacattgataaaaccctaagaatgcatgccgtaatagtagtaaaaatcaattttctttatctgaaaaattattttgcctagcaatattttgtattgattagtattgtactttatgaaattctaacaaaaagtgaattaaatttaaaaaataaacagaaaaaagaactttttcaccacaaaacagtttccaaacctcttaaaacactcaggaatagtcaagaatagctcttaggaagggttgtaaaatcattctgactactgtttctgattttgtcctacaatttattgcctttctgaattgcgaattttttctgaaatgctgatctagtttctaatgctgccaaggagagtgtctcactcagccaatatttacaactacttcattttgttccacaaagggtaatttgtccttttgggttttctataaccctcctttatctacttaataatgtggaacaatttcccttggatgggtctgagcacttttgaatggtcactgggaaatttccttcaatcttagtatctgtacatgaagcacttgtcttttgacaacctcctaagaatataatgaaaggtcttaatgttaatatcctgatactcaagtctttttcactaataggaggattcttaaaaattgtcattcaagcaattatcctgccagtctgctttgatatcatggtctaatgaaaacttagtgatttctttatgatttgatggccctatgacggtaaagattgctgtgtgagagtaaactaaatctaatttaggaggtgaggaatggccaggaaaagcttctctggagaaataaaattaaaatgagggctgaggtcaaataagaataagccaacgtgggaaaagaaatattttaggcaaggaaaatgcacatgccttgaggagaaacaatgaagggcagttatagaaatagacagcacagaatgactaatttgtattcagtgatgggagtggttagaaatgaccttgaaagaagtgggaagaattttaacatcagaaacaacatgttcagaaagttagacttaaaatataggaacaatgtataacttttaaagtatttagttgtaacagtgaaaaaaatcatatttgaaattaaaaaaaaaattccagccataactggagaaaggggatttggttgggagtagagtctgtagtggatttgggatgacaaatttggaggtgtggcagtggtctaagtaagaaataatggtggattggacgatggtagttacaatggaaatggacagactcttagtgtcttgatactcaaatcttcttgattgagattaagacctttcattaaattaataggacattgtcaactgaggtactggaaactacaagtattggtgacaagaataaagaatcatggtctacaaaattaacaccagctttgaatcaaatgtgatctattcatccttaatagatgaaaaaaacactatagtgaaaactttcttttttcccatttttaacagagttccttttctatcctcagtctttccatcaaataacttatcacttctacctttccctgtcagagatgaatgagatattttactttttttctgcacagtgtgacatttggttcttttcagtatcctaatgcctacccctttgtttttatttacatgttgtttttcagaaaaccaaaaaagagattgcaatattaaaatatttcatatcttcactgcatgtagaagagggagattgaaatagctttttggtcccttctcaattcttttttcttgatatgatggacctagtttaacccaaacatacttggaataattattgtagagttacaaattcaatattaggaagttacatctaatttattaaaggtgtagttttgagttggcaggaaatctccttatgtactgacttatgaacccattcactgatgacatattctgattggctgagaaagacttcttgagatttaagctggttttagaatttatttaattagtgcttgtaaatcattaaataatgtaaacatgtataaaaatatcatatttaacccttaatgtataatatatacagttattatttttcaattaaaaataaattttaaaatgttttagaaagtggtaggtacttttatacagctaaggttcaaccttgcaatctttctaaagtatattcattaaaaaattgctactaatttagaaatttattaaaatttaaatcttacattggaatcatttgttatacaaaacagtatatcattaagcaaaatcaaaaccccttactgcattttattttgtcaaagattagtgtgcaccagataattaaggagagattttgtacagcctattgccatagggaaagcactgcagatctgaagattagtgtcctggcagggtgatttttgccttagacattcatagggaggagtagacaattttcaggtggtgtgatttagagttgtgactgctttacaatcaagggaagtctcagtcatttagctcaacaggaaatgtttatctgtgtgtctggctagtttcaaggggacaaatagttcaaatcttagctaatcactcttgagacacagaataagaatttagagggtctctctttggtcttttctaaccagatattaaaggaagtcatatgcaaatcttataggagtcagtaaaagagtgtactatgagtcttatttgaattttatggggaaatgtggttctttatggaaagatgtttcctgaatgcaaaagcctggatttgttgttgttgttgttgttgttgttttgttgtgttttttgttttttgtttttgttttttttttgagaccttgtctcaaaaacttcgcctaggctggggtgcagtggtgcaattatggctctctgcagcctccacctctccaggctcaagtgatcctcctggctcagcttcataagtgcctgggactatagacgtgaggcactgtgcccaccctggctggggaaattttagaagacaaaaatttaggggcagatttcctaattatcagtgtgtattgggaaaatagggattgagtaaagttaaatattgtcatattttacatgtgaattccacattcctgacataaatatatgtcatcacagtaatacattttcatcacttcttcccagatgctgcttgtttcacaaaactgagtcaaaatttaaattttggagatttggggctataaagaaatgttcgaaggggttaattttccagaaacatatctcgttttatctggtatttgcaggaatatcaagctgtttgctttatgtttatggtagaaagaaacattattttagtatagttagtattttattgtcttttatttgatttattttccatgataaactgtagagttttactaatcattattagagcacactcctaccgaatattattagttccctggttgaaacaaaatagtagcttgcttaggaaatgattttacagtgtttacttaaatttgaactgtttatatgttgttcattaaatatgaatcaaatgtttcagaatattattgttttactactttttgaaagcttgacaagaaatcttctataatagttcagtaaaattacatacagtcttatgttcgatcaagctgtgcatgctcccattctgtgttgatgaacatccttctattttaggggaaatttcaaataaaaactgaatttgagctttttttctgagtaacttcttgcccataaccctgggctggttgccaagtaataatgtgattgctttacagtcagtgagaagtaattcagtggcgttttcccatttgtaatgcctctcaatgaggaataaggttgttaggcaacagatgacatcaggtaggagcaggaaaaagacttctgagttaagaattcacaccaaaaatcactctattttctatattgagtcaatttttaaactgctgtctggaaacaattttagatttaaatattgtaagaacagtacagagagtttctgtgtacctttcactcaggttcccctaatgataacattttataaatgttatatagtgtaatttaaaaacagaaaattgaatattataaaccaaactatctgattttttttttcagatttcaccagtttttgtacttacttatttctttttcctttgggtttttcatggtggttgttacaaaatgctatgaaatattatcacatgtatagatttgtataacccccaccaaaatcaggatagaaaactgttctggtgctccagagaaactccctcatgctacctgtatgtagttactccctcttcctaatcctgatccctggaaaccactgattttttttctctatcacaaattttttttattttaataggctaaataaatgaaatcataaattatgcaaccattgagaatgactttttataaaaaaattgttttgaaaaatttaagactcataaaactttgcaaaataaatacagataatttgcattacacagtttcctcaatgatgacattttacataaccatcgtatattatcaaagtcaaaatattgacattggaccagtattatcaagtaaactacaaaacttaattggatttcatatttttacacatatttttaaaaagtttaattctatgaaatttcatcatagatatggattaatataattaccaccacaatcaaaatagaaaaatgtttcataatctcaaatcagccttttcacactctccccactaaacctaacccctggcaatcatgggtctgttttagacttttatcatttaaacttttctagaacttagcataaatgtaatcatatagtatgtactcatttttggttcagtttctttcacttaacatagggcccttgagattcattaaagtatttgcttatatcaatagtttattccttcttattcctgagtaggattactttgcacagatgtaccacctcttttatacctcacttacttggtaaaggacatttaaattgcttctagtttttcactattaaaaacaaagctgctatggaaattcatggatgggtttttaatatgaccgtgagtttttatttctctattataaatacccaggattatatgatatgtgtatatttaaacttatgagaaactttcagactgttttccagagaggtcacaccattcttattcccattaggagtatgtgaaagatccagttggtctgtatcctaacaccaggatttggtagtgtcagaatttattaatttagccattctaatacatttatggtgttatttcatcatagctttaatctgcatttccttaatggctagtatttttcttttcatgcgattttttttgccttttatgtatcttctatgattaaatgtctgtttaagacttctgcccattttctgattgaatatgagttccttacatattccttacatattccagaaacaagccctttgtaacataagcaatttgcaatatattttctgccagtctgtggctagtcttttcaacctattaacaggatattttacagaacaaagtgtttcaattttagtgaagtttaattaataaatattttcttttgtaaattgtacatttggcatcatgtctaagaatgtgtcacctagcccaaagtaacaaagattttctcctgtgtttttgtctaaaaattttagtgttaggttatttatatctctaatttattttgagttaatattttatacaatttgtaagtttagactgaggcttattttctgcctagggatgtccaattatttcatttgttagaaaactatcctttttacattgaattgcttttgaatcattgtcaaaaatcagttgtgagtactttggtttgcctattactgaacttcctattttgctccactggtatttgtgtcagtccccctactcatgcttcttttacacttactgtaaagtatgtagaaagtcttaaaatccagtaatgtgatttctcaaaccttattattcattttcaaattgttttaactcttctatagttcctttgctttttatataaatttcagaattactttgtatatatctacaaaaatatcctaagtttttgatacaaattgatagaatactataggttagttttgagagaattgtattattgatcatgttgcatcttccaatcaatgatcatggtgtatccctacatcaatttaggtcattgttgaattatttcatcagtgctttatagtttaaggtatacatgtactgtacaagttttgttagacttatactgaagttttccattttggagagttatttagtaactttaaaatgttaataacaatagctcattactactctatagaaatatacttaatttttatgtcatggtcttatattctgtgaccttgctaagttcacttactagttctaggatatttttttttcaatagattctttgggactttccatatagacaaatcatgccatctgttaaaataggaacagttaacatttctttcttttccaataaatttctcaatctgtatgcctttaatttctttttcttgccttattgcagtagctagaacttctaatactacttaaataggaatgatgatagtcaacatctttgcttttctcccaatttagggtggaaagtacttagtctttcatctgtaagtttgatggtaactgtgtattcttgatagatactctttatcagattgaagaagttccattctgttctcagtttgctgagaattttatatcagtgagtattgcattttggcaaatgttttttctgcatcaactgatataactttttgtctttttttctttatactcttaatgtggtaagttttcaaatactaaaccagctttgtattcctgaaataaactgcctttatcattgtatgtaattaatttatctataatctggattctatttgctagtattttgttgaggatttttatatgtatgttcacagggattattggtttgtaattttgtttttttgtattgatgttatctagctatggtattaaggcaatgctgggctcactaaaagaattgacaagtgttatctatttactggataaaattgtgtcaaattgaggtcatttcttaattatgtgtttgatagaatttactattgaatctatttaggctgagtgtttttttaaaagctttttaactagatactcaattttgttaataaagattattcatgttatctatttttatctttgatatattttgattgttcatattttttgaggaatggtgcatttttttttattccaattggataatttctattgatttgtcttccaactggctaattctttcctctgtcatgttcattttgctattgaaccaatcttgtgagttttcaatttttcttactgtatttttcagttctaaattttcaccttcgtttttctttatatctgatatttctttgtcaagattttctatattttcatttgattcaaataatttctaattttttatcagagtatttttatgatacagattttaaaatcatcatcagataattgcaacatcatgttgtaattagatacatcttgctttggtgtctgttgattttcttgctcaaattgatattttcatggtcgacatggtaaatgatgtttaatatattctggaaattttaagttgtatatgataatatttcctatttatatctgctaaagcaggtgatatgcctgttaaagttcagagtgcatgtcctggccaacttttgtgggccgtagtttaaatgttaattgagatttcaaaacatttacagtgctcttctggtctcttctgtttatgtgcttttcattaatgaccaacttgaaatcttggcaatattctgcaccatcgttcagttctcatacattttgccctgtgattctggttggtttcatgcatggccgctctggagtttgcccagaacttcatatacaggatctctttctgaagctccctcttcttcctatacatagcctctattttctaattaggtgggagttggttgcttcatctttgctgtcactcagctagtgcaagattaggatagtagcagcgctctacttcatgagctccacagcacatgacaggaaggaaaaagagtgctgcttcttttctgatgcttagttcagcgttggaatgatcacatcgcttttttactccacagtcttcctagtcacaatgctcactgtggatgggagggaaagcacatctgctcatgctattgcaatgtggagatgattggtaggactctaacacacagttggcagagtgcacagtggggagagatagggatactgcctcctttgtgcaaaatagggatgaaagacaagctattgttcaaagtctggggctggaggatgcagtagggaaacagagaggtgcagcgttttcttggagggagtacatagtcaagagggttatgtctcattagccatccttttctgtgtgtatatatatgataatgggagcagataaaacaacaacaacaaaacccccacaaggatggtatatatacccccacaaggatggtgtatatatatatgcatacatatatatgcgcatacatatatatgtaccatccttgtggcggttttgttgttgttgttttatctgctcccattatcatttatgttttgtgggtttctccagtacccaggcagagatacataggaggaaaaaacaaacaaaacacagacaattcacttcccccttattcctcaagtcataaaatctctagctagtttgctttcttttctggacttttaaggtactctgatatttacttattttttctgagattttttgttgtaattcatagaaggaataagggactaacttttttgggggaggaaaacatcctatgttcagtcaatttttaaggccagacttttagttctagtctcattttctgtttttcagcattagctaaatatgttctgagtactctattagctcttgcgggcagttagaaaggagaagtagacttagttctagcccctccgtctattatgatcgagttcggataaaatatatctactgaaaaccttatgtgtaccagacactgttctaaactgggggtgaattatcgtggtctaattggggaacagaaattcaaacacacaaactcattatgaaaaattttttttaaaaattattgaaacaatgagaatttatctttttatatatgtacaattaagagaaggcataacaaccctgtgaaaactgagtagtttcacagttaggtagaaatttgattgactaattgggaagtgggacaaagtggaaaaatacaaattttcacacaataaatctacaaattcacataaccagtaaagcccatatagaaatatacttgttaactaagcaattaaattgatataaagaagaagaaaataagaaataagaaaaatgagggaaaacatgttgtgatttggttttattgagcagtatttcaggtgataagatcagtcatagagaaaggtgaactatatgaattcagggcattacacacatgtggagaaatgtcatatgattttcttactatggagatggtcaagtaccttattttaaaaatggatgagaatcccattaaaacaattttcagtttacatgagagggaaatatggagatagtaaaattaaatatcagtgtaatatctatataataccatgctcactagtgaatatgacagattgaaaagaaaagagaaacaaaagttaaagaaagacaaggtagtaactcaaagataacatcagagtcactctgacaaaatgactctgaggtgacatggctatttctttttataagatctgatagaggaaaaatgattacaaatattctttaaggaatatagtttttaaaaattaaaaacaaatgaaaacaataattaactcttaagggacttagaaactatttcttataaagaaagtataatttatttctaaaaaagtaatgttatttggaccctatccatattggaaattagttcaattataatgaacgaaggccaaaatcaacttttaagaattattttcagtttgtttaaaacatatattgattccttaatatttgagtacctgatgacatgaacattcacaattttagaaaggccaaatttgccactctaaacaagagaaaacttgtcacagccagacgcaacattcttaactctacctggcacctaaaaatgttaggagaaagacaatgattcctggaagggacatagcttttcttggcattttgtgggaacatctgctaatgctgaagatggctatcgatgaaacgagagggacctacaatgctttgaacgtgtgtctgctctaaaattcatgttgaaactccaccatgcttagcatgttactgccatcttcatagtccaaaaatggttgtcatgaattttatcattgtttcctttgtccaggcagaaaatgggagaaggatgaatggaagaagtgcaagcaactaaagggacataacgctaaggctattcatcttaaaaagctttcccagaatctccccagggatgtccacttagatcttcctggccataagtgggacatgtggtaatgaagtcaaggattgttagagtgctagcactcccaccactgtggaagataaaagtaagggagaagaaactattcattgctttcttttgaatagaacaaagcacagaatatgccccaggagatggggatttgatatcgtcaagtggttgatatagagtgaattcatcctaagaacagtatagttgacctcagtgcccttgaatattcaatgtggtttgcataacaagaatacacaaaatctccatacctcttctggaatatactttatttttctgagcctatcttctggtccaaaaacttaatctaatctcttcaccctgagcctcctatttttgcttatttattcttcagatttatcctcaattcttgtttttagagtctgattttggctttttctgaaatttactttctgtctgtctaggagaatttgatctctagtatcttacctcatcacttcccagcttttgtagtattttgttctgtttttctctatgtggttgttgcttttaatctctctgtgtggctttctcgattaagctgcaattatggccactagtggctcccaggctcacatcttttctgtgcatcactacaaaggaagtactctatttttaaacaattcttgtttgaaatatcatagagaaagacacttttaacattgtctgggtcacatgcccatgtcagaaaacatgagttgtatggttaattctaccgtgaaatgagtatgaatgctgccacaataatttccctaaaaaaaaaaaaaaatcctggggtatttctcagcagaatcagagaaaaacattaacaggatttgaaaaatgatgcacattattctaccatatgaggttcaatttattttctttgtctgtatttataaaaatgatacacaatttttgtggttggtaaaatggcttgaaactatttctaaaattttggtttagctctcaattaacaataagtcaattaagtatttcataaattgtttcaaatttcacagggcagtctcctctatcaaatcagattctatgttttttaactatagagagtaggactgtgtttaaagatgacaaggaaaaaaagatgatggaaatacatcttacgtcagatgaatagaaacatcaagcaatatgggtctgcaacctcttaggtcctgttctgtagtggagataatagccatgggtccagaccctgattgctctaaaaagaagagagaaacgataaaacatattttacacttactaaaattgtgaggtacaatatggccttttatctgataatattgggtttgaatgggcctgttagaattttctgcattttccagcacactctacccagagttatagttccattttgaccttcatttttaggctgtgactatgatttagcaaaatgtattttcatttagttccagttcaatctcattatctctgagaatgagtgttactgcagtttgattgaacaagtagtatttgatgattttcattccaggtggacagtaaataataaatacagtgtattactgttgaaagtgcaaatgaaagatgttaccagatgcagaggaatagtaacacgttttatctgaaagcaatagcaccttaacatttgtgtaaaacaattgttaacaaaccaattccacctatatcatttaattcttagagtgtgttaatggggtatgaaatatttccttcattttaaagaaaagaaaatcattaccagagatatttacatgacttgcttaatatccttagccattaattgtagccaagaaactcaaatccaagacttctgattctagttcagccttttcttaataccacaattgcttatttgaacatagaagaaatattctctgcctgctccatgacaatgataagatgataggacttggagtaaaggtgcaatgtgattatctttatgataggatcagaaggtaatatattcattcatttcaataatatctgtcatgaatctactacaagctttatctctagtacctagcagaatgtctgatacgtattataggtaatataagcagatatgtaagattaataaatgagcaaatgagtcctacatcaagcaagcatcatactacactgatgatacagtggtaagataaagaccctgctttcgagaaacttgcttgttagcaggagatacgtgaatatcaataagaaaatgtcatatagagtgaaaagtactgaagtgaaaaataaacaagatgttctgaggcatataaatggtggataagttgaacaaatcttcagtgaacaggtgatacttgaggttgaccatgaaggactaatcagatcttccgtcatagagagaggaagcctcacactcagaagtgatgtgtgagagaatataggaagttccatgtgaagtggtgcttcaagcagcctaggttggggagcttaggatgaaacacaggactatggaatatgattggcacctagagaaaaacattgttttgtgtcccctgatgacaactgaatttgttttttagaacattgactctcgtggcagcagggggaattgattggagtaagaagagctgtgagccagagaatgaattcctgaaccagcccaagaaggtgaaagtgaggaacagattctagagatgactagggaatagcaggagctaatccacttctgtgagactctctctaagaaaaagtgctcaaaattacaaatacaaaattaagtatgaaagcaagtatttgtttataatgaggaagtaaataataaaacattaccaactttagaaggctaacagggccaggtgcggtggctcatgcctgtaatcccaacactttgtgaggctgagacaggcagatcatgaggtcaggagttcgagactagcctggccaacatggtgaaacccccatctctactaaaaatacaaaaattagtggggtgtggtggtgggtgcctgtaatcccagctactcgggaggctgagacaggaaaattgcttgaacccaggaggcagagattacagtgagccgatatcgcaccagtgcactccagcctgggcaacaagagcaaaactccgtctcaaaaaaaaaaaaaaaaaaaagggggggggctaaaaaatactacaaacttcagataatccagaaaaataacagaatagctatagattaataactataataatacaataatagttaataggtaattgaattaccttcttgacaaatctccatatattatccatataaaaatgttttggacatatactttttaatatcttcatatgaaaatgattttataatactattttccatagagaggtcagaaagaaatcaagactttttctgctacgattggttaaaaaatttactgatagtttggatgcaaaaaatatggttttacaccaagttgtatctgttacttatagtactgctactggttgctccctgccaacacagaatttctgataaatttaactttaagcacttttcatcaaaagaaggaagaaaaagagcatggcaggtttataattatgcatcctgcattataaatcatatttctaaccagaaatactttcattttgattaggcacttatgaaaaccaaatattctttttataatgtgtatatatatatttaatgattggaagatttttccacatattagctactggttctgcacattttaaacaatatttctcctttattctcatagttccagtgacagatgggagaggacaccttcatacagcagtaaatttttggccattctccttcctcctgtgttgctgggtgggtcagcacaatgagtggtaggagtacttctggaagccattcctacagcagggatgctagcaattatgaaaccattcctagaagtgtctgaaaaccacaacatattccaataaaccaaaaatgaagtatttccaactcagttgccccttagttggattccaaacatgctttgtggtcacccttacattacccaacacgaagggaagtgtgatggagcagcaatcactgtggagacagtcatcttaactgatggtgattctaacttttgaaagttttagaaaaacatatatacatgtgaacacattggcagggactctctcagagcttgggaaggagatccatgcacagaaggggcttccggtttatactatgttagcttatggtgaacatgtctctaggaaatagagcccacttctggggactggttggatatgaatgaaggatgagagaaacaggaatctaggaagtctggcagatttttctagcttgtattccatgttgaatgataatatggtaaacaacaacaacaaaaaatagaatgaccacttttcaggcttgattgtcctatttttagtattaaaaatctcacattctggggaaacacctcttcaggaagcaaaaatctcagtttttaggtaaggaaggttgcagggaagtgccatactgaaaaggcagccccaaaaatagtaactgaaagaaagccgtttttagtgtcaaatgaataccagtatagattatctgtctttcatagttgttgccgtttttacctctgatcactaatgtttgcagctatgattggcagttctccaaaatggttcatgcttggttggatcactccaagtgacacaatttgtgtgaaaccttagtgcactgtaatcacgaacattaacaatctgtctttggctttgcccgtggattaacttttgtgctttgtattgagatactgcttgtgaaaaaaaacaaagacaatccaaataagaacaaacagaggccatttaatcagagcttgataaagcaagggagtcagccaccatcacttgcatttggtagactcaaaggcagacaagggagctttgtagtggataaaaggggagacttcagttataccttgataagaggttattggcacaaagaagctggaagtaaattaactagcagttgggcatagtatataattggtttgggaagtatatttggctctctctgattggtgctgaggtggaagtcagggcaaaaattaggaaagttggcagtgaatgactaagtcttgacaattctgggctgattcctgcggagcttttggattaaaattctattgtcttatatggtctgacccttttctatttgtacattgtccctcaagacagtttaattttaacattgtaaattttatgaccatattttccaagaacctagataatgaaaataaaagcaattacaataccaacaccagtattacccatatatccccctaaaagaaggcttaataactttgttacattaatggcaaatggaaaaacacatacagctgcattaaggaaataaataaccaaaacaaattattttgcagattatgcaaaaaataatttgggattgggaatggtggagtaggggatggggaaacataaggttagcataagacaggtaagtactgctaaatcattcaaaagtttttatttttatttcccccaaaataccaatggtcagttgaaaacagtggccactgaattaccttaggcatatcccagtaatgaacatgcattatcatattattcccttgatggttgtatgaaactgtgttaattacttggcctgattcagaagttgcatctaaaatgtcctgttggggaaaaaataggggattttgataacagatgcattggcctcttatggggtagatctgattctgtcagatcttagcaaagattatgttttctacagtgggtcaagggaggtgcatggaatcacagtagtaacaaaatgtttcttttagtacatagacactttaatttgaaaaattaagtttcaaatagtgttcttaatttgtatgaatattttaatgaaactttggaaaagacttgctcctatatccacatattcagtagacgatgaaaataaaaatgttggcaaattccattcagtcagtaaactccttatcaaagaaagtaaaaagatcttgccagctaaatgtcctcgttaccttctacaacatgtagattaaaaggtgtgtgatctgcttgcgtgccatattagggctttcataatgaaagtttttggtcatttttagtgtcctcaaatatgaagaagcacataattatatttttgattgtataggtatagaaggaaatagcttcattaggcatgtgcctaaaagatggctatcattgttgcttgacatggaaaagatattaaaatggtggccttccataaaattataatttccaactgtggaacaagaaaaaaatccttctctaatttggagacatatgagagtaaaaatagataaaaggattacagtaaagcagaaatgtatatgctgtttcctaaaaatatttgataatctttgacaagaccataaggcaactagaaaaagatgaactgactacacctgagttttgtaaggttacatgtaggttgcaacaaaaactcatatagagaatatgactcatttttagaaataagactccttcagaatgcaaaaagatgttaccagaaaaaggcaatgagttaaacatagcttttcaaatttcattactaaaactgcaacttatttagaacccaattttgatttaacaaattcaaattacctctgtgccttaaaatgattccctgagaaacaggttaccttatgaaaacattcaatgtgctttgaaatgtttaaattatcgacatttgaaacaggagactatatgacaaataaatacatgcaaaggacctgattgattcatagctggattacatgaacaagcctgtaggtataaaggaggaggacattttaggacagctggaaacaaatccctatgcatgtgaattctgcttttgctattaagtaaaatcttaaataatccatgttcaaacacttttcttgcgaggttactttgttgatgtcatcacatttgtctgacacaaggagtcagtgtaattgagcttgataagaacatagtgctagtcaaagagaactttctgtttggttgtattcagttttactactacatgaaagaacagagctagtcatctatgctgcaggcagctgagataaatggcactggaaaaggaacacaaaaatattctactggctcacaggacagaaaaaaacatgtcaatgttatttttattaaaaataggtaatgtctgtttatttaatctgcattttcttcttttaaaatgtcctaattaaaggctcttaagagtacataatcagtcagagctaagatggctgagtagacacagccataaagagcttttcccattgagagagaccagatcatcaagtagaggaggatactccaaatatatcttcagtaaaaagacattgagagtggacagagggtggatacagactcaaggctgaaagagaagagagctgggaaccctacaagaggttgccaagcatcaggacttgttcctggcccccagctgctcctagggaagggctgagtgaaataggcctggagtggtccactctcaccattgatctctgggattctagctgaaggagaccccaggacccccaaggacatctgagctggcagagaaaactgcctggagagttggtagagacaaaactcctgcattaatcaagcccagaatatttgacacaggaacagctgcagtggagcatggccatgggtgcccatcccacaaagttctccatactccattaggcagctttagactttattagctgctggcattggacagagcaaggctatgcttcctgtgggatggggtctgatattacttggctgtgttgccacccaaatcttgtcttgaattatagttcccataatccccacatgttctaaaagggatccagtggaacacaattgaattatgtagatgggtctttcccatgctgttcttgtgatagtgaataagtgtcatgaaatctgatggttttataaagcagagttcctctgcacatgctctcttgcctgccaccacgtaaaatgtgcctttgctcctccttcaccttctgccatgattgtgagtcctccctagccatgcagatctctgagtccattaaactttccttttataaattactcagtcttggatatgtctttattagcagcataagaacagactaatatagggccagtctgatctgagcaaccctctgtctgctggtctctcccagtgtccctgcctggcctcatccacttacagcactaccccagcatcccagccaaagtgctttccagtggccaccactatagcttctttgccaggagaacctacctaccgattcgagcacttttgcacatatttttggagaccccaaccagtatgcacccacttacagcctttccccactggtacacactcatccacagcctcatcctgccaccttattagcatgcatatgtgcatagaccccttgctgccctgctggcacacacatgcatacatgaatggagagtcgcactgctcctccagcacacatgtacatggggactcattgttgacatgcatgtgtgtgaggaccactaccaccttgctggtgcacacatgagtagggaaatggcgactcaccactgccctgctgaggagctttcgtcagtagcccctgttggagtgttgctaggttaactttgacaagccagagatcaaagccatggacctggttccagcccccagggttagagcatatagcctaggagtgctaagctgagattctggtcccctgaatgtatccagaaacaaaaccaatggaccaaacccagcttatactacagtcaaaccctcaaaggcattaaagaatatacaagaaaaaaaaaaggccacatccgaaagacaacaacttcaaagattaaagtaacatcagcctacacagatgagaaagaaccagtgtaagagccctggcaactctaaaagtcagagtgtcttcttgcatccaggtgactgtactggctcccagcaatgtttcttaactggaccaaagtctggttatctggaagataaggaagctcatcaagatacagaagaaggttggaactcaatcaaaggaaaacaataaaaccatccaactgttgaaagacaacatagacatttcaagaaagaaagaaccaaatttaacttctgaaaataaaaatttcactacaggaatttcagaatacaactggaagcattaataacaatacagcaagctgaggaaagtatctcagagctcaaagactgttcattttaattgacacagtcagacaaaaattaagacaaataaattttaaaagatgaataaaacttctgagaaatatgggattatgtaaatgcacaaaacctacaactcactggcattcctgaaagagattgagagagagagcaagcaacctggaaaacatatttgaggttattgtccatgaaaatttccccaaccttgctagagagtttgtcatgcaaattcaggaaattcagagaatccctgcaagatctatacaagatcatcatcttggggatcatcatccccaagacacatagtcatcagattctacagtcaatgagaaggaaaaaacttaaagccagctagagataaggggcaagtcgtgtacaaaggctatcccaccaggctaatagtggccttttagcagaaactttgcaagccagaagagactgggcctatattcagtatccttaaaaaatagaaatagcaactgataatttcatatttagccaaactaaatattaaattttcataattgagagagaaataaagtccttttcaggaaagcaaatgctaagggaatttgttaccactggacctgccttacaagaggtccttaaaggagtgctaaacatagaaatgaaactatgcctgccaccactcttaagtatattaaatataagcgaacatagaagaaatgggtaaattcctggaaacgtgcaacctcccaagattgaaccaggaagaaactgaaatcctgaacagaacaataacaagttccaaaattgaatcagtaataaaaactctaccaactggaaaaagccctggaccacagagattcacagccacattctaccagacatataaagaagagctggtaccaattctacttaaacttctccaaaaatcaaggaggagggattcctaactatgaggccagcatcattctgataccaaaatctgacagacaaaatgaaaaaagaaaatttcaggccaatatccccaatgaatatagatgcaaaattcctcaacaaaataccagcaaatcaaatccagcagcacatcaaaaagctaatccaccatgatgaagtaggctttatccctgggaagcaaggttgataccacatacacaaatcaataaatgtgatacatcacacaaatagaagtaaaaacataaaccacatgatcatcttgaaataggagagttccctgacccccttcgcaggatgtgtgacaggggtgtggctcacctgttcagcaactgcatgcgtgctcaaacaccttacaggagcggggagcatgcagtcaggtgcagtagctgggtcaagcatttttgggctctggccccaatggtggtatctacggggtgggttcctgtgactcctgaagccatagggtgtgttacagtgctcctttaggtttgctgtccacaacggcttaagtgttaaccagctcagtgccctcttggtatgcgggtccttttccagcatccaggaagaagcaggtcacacacggacttgaaggatggtgaatgaagaggttttattgagtggtgaaggtggctctcagtgggatggatggggagccagaaagaggttggagtgggaagatggtattcccctggagtttggccatcctgcaacggatctcctctcagaccgtctccagctgaactcctctcaacgttcaaatgctccttcttttctctcctctgcagcactgctcttctgctcctctgctcttctgttcatccactcatttgctcgtctgctcgtaaagcttggggtttggggtttatatgggtacaggatagggaaacgtggtgggccaaaaggcaacatttgagcacgaaagcaagaatgcctgttcccatttagggccatgggcttccagtcttgagggtggggtctttgccggggaactgccctcttctacccggtatttccctgtctcctgtccatatcaatctcaatagatgcagaaaaggctttcaatgaaattgaacatcgcttcatgttcaaaaaagccctcaacaaactaagtattgaaggaacatacctcaaaataataaaagccatctgtgataaatgcacagtcaacatcatactaaacaggcaaaaccaggaggcatgagaactggaactgagaactggaacaagacaaggatgcccactctacgactgctatttaacacagtaccggaagtcctagccagagcaaccagggaagagaaagaaataaaaggcatccaaatgggaagagagaagatgaaattatctctctttacagatgatgtaattctgtatctagaaaaccccatagtctctgtcctaaggttattagagttgataaacaactttagtaaaatgtaagggtacaaaatcaatgtacaaaagttagtagcatttctatacaccaacaagtaccaagctgagagccaaaccaataataccaccccattcacaatagccacacaaataataagataactaggaatagagctaacgaggtaggtgaaaaatctctaaaatgagagttacaagacactgttgagagaaatcagaggcaacacaaacaaatggaaaacgatttcatgctcactgaaagtgtgaaaggaaaatgaatctcaggatccaaaatcactaagcctgcctctcgttctattcctgaacaagatagttgctaacataaaaaagttacatacctccctcacaatttatccacaaggaaattccttgcagacaaagcacaggcagagctcaaagttattcctcttttcactgagataaatgcatatctgattgcttcctttggaaaggctagggagaaagttaagcaatataactgtaggtgtttatctacaaatgacctggaagtcccctccccactttgagttgtcctgcttttctggagcgaaccaatgtacatcttacatctattgattgatgtctcatgtctccctaaaatgcatgaaaccaagctctgccctgaccaccttgcacacatgtcaggacctcctgaggctgtgtcatgggtgtgcatccttaacctcggcaaaaataaactttctaaattgactgagacctttctcagtaatttggggttcacaataggaagaatcaatattgttaaaatggccagactgtttaaaacaatttatagattcattgctagccctatcaaattaccaacattatttttcacagaactagagaaaactattctaaaattcacatagaacaaaagatctgaatagccaaagcaatcctaagaaaaaaaaggctggaagcatcacactatccaacttgaaactatattacaagtaatcaaaatagcatggtactggtaaaaaaaaaaaatagacacatagacaaatggaataggttagagaacccagaaataaagctgcacatctacaaccatctgatcttcaataaagtcaacaaaaacaagcaatgggaaaaggactccctattcaataaatggtgctaggataactagttagccatatgcagattgaaactgaatcccttccttatattatatacagtgatcaactcaagatagaataaagatttgaatgtaaaacgtaaaactataaaaactgtagaggaaaaccttggacacattctggatataggccttggcaaagagtgccggacagattctcctaaagcaattgaaactaaaacaaaaatgctggatctaattaaactaaagagcttctgcacagcaaaagaaactatcaacagaataaacaaataacctagtgaatgggaggaactacttgcaaactgtgcatctgacaaaggtctaatattcaggatctgtaagaaacttaaacaaatttatgagcaaaaatcaaaccattaaaaaatgggcaaaggacatgaacaggtatttctcaaaataaaacatacatgtggtgaacaagcatatgaaaaaaatacttcacatcactaatcaagagagatgtgtaaatgaaaaccacaatgagataccattttacgccaatcagactgactatcattaaaatgtcaaaaaataacaaattctcataaggttgcagagaaaagggatgcctatacactgctggtggggatataaattagtcttagtcactgtggaaagcagtttgatttctcatagaacttaaaacaaaactaccatttgattcagcaatcccactatgaatatacatccaaaggaatttagcatatttctactgaaagacatatgcactcataaattcattacagcactatgcacaatagcaaagacatgaaatcaaccttaacactcaacagtggtggactgaataaagaaaatatggtatgtatgcaccatagaatactatgcagccataaaaattaaatgagaccatgttctttgcagcaaattgaataagctggaggccattatcctaagtgaattaacatgagaacagaaatccaaataccacatgttttcgcttataagtgggagctaaacactgagtacgtgtggacacaaagaggggaactatagacactggggcctatttgaaggtggagggtaggtggagcataaaggtcacaaaactacctatcaggtactgtgctcactacctggatgatgaaatcatttgtataacaaaccccagtgacacgcaatttacccacgtaacaaacttgcacatgtaccccttgaacctaaaatagagtttgaaaaagagaattaattagttaaggaaaacaaaatttgtccaaggtgatatacattttggcaattgtatataattttaatgtagaaatttgtctaataagagtgcaatgaagattactaaaaacaagtagaaccatcacaaaacatatttgtttctaaaaattaaaaagaatgtgtaaaaatgtaactatacaatttatatatccaatgcaagttttaaaagagttaaaatgaatcgctaaataagaagacagaaagaaaattgtaaattgtaaacatattgttatagtttttcacatatatgttcttacttgtctaagtagacttgattgcctaattaatttctttaattctaattgccactattaactagctctattgccattttactgaaattatggcatttatgtagcagaaaggtaagtaataagtaaaacatactggtatgttttgattcataaataaataattcttctgtaactgaaaatttgtggaaatctatgtgaaaattcttgacaatataacttgaaaactgagctgactgtatttaaagatactcaaatttctgtttttgaatacatggttttgataaatctatttataaatacaaagatcagagtaaatatagcctcactaaaataatataaacttctatactgtatgcatatatatatttgtttttccttagaacaaattttaaacattattttgcctttccattatggtttaacattgaactttctggtttttctttttactttcatacaatatcctttcatacaaaagatgttgactatttcttttacttcagagagcatcttatttcaacgttttgtcttaagatcctaaatatttttctttgttgttgatatagtttggctgtgtgtccccatccaaatgtcatatcaaattgtaatccccacttcttgaggggttacctggtaggagtgattggatcatgaagatggttttccccatgctgttctcatgatagtgagggagttttcaccagatccgatggtttaaaatcagcagtttaccctgtgatctttctcgcctgccaccttgtgaagaaggtgctgcttcccctttgccttttgccatgaatgtgtttcctgaggtctcctcagccatgtggaaacatgagtcaactaaacctcttttgtttataaattactcagtctcgggtagcatctttatagcagtgtgaaaacagactaatacggcagtcaatgttttaaggctaacatttagcaatccctgtgtgattctgaattaaattatttaaatattctattttatgaatgggtatccctgatatatttacatctaggcccatttctaagtgccgaagaaaacagctatgaaagagcaatgctgaatgccccctcatatttttcttgtcctcagtacaaaatgatatttttgatattgtgagtatgtaataagttttcagagatcctccaaattaacaaattataaataagttttatttcaatgttatacagtttattgtttctgtcttaagcgtatattgagtgtctttgggaactgtattcataacaactgaaaagaaattataaattcaaatctttatcaaatgttgacacctttgtcatgtgacaattgaatgttgttttaataagaaactaacaccaaattaattctagaatatacagaaaccaaataattccaagaagagttcagatgaaatttttaattgtgattttgctctcagctaaatcaacatacaggtgaaataattctttgtcatttttttatcagctgtctcagagctctcatgtacccctaggacacatatgactttaagtagatcacaataaaagaacagaggcagaaacgaatgaagaaaacagaatgacacttgcaatcagagaacctggctttcagacacaaacctgtgcctttctgattagatgattttagtgactcattctttgagcttgagtgatcttatttacagaatggagataataattcttaatccataccctttgtgaaaggagtaattaagattatacttgcgaaaatgcctagtatgaattccggcaactggatgacatttagaggatcctcatttttaattttctcatttattcatcaagatttgtgatatacttctgttttttcagtccctagaactgattctcagtcccaggtttgcactttattcattccttctttcctccagcatgacttaaatattcgatttgcatgtttgttttgttcctgttggctgttccacagaaaggtgcacattttataaaatatcttatttttttcttcctctgaaatacatgtaaaatattattagacattagaaaataattctaacaattgctgtttgtggacttctccacactatagtgaattagccaatgttttttctacactcttcatgtatggtttttgaaatgttctaattctttttgtgttgtcagtcagttcagcccaatgtgatgttcataatcagtttcactggtgagtatgatttatcattcttcagtccaaaacaggttctttatgaaagtaatgccaagacttacagatacttagtatccagaatgtgcgtctaagacatctatcaagatattattcctaatacagtgtcctccaattccatccatgttgtcacaaatggcagaatttccttcttttgtaagggtacatagtattccattgtgtatatttaccacattttctttaactattcattcactgatgcacgattataacttgtcaattaaaactaaataaatacatatgtacatatataaacattccatttttctttcccaacctttaataccctgaccctttttaccacctcattcattcttttggccttgatctgaatgaattactgccttatagataggtcaaaaatacttggatcctgcctttgcctcaataaagaatgaagactctgtcatagttcttcaaatgtcccctgaactattttgcccttccttaaagctttcatggctctatttcctggaaactactgtcttttctgatctatttttatttctgtgcagttttccaggattctaatcagtattttttttttttttttttttttttgaaacggagtctcgctctagcgcccaggctggagtgcagtggcgcaatctcagctcacagcgagctcgcctcccgggttcacgccattctcctgtctcagcctcccgagtagctgggactacaaggcgcccgctgccacgcctggctaattttttggatttttagtggagacgggttttcaccgtgttagctaggatggtctagatctcctgacctcgagatccgcccgcctcggcctcccaaagtgctgggattacaggcgtaaaccacagcgcccggcctctaatcagtgttaaagtccgagttatggctgtactgttcatgaagctgtatgcctttgtataaatactggtataaattattcttattagttgtcagcagtctctgataacagacataattgtgttctctatttttctcctgaagtaacaaatctccatatcttcttgttttaaagctcatgcccttccaaggtatttattatttcttttattatttcttcaataaatatttttgggtccctcctttattcagatctcagactaggtgaccaggacttaagatcaaaacagaacaatacaaaatatagtttggtagtttatatcttccaagggttttggtccctttcatctaagttatcaaatttgtggttatagtcatttgtaatatttctttattattattattatttttgagacggagtctcgctctgcaccaggcttgagtgcaatggcacgacctctgctggctgcaacttccacctcccatgctcaagtgattctcctgcctcatcctcccgagtaagtggaaatacaggcatgtgccaccacacctggctaatttttctatttttagtagagacagggtttcaccatgttggccaggatggtctctatctcttagcttcgtgatccacccaccttggcctcccaaagtgctgggattacagtcgtaagccaccacgcccagactttttattgtatttttaatgtccatgaatttggtagtcataacctctctttcatttctgatattgttgtttttttctttttttttttttttttgaggcagggtttcactctgtcacccaggctggagtgcagaggtgtgatttcgactcactgcaacctccacctcctaggttaaaacaactctcttgcctcggcctcccgagtagctgggattacaggcgcctgtcaccacaccagctgatttttgtatttttactagaaacaaggtttcgccatgttggccagtctggtcttgaactccttacctcaagtgatccacttgcctcagcctcccagtgtactgatattgataatttttgtcttctctctcatttttccttcattagcctggctagaagtttatcagttttgttaatcttttcaaataaatgtttagattcattgatttttctctattgtgttcctgttaatatagtggtatatggtggttcttcaactctaaaatgactaaataccctagaacttaagggattcaaatatttcattctgtgaataagggtcatgtatgtgcacacaaacacacacgagactcaatgaaagtagagttgctaacacatatacaactattgactactctgccttgtttactctgtattaaatgtttaattaattcatatatgcattcattctgtaattattgaaggaaaacctactgtggccctggcactcttctagtgtctaggaatgagcagcaaacagcagccaattcatgaactcatgaagtttacgttctagtatggaatttaaaactataaataaagaagtaaacgtcaaatagtgataagtgctatgggaaaataaggaatgttcaagaaaaggtattatatatattgtgaggtgccccaataataatatttaagctgaagataagaaatgaaccatgtgccttaatggttgaagggtaatataggagaaggaggaaacagaagttcacacggtgaagaatacctagtgtgttcaaggaacaacaaacagtgagtggctccaacaaatgtattaacattcaagaaaatgacagaggaataattataaagacataatcatagagtaaatattttaataaagtttaagctcttagaattctggacccatttcccatttactctgaaatgtgagagcttttttttaagctttggcacatgcatgctatataaatttggatgttaaattcaaatcactagaaaccttatttaatcacatgtacatagtccacttccattaatcactatgaatttaatagttatcttaaagctaggatggtttgaaaaccctcccacccacctagagactctaactctttcccctttactctcgtagtttccatggttctcaaattttcatgtgcataaacattactatgcacaattgtccacacaaagttaagtttgaaaaacattatgttatgcatagccaaataaacacgaattttttcaatacatcactattggattgttttctttctttagaatttcactcccaaataagttacaacaccattgtagtgaattgaaagagaaccacttcttctgagatagtgtataaattttttgcctataaaaacttaaaatacatatttaaattagataaccaaagtatgtcctcataagaattttcatgtcaataatatgaagatattcttaatattatatcttagtttattaagtaataggtaaatattataaaaacgaaagatgagtaaaaatcagtgagttttaatataactcacaataattacaaatttattaaaaagacatgaattttccctcattgaatgttatttaaataaaaaatataacttgcagataccgtgtaataaaatcattgctatcgctgtagaaaacaaacaaatttaaattttactgcaagacattggttgtgatgatcagtaaacacagatgctgtcactggcatttcttagggtgggtcactttgtagtgtaaaaatgtaatcaagaagtctactgccctgtaaccaatgaagaaagtggggaagcatgttttctttcagtggatttttttttctagtggatatttactgagaaattactatgtgcacatggaccactgcactatatactgaaaacatctctaacttccaggagctcattgtgtagtgcaggacaacaggaaaacaataggtcacaaggcaatatatggacagatgaatggagtgccttgacagtaaaatgatcctgtatttttttctttcaaataactagtggatgtctctctttcatatatttgacctattgatccacagatatgactatgagtgagaagcaggggaaatctgtaacaccttttatcatcttccacatagctaccattcctattagataatgtgggtcttccttctgccaatgtatctcttatattttgtatcctcatccctggaacactgttgcacatgaaagtggactctaaagaatgattgataaattgaatgaattatcatcttactcttgatcatatttctatgcttgataattgtttgtgttcagaaagatacaattgatgaccatttctatattaaaaataaaagtcttacttatgtgattttcctttcagttatatgtctcttctctcactaaattttattgttttagagtgcattttactagaagtacgtaatgaacgcataagtgatatttatatcaagaaacttttatttaatatccattcagttcctgagacaatggtaataccaactcttacaaaacattattaaaattttatttcagatccatttatattgctcagaaagcacattggaattaattcaaaaccaatctaaaggtatagtctctaagtaaacaattagctaggccttgaggtgagtttaataaaatgacatctctgtaaatatggatatagtacagtagtcttttctaattatttacatctaatgtaacatattatatgccagataactgctttttttccataaatgaagtcttctcttttgcattaataattatgactgactcaggttttgaccaaattcttattgatatctagatacattttgtcagtatttgtttatcagtggttggttatcatacaggatgttaaaaagcaagtgtttgagaatatttagttagtaaaggaaaaaataatcttgagctttatttaataatatatatagaaaatatatatacacatttatgaaaacaaaacattgataatgtataatacactgatgcatacacttcaattatttcctatattggcatttctgtctcattctttgtcattagtcatgaacccaaagctttttattatttagctggagaattagtttcagaattagattctaagaggccaaaatgaattgtgtctcaaatttttgattcaatgttaatttatttcttgttttgttgcttttgattaacagaataaaccaaattttataaaagagaaatatatcaaaataaaaacagggcataactcctcatttaattatgtcttcctgtgtttgtaacatagtgtaatagaatttattgaacagagaaagcctattaactctgaaaaatctccaattaagcacaaaaacagagactaaatttcctaaaatataatcttatttaattaaaaaatttttttgaatatctaacaggcatgggaacttgattctcctaaataaagtctgcatgtacatatacaatgatacaaattgttcatgaataattattatataaacataatttgaaagcatgaattatatatacaaattaactgaaagttattttctaattttatagcttatttatatatgtccatacagatacacaaacatgtatacatacaggtatgcatgtatgtatacttattatcaatgaattattattgattaaaagctctaaataaatgtacttgatggggaagactttccaaaataaaaccttgaagacagaaaattttcatatccaaaaactgaagtcagtaattaattattctgtttggattatatcctgtatgttctttgcccttcttttttccctcctggttctcatagacatgtttttgctcttcagtaagaagatattcataaagtatatcagattaatatttcaattagtttgcatactcttaagtctatgcaaactaattgtaacattgtataaatctgatttttctttttttgcatattgggatccttaaaaagcagcagtggcccaggcttctacccagctcaggttaaccttgtatatcagctaaatttgcattatcagggtaatgcaaataagcaataaggcttaaatttttccttctttcagaaattttgacaacttaataatgtcagaaaccaaggaagtaagaggtaaaattttcatatcaaattcaggacaattatttaggaggtgaggtttctcagcaacttgccagtgtaacaccagaaagttacctctaggataaacagttaaaatatcttacctctagaactcccaaactggtatagatttgtcttgaagttaatactattacctacagtcagaatgctttaggttttatgctgctgctttttttttttagaaaagataatttcataactatttatttattattttgtataaactattcccttgtgtaaccccccaaaatgtaagcatgcccaaactttgtactttgagtcttgtattgaacaaataaatacctatgagttactctaatttagtttaatttataacaaattattttaatgggagaagtgtaatttttattagaataacatacactttattagcatttatgcattaatagttcttaaattcacctggtgttggaaagagtaaaatgtatttcacatttgtagctttttctgatctgaattgatttgagagcagaattctgatttgagaaactggatgaatgaatagctaacatatctgttaatgtagttctctggaatatcaatcatttctatagtactctttgcaggacttggaaaaaaacaatgaaatattaacattcctgagtgtacctaaagtgaaagaatactgggtggatgattgaaaagatatgtgcattatttagataaaatcaagcatctggaaatgtagattgttaagcttttgggttggagttacaaaaatttaagagcctgacatattttagcactgatgaagtattatccaacttttatgcttataaatactattaaaaagcaaagctaagcttttttttctttctgaaaaagcgattttgagtatgttgaaataatatgagggatgttgcttggaatagtgtgagggcaagaagaatcctctattggaatataacattagggagaaaaaatctgataaggctactgaaggttgcttcattttaagcacattgcatttttatgtccttactggatgagtttgtaaaggaaaattatatattttcctctaaatagactagcatggcatttagttttttcaaaaatatctaatatctttgtcaccatatgctgacaaagacacgactattttaactaaacttctctatttcacgtatttgtgttgttttcatctgagttagacaggaataaaaaccaaactttgggagattcatttttggaatgcctgtgtgcagggctttggtgaaccagcttctcaataaaacaaccataactggtgaaaataatgggtaaaaaacataaagtatctggaaattgtcctaaaggcatacagcaaataaagaaacatttactcaagaaaatccgcaaaatctcgtaagacaataagagcatgtagtacctgtgtcataatctgttcttttccttccccagctcagcataatagaagctttactgtaggagcccatggccaagaagatggggcatgctctccccaaggtcccaagcaagggctatagcactgtattactttcctagggtgactgtaacaaataccacaaacttagtggcttcaaaaaaatataaatttatcactataaatacagttctggatgccagagttcaaaactgagggatgggcaaagctgcacttcctctaaaagctccaaggataaatctattccttgccttttccaacttctggtggcttcagttattttttggcttatggccatatgtttccaatatctgtctctgtacccatattgcttcttcctctgtggctgtcctctgtgcatcatttataaggacacttgccattggatttatggcccagccagataatgcagcatagtcttctcatttcaagatccttgtcttagttacatctgcaaagatcctttttctaagtaaggtaccattcgcaggttctggggataaggacattgacatatcttttgagaaccaccattgagttcactatagtctaccctctgagccctaaaaatttacatctgcctcatgcacaaaacacatttatcccattccaacatcctacaaagcttcaacgtattaaagcagtaactctatgtccacaatctcacctaaatatcattagcttaaaagtcccagatgtcaccatctaaatcaggtatgggtgagacattgagtattactcatcctggggcaaagtttctcttcatctgtggacctctgaaagtagaaaacaagttatttttaaaaatacaatggcaggatagggataggataacagttttaaatatttccacttcaaaagggagaaaaattaaggaataaaaggatcaccagttccaggcatgttcaaaaccaacaggccaacttcagttagatttcaaggcctgggtataatcctctgtggctaggggttctgccttctgggctcatgatttctctagttaggtgaaatatggagcatggcagctccataagcctctatttgagacagctctatagcttctgaccccagcagcacttctgtaagcctttgtctctgtacctttagtggctcagtaggtctctgcctttgtgtttttgcttttgacttctgcacctatgaatatgcttccagcctctgccttagtgctgtagctccataggcctttgcacccatgtctctgtgggtctctgcacctgtggcacactcatctgggtatttctcgaagaacagaaaatatttgcagccaaatagtaatatcaacctgtttccatcctgtagagttttggaaatctgacaactttcttcattttgtcctctctctgtccctgtcagtccaactgatagtgtttctgctgatacaatattttcaaaaattttgtaggtcttctgtgtatgtcatggggagtcacacaatgagccaagagggtcctccacagatatttcttggattatcccatctcttttcctggcttctgctgaggtgtttgagtggatttataaatcttataaatcctataaatgcttgtctagccgtccattttgctttttctccagagcacactttcctaacagtgaggttaaatttagtgttctttgcaatctggctaggctgaaaaatttcccgttataaaatgctggtttctttttggttaaaattttctctctcaatttgtcttgttcttcctacattttactgtaagcaacagaagaaacatggccacaccttcaacactttgtttggaattctcagctaaatatctaagcttatcagcttacaagttctgctttctacctagctgtaggacacaattaagccatgttttctctgactatataagaaagatcatctttcttctttctccagtgacatttttcttatttccttctgagcctttccccaaagcacccttaacattcgtatttctactaacatttagttcaagagtatatattaaaagtattaatggggaaatagtatttctttcttagcttgtttctcttgctttcatttactcattgaatagctgaggcaagaaatagcaatcaattctgtcttgtggacagtgtggaaatcttgggggcccactgctgagggctattttctgttgtcattaaggattggctatgattttgcagagtacctagtagggagttggtggcaatgcagatctgttgaggggaagtgttaatatttacttagcgactaaattcgaacaaatcaatcctggtaatttgggtatagtacagtaaaatgtaattgactggccaatacttaatctctaggatataattcaaaataagtactgtttacaaattcagaataaatgctatttactagctgattacatggaacgtctcatgagttaccttactcctctaaatcaggaaaaaacaatggttgctttactctgagagaaatgaatgaactaagaaggcttgctttcttctatataggactgggaggattgtttgaagttataaataagaaaatactctattttttgaccaacagtattatttttataaggagatttaaatgccaatatttgctgaaaattttggtatatatacaaacagatactaatttatagtatatgcaaacaatatataatttattagcataaatttactaaatatcatatttaatttcatatatattacatattatatgtaatcaagtcccaattatccatgcctccaaatagatcatctaaagcctgagtagaattaaacctaattattggaaatatacttctaattacttgggccatggtaggccaggcattaattgtttgaagtaggatgatttagaagttttttccaagattaatctgaaaactctaataatgcttctcagttttacctctggccctacagacatgattctgtctaaaaaaaaaattaagaacaatgattttctttcttttattattcctataaaataaataaatattcattacaaattagaaataaaaatgatcattgtaaaagaaaggtgagccctaatccaagtgcttagagataattaactgaaagcattatataattttccaaaaatttctaaccatttgactaagatccttattactatttcttttcctgtttcctgacaccaattctcacttatgctgacagaagagtgattgaacatggacatttgaaaataagcaggctaaagagaaagttagggctgtgtcttcaagcctggccagctaaataattataagtagggtcacggaccaagataggcacaggagtggaattggatttcattgtgcagactggtagggagggtagaatattaaggtgagcaaataaagcgagtaattcaaggccttgcaacttccatttctggttcttgcctcactcaggagactgcggaattgagacccatgagtgaggtgaagcagtgagttatgtgaagtattctactcaatatcaaacaaatgaatgaaacccaagaataagaaccttacacagaagaagctgaaaatacaattaattttcctctcttgctcatcaaataacatgttgtataacaccctggaaaggaatggcaaagtacaagtttacagtatacctagttattccttgaatttattcatttccatatttacagacataatgagataattgcaagcttagagggttgactctagttcttcctggggtacaatacgcaaacagcttgtttatacagttcaagtaccttattaagtggagaaggtaactgtcgtcttaaatgtgatgtgaagacattaataatccagttaactaatgtctaactttagttaacaggagcttagctgtgaatagaaagacaagttgtaatacatagataaaagctggtgcttaatgtgttaaagctctgtctcttgttctactacttatgtattacatactatagatcatggggaaagtatgtaatatgtcatacttgcttcctaaataatattaattcacctgatagatatgtatgagtatctacttatgtaagacaatgcaagacactgccattgatagtttttttgtataatgctttacagttttcaaagtcatttttttaaccaacagtgtccaccaattgaataataatctattctcttaggttcttaatcaaattgtccctaaaatgtcattgggaattttgttatttctgtgatatatcacagaaaatgaacataggtgcagacaaatatttctgtatgtaatgtactgggtccatgtgtccttgggtcccctttatctatctctggaccttcatgataagaacatctgttttacaagagttgggtttctgctctgccctccagacactaggatctatgcacagatttttttttttttttttttgagacagaatcttgctgtcaccaggctggagtgcagtggtgtgatctcagctcactgcaatctccaccttctgggtttaagcaattctcctgcttcagcctcccaagtagctgggactacaggcacacgccaccacacccagctaatttttgtatttttagtagagatggggtttcaccatgttggccaggatggtctcgatctcttgacctcgtgatccgcctgcctcggcctctcaaagtgctgggattacaggcgtgagccaccacacctggcccaggtatctttttgcacctagtcattcatattttatctcataaaggaaatctaaaggacagatcaaagaattattagctaaaataaatcaaacccatagtgtataaaaactattcacaataaacatttacattaataaaaatgtgtgtatttgtgtgcacataaaattgacaatacaggaatacattttaaaagatcaccaaggttttgctttttaatctttatttagttatccattagttcatacgatattcagaaagctcatgtggagtgaatagtacaaatacgtttaacaccagtttcttgaatgagaaaatttaatgttcaaagcttgtgaggtagatatattcaagtaatcagtggtcacttgagaaaacagagggtttttaaaaaatctttgagccatattgttacatcaactgtacttttttcttcctcttcatgtttctgctaatctgtgccatcataaagtagaattcatatttctcaatctaaaaatgcttatttatttattttctaaaatatgacttaactggaaacacaagaatacttaaataatgggaaaaatgaaagagatttcaaagttgattagaatttacatttgccttcatttttaagataatagattcatttgtcagtttagaggaattgtgtttcggtagtaagatataaaatgacatcttattactaaaatgatttatcactgtttattttatatttctcctgatagatctcacgttgctacacttaatgggttttagtacaacatttatttaatttggagttgatgtttgtgttaagtaaagattgaggtatggcattatgtactgttttggtttgttttacagatttacagcactagttaacctataaatacagaattaaacaaaggatagctctacaacaaattaaattttaattcaattaatatatttacttaggtcatctggttacatttaaatttgagcaaagagcttcacttagcttcattactacataacttcctgtctaatataacttacagatttttcaatgtgtggacttcttaaaaatttattgtaatttttaaggggatggggtagaacaatgagaaaaatgaaagggacaaaaatattaattaatataaggtaatataaacatgaactaccaagtcaaattattttctgatgaattcaatcaacataaaaaataaatcagaaccacccaaggaccccaaactctgctatctccgtgtatagatgtcttaaaatattaactctttttttgtattccttttgtgtgtttgtttttttaaatctacgctacagccaacagtatccacatattaggtgtttctggttatcttcatcttgtcctgagttagtttccatctggtataattttcctttagcccgcctagtttcctttagtttcatttgtaccgaaaatctgctggcggtgaaatgtcttagtgttgtttgtctaaaaatatctatacttttattcttaaaatatattttctctggatttaaaattatgagttgagggtttttgcttgtttgtttatgcagttgttatggttggttgttttcccctctcatcatttttaagttttctcatgtcttttagttttcataatttagatgtgaaatcagtgtacattcatataattgttccactgtacgtagtacctcatttttcttcagttgcctttatccttggcagtttgactatgtagttcaatagtgggctttttggatatatctttatttattttatatgcttcttcaatttgtaaatatttttcaacaactttgggaaaattttgactactatttcttcaaataaatactcgttctatattcttcattttctccatctaggactccaattacatgtacaagagagctcttcatattgttacacaacattttattaattaatgttagtcagagagatgaatttgagactaatctcccatcttgttggctgcagcaccagattaaagccttctttcctggcaatactcactgttttagtgattggatttctgtgcagcaagtagcagggcctagactgaacccctggggtttcagtaacactttcctttcccattactatggggaccctaaactttgccctctatttttttcaagccaatacttcctatgcaatactgcatacgctgtatctgaattttagccaccccacatggcagtgaccagtgcttatcctcagttaaggagatgtagaaaaaagacctcactcaatgctgttctctttttccaaatgtcagccatacttcaggttgtctcgatttatggcataattgagtaattaaatttcatgagaatttaattctcctgaattaaatacaattttattacatcaagaatattatgaattaataaagtgaatatttgatgatttttcctcagtttcccagcagttacatagattaacattttattctacttgattatatttttaaataaatatattcaatatattttgcatgtatgcaccctaaggaaaaaaaattgccactactttttagctctatcagcaataactatcaatcttaagtatcatattttattgaaggtcaacttgctgtagttgaatgagaaagtaaccatttattgtttttgcctcagggaccttcattcagctgaactaatgcgactttaacagtgtgaggacagagatcatttactaggaaggacccatttattataaaatctaagaaaatgagtttattctatcctttattcagagtacttgaaaagaatttctcaaatgttttctagtttatatactgttaccatttataattaaggacaaataagagccatgtgaagattaaccagactgctttagtgataatttttctggggccactagagaaaagctaagaggaccacagtgaagtcatccccactatctgttcttacagaaagttagctcacccaatttttctgccaaaagtggaaaataccatacactatatgtcatccacccataaagatccataattcatactagtatatggcatagtagggactctggaaatgttgggtaagaaaacctgtttaactgtgcttagtttagtgtttcctaaacatatttgactacaaatttctttttcacgcatgaagggatatagttagaattctttaggtaaaccctaatgaaacaaataggcaaaactgattattcaatatgttaataaaacctgatatcttgggtgattaggtatatcaatgagaagaaggagcctactctataaagttgaatagtctaaactttgaggaaaacggccctctcaatttgaatgcttctgggtgcttagcatatgaaaaccccatttaggtaacttaaagcaaaggaagattttacaccaaaccatcttagatctgatgacattagtaagaaaagcagtgctctgaatgtgggtctcctttctcttcattctctatgtgtggatgtatgtatgtaagtatgtgtctggcatacaaaagaggaatcatttgtcaagggcaatctgtgagttaatgtgaaacaaattaacacagggaatcagtaaatagatgatgatgactgatgttaactgagtggacaggcttctcaaatgtattatttgggacctcaaaatgggcggccagtttatttttgaaaatctcagccagagactatcctcttcattcctgtggtataaacctggtgaacctacttaagcattccttcttctgcagaaagaaagatgatccttaatataatcagtctcagtgaattatatggataattctagcgacagtttattctaagaattctcttcatttctgccctctcatcaagatgttgctacaaaccccaaggccattgcctataattgtctttcctccttgtttattctggcaatgccctaaaggactcagctcttataccacctcttctgcaaaacattaacaaaacccacaccaacagaattaattgctcattcctttctgcctccttggcacattctttatctgttcatattgccttacagctgtttgttcatttactgcaacattcttgtgggttagagttttgacatattatttcgatctagcttatttttatatatagatcaggtccaatacatagcagtattaaataaacattggttaactgaatgagaaataaacatgggggcttttttgtttatttgtttgttatttttgttacctcactctagtctatattcaaattgtaacactgtcagcttcctctttcaagatatgcttatctgattgttcctcaagagaacactaaaaatcttggcctcctatttaaaaaaaaaaagagtatatgggaagaagacatataatgaatcttctcaggctgctataacaaaataccacacactgcattgctgaaacaatagaaatttattttctcacagttctggatgctgaggaatccaatatcaaggtgacagcaaattccatttctagtgagggtcttcttggcttacaaatggctgtcaccttgctgtgtgctcacatgagctctctagtgtctcttcttataaggacactaatcttattggatcaaggatccattcatgacctccttttaccttaattactttcttagagaactcatctctaaacataattgcactgggggtcttcaatatatgagcatgagggggtacacaaacattcaatccataacaagatatttgatgtttcctacccgtcaggcactatttgtttaatttttgtttaatacagattattcagaatgaaagaatgactgcttgtgactaacagaaagtctttttagtatgtcacatcactacagtattatttcttgggttttaaaaattatcctttacacagtattttcaatttgagaaatattttgggtagtagctgtttgtttttttcattttatctagaataggatgccatattttcttgagaagataaatgcagtgggtattagttgcagtcaattccaggaaaactgttaactggcacaaaacagttaggagcagccagctaccacttcataatcaatcctgcatacccaccaagccctccacctgtggaaattggcatttagatggcagaataattaaaatgaatgagaaacatcagtgttcattgtccatatgctaacggtcatttctctctgtgtgtgttacctagttatttctttaaaggttgtatacgttctctgtattgttgcaattttgttcaagatttgaggcagccaaagggctttagtgggataacattattgtaactacctaaagaatgaaatgattttccaacgtagattcctgattctttgtggtaacttgatctgtgatatgtccagaaatcttttaaggagtaaagattggtatcagtggaatgtttaaatgtgataaaaatgtgtaaagttaataaagttgttggcacttaataggtaagcaacaaatgcaactatttccatccctcaattacatacagtattttgatacctggggaaatataaaaacaaacaaaaaatttcaactggttattgttaaatcagtttttaaagtaatcactcttgtagataaagcaaacactgacaatgaatcttttcactgtttataaaactttgtagaactgagcaaataccactgtcaggtgtctagtattacaccctttatgaaatacccttgttttagcacatatctgggttgatatgtgttaatgtaaccaaatgtcctatcttggagtcactagaatatgaactttataaaaatcaaaacaattagcatttcactagataacaagagtttcatatgttggtaagaaattaatcttttaaagaaattctgaaatctgatgaactcatataatctctaaatctgggtgtgtcctctgctttgaacatttatgttaatttaattctgtataatttaattagaatgtaagaaatgggatagtgacctataggaattatgacacttgatgtttaaaaaatcatgagataaacaaggagtaactatcatttaaaagcattctagtgacatcttatgttttacaaatttttgtactactcattttcaagtaattaattcataaaggagagaggctttttggactgattaagaataggataaaacagatttttgtgggaaatatttaatacatggtgaagaaatttaatctccttcaatgttattaatattgtctcacacagctgtctctacgtctaaacttttgagagcaaattgagctgtgaagcatattatgtttagaattaaaagatttggttctagtctattctttcggtgacagacttgttagttttctcacatttaagttgggtgtgataatcacctattctaattacctcaggtgtctatataagagtcagggatgttcaaagagcacaaacaaaataatatataacttttctattaagagggtagtaaaagagcccagctatttgaaactctaaaaacatttctgtttataagtctccctacatgtttcttagatgaggtttagtttggactttcccaaacctatcttcacttgcttttcacaaagttattgtactgcttgttgctcttaaaataaatactcataatgccctcagaatgacttttaaaacaataattacttgcattttagttttcttacattttattattcttatgtaattatgaagaaaagatctgataggtttttaattttgatacaagttttgggtttttgctttgttttttttctccttctgttgttatgttaaataacagttttacctatggaatttttcttacattttgcactatagactgaatttgagatgagtcattcccatctcaaaaaaaacacattaacatgttgaaaataaataagaaaaactgctagctcttagttaatatagaccagcacttaacaacatgctgagtctattatggaattggcattaacacagaccttgaagtctttcatgtcttatagttcctatggtgaggtaataaatcggctgtgtgttagatgatataaggtatgtggaaacgaagttgcaaaaacttacaatggattacttatggcatctgctagatgcagagaatattttaattcatttaatcatgaggctatttttctgactagaaaatttatttttaacaccttttaaaaggagtgaaaatagatttccagatactaatactgaaatcccaatagccctctgcaagggatagaaaggttcctttctaaattttattgccagtaacaaaatatttcaaattaccaaacgtaaaatctctaaatccagtgaaatatagtgaataaattacatagtgtttcttagggaaaaaagtaaacatgtatgatactttttatagttacaaagttttccagataaaatacttctggtaaattcgtgagtttccaaaagacatccccaacttccattactcagattagtcttataacattggcttctctctttggtattaattgtgttccacaatttgtaaggcattgtgggggtgtattgcaagcctggtaggttaacattaaatctctgtgtgaatgtggtattgtagctatttgttagttaataattttcatattgtattaagtgattagtgatagaaaaagttaaacacatattcatcatttaacctggaatttccaaaaataatttacttctttggtggttttcttagtccattttgtgctgctataacaaaatactgcacactggataatttataaagaacagaaatttatttctcacagttctgaaggctgagaggtccccagtcaaggcactggcatgtggtgtctggtgagggccttcttgctgcctccttatgtggtggaaggcagaagcgcaagcagggatgaacactgtgatctcacattgcagaagagtgaaagaaaaagagctcactcccacaagccctttctacagtgcaattaatccattcatgaaggttgagccctcataacctaaagacttcccatctcccaacattgttactttggggattaagtttcaacattcgttttggaaggaataaaaaaattcaaactattgaattctgcccttggcacccccaaattcatttcatccttatacacaaaatacatccattccattccagtagcctaagtcttaatttgttacagcatgactttaaaattcccaaatccagagttttatctaaatcagatatgagtgagattccaggcatgattcatcctgaggcatattttcctccagctgtgagcttctgaaataacagaatttatatgcttccaaaatacaatgatgagacagcataggatggatattaccattccaaagggagaaataggaaagaagaaaggaacaacacgtcccaagtaagtctaaaacacaagagggcaaactacgttagatcttaaagatccagaataattacctttgattctatgtcctggacacactgaaataaagtttagggccccaaggcctctgtcagacctgcttctgtgactttgctgggtgcagctcgtatcactctcataggctgaagtaaggtgactatggcccttccaggctgatgttgcacacatttggctccacaattatgggatctctggggcaccctgctcccacgactccactggacatcaccctattgagggctgtctgtggcagccctgaagctgtttgagatggcctttgaaatctgggtagaggaagctatttctctataattttgtgtgcctacagaattagcagcatgtagacaccaccaaggcttaccacttccaatctctgaagctatggcttgagccacacttgggtatgcctgagctacagctgaaaaagccaaaaagcactgcattggaatgcagacagcagcaatctaaagtggtttctgggtagtgagactcaaggtcacacatgtgccctaggatcttctcttgaaaactttctgccctcaaggccctgtaactctgggcatgtgatgggcattggagcctcaaaagactccaaaatgtcttcaaagtcattcctccattgttttgatgaatagcacctggattccttctacttatattaatatccttatcaaatgatctctggccacacccttagttttgtttgtttgtttgtttgtttgagacagtctcactcttgtagcccaagctggagtgcagtggcgcgatctcggctcactgccacctctgtctctgggctcaagccattcacctgccttagcctccctagtagctgggattacaggctcccgccaccacgcttggctaattttttgtatttttagtagagacagggtttcaccatgttggccaggctggtctcgaactcctgacttcaggtgatccgccagcctcggcctcccaaagtgcttggattagaggcatgagccactgtgcccggcctttttttttttttctaaagttgctttttaattttttttacatgactgggatgaaaatttttcaaaatttttgtgttctgtttccagtttaattacaaattccctctttgttcccagttcttgaattttactataagcagctaaaagaagtcatgcaccatcttcaatattttgctgtttagatatttcttctgccaaatatcccagttcattactcttaaattctgccttctacaaagcccttgggcttggacaaaattcagcccagatttatttatttatttgtttttgccactttacaatgaaagttgtgtattagttaggcttctctagagggccaaaactaatagaatagatgtatatatgaaagggagtttattcagtagtattgacttacatgatcatgagatgaagtcccacaataggccatctgcaagctgaggagcaaggaagccagtccaagtcccaaaacctcaaaagtagggaagccaagagtacagccttcagtctgtagctgaaggcccaagagccccttgcaattcactggtgtaagtctgatatggtttggttctgtgtccccacccaaatctcactttgaattgtaataatccccaagatgtcaagggcggggaccaggtggcagctttccccatactgttcttatgatagtgagttctttcgagatctgatggttttgtaagtgtctggcatttcctctgctggcactcattctcttgcctgctgccatgtaagacatgcctttttcctcttttgccttctgccatgactgtgaggctcccccagccatgtagaactgtgagttcattaaacctctttttcctagtcttgggtatgtctttattagcagcatgagaacagactaatacaaagtccaagactccaaaagctgaagaaattggagtctgatgtttgagggcaggaagcatccagcacagaaaaagatgaaggccagaaggctcagcaagtctgctctttccaatttcttctgcctgctttatcctgctcacacaggcagctaattagatggtgcccacccagacagagggtgggtctgctcccccagtccactgactcaaatattaatctctttggcaacaccctcacagacacacccaggaacaatactttgcatccgtcagtccaatgaagttgacactcaatattaaccatcacagatggcttttcctccagttcccaatgtcttgttcctcatctctgtctgagaccttatcagaatggcctttactgtacatatttctatgaacattctgttcataatcacctagaaaaacttctaagaattaggctccctctacagctatcctcttctgagccctcaccagaatcacctttaatgctctgttcatggcaatataggttttttctatattgttccttcaaattatttcagcctctatttattacccagttccaaagccacttccacatttttagttgtcatagcaactcccaactcctggtacccacttctgtcttagttttatgttgctataacacaatatgacaaactgggtaatttatgttttttctttatttcttctaaaaaagaataacaggatatatgtacagaatgtttaggtttgttacataggtatacgagtgccatggtggtttgctgcacatattgacctatccactaagttccctcccctcacccctcacccccaacaggccctggtgtgtattgtttccctctctgtgtccgtgtgttcttaatgtcaactcccacttatgagtgagaacatgcagtgtttggttttctgttcctgtgttagtttgctgaggatgatggcttccagcttcatccgtgtccctggaaaggacgtgaactctcttttttcatggcagcatagtattccatggtgtataggtaccacgttttctttatccagtctatcattaatgggcatttgtgttgattctgtgtttttgctattggaaatagtgcctcaataagcatacatgtgcatgtgtctttacaatagaatgatttatattcctttgggtatatatgacaaactgggtaatttgtaaagaacaaagacttatttctcactgtccttttaaccactgagaggttaaatattaaagtgctggcatctggtgtctagtgagggccttcttgctatggatacaaatgttatatcctcatgtggcagaaaagcaaaagagaaagaacccacttaacaagtcctttttattgtggcattaatccattcaagaggattgaacctcactacctaaaaatctcctgttaggtctcaccactcaacattgttgcactggggattaaatttcaacatgagttttgggagggacaaatacattcaaaccgtagccatagtaattatttccccacaaattattaccaagtactctgttatctagtgtctactatttattttcaatactgaaaaagtgtgatttgcttttatgtttactataataattaagaataaggaaagagtccattttttgaaatcgttctcatttaacacatttgggctaattaaatgaaattctcaatgctagtcttttatgaacaaaaaaagaagagaatatttgagtgccccagtggaaaaaatatggcaaaaataaaacaagggaaagaaccctctggctattttctcactttctttctcaagtcagtttatccttatgtcactttcctctgatcctgcttataatgttgtctctgtagaacacattattttagtctgcccagaacatttctctctccttcttgtaggttggatatgtgacataagtgaggtgagtcatggctagcattcattaatctggccaaattgccagtatgggagtagtcacatgattcaagttaggaaaagcagagttctgtggggtttttctaagtagaactagcaggaagaattctctcttctcttttggatatcaagtattaaatgtagtctaaaaaacccttcagggagcaagtctttttcatgtgacaaagcccaagaagtatacaagaagcagaaggagtcttacaggaacaaatcctcagattcatactctaatgcctctgagatgcccggttcctgcagttcttcctttaatttttgcagctatcttatatccttccaatccatcccatgtttagattaaactattttgaatttagtttccttcatttggaatggaaaatatctgcttgaagctgcatgttcaaaaagggaatgtcaaaggatactgtagtattcatactttatataccttctttaaactgcacctcagcgattcatctgtaccaaattttacatcaaaatcaaaaatctccattgcacagactcatttataactataacgtgggtgttgttgggattctccatttgccttctctaacattagactctgctacacaatgatgcaatgtatgtttagttttttctactgcaaagactgaatctctagaattgtttttccccttgctcttgagagctaacagaatattcagtgtaacttcttgcccactttccatattcatatgataatcagatatttgccctgttagatcttctaaatttctaattaatcacacagtttaacgtacaaagaaaatttaaaaatgctcccaagtttctttttttaaaagaaaattattttttaaaatgtattttaagtatgctcttcttaaaatgttactttagctccatggagataatcctttttgattctattcatgttacatctacatgttctttaaatatctgtataagaactaccctttctagcactacctgaaatttataatttattcataaagcatttttatgatgtttttctttatgtttttgcatactttgtctgctttttttctgaagtaaaatattttttactgattataatgtgaatacataattaggcagaaaattaaagcaatagaagaaataataagagtaaaattttctccaaatcgaagcaggccattgtaaacagttaaactaaacacctttttaatttaaacttttgaggtaattgtagatttatatgcagttcttagaaattacagggaaatatcccttgttcctttacccagttttccccaatagtaacatcttgtaaaactatatattaatatcatgactagactattgactggatattttgacatgtgtgttgctagtacataaatgcaatttattttcatatatttatgtgaacttacatattgactctagaaggtatcttcttgcagattttttgttttgtttttatgtagataattatgccatctccaagtaagaacagttttattttttcctttctcatctgttcacaacaaagtgctaaattagatatagattttttaatgcctttatcatgttgaggaagtttctctctattcctgtttttctgagaactatttatcatggatgggtgctgactttttcaaatgctttttctgcatcaattggcataattatgtgatttttcttctttaacctgttgtggtgaatattgatttacatttgtgaatattgaaattaccttgcgcttatccctgaaatagacttgacttgatcatttggtcatggtgtttgtgtgtgtgcatgtatatatttatttatttactgtattagttcattttcatgctgctataagaacataaacaagactgagtaatttataaaggaaagaggtttaattgactcaccattccacatgccttgggaggcctcagcacacttacaatcatggtggaagaagaagcaaacacttccttcttcacctggtggtgtagcaggacaagacgcagacaaaatccctcagacactgagttgtagaaagaagggctttattcagctgggagcatcggcagactcacatctccaaaaactgagctccccgagtgagcaattcctgtcccttttaagggcttacaactctaaggtggtccacgtgagggggtccacgtgagagggtcgtgatcgattgagcaagcagggggtacgtgactgggggctgcatgcactggtaattagaacagaacagaaaaggacagggatttttcacagtgcttttctatacaatgtctgtactctatagataacataactgattaggtcaggggtcgatctttaactaccaggcccaggatgtggcgtcgggctgcctgcctatggatttcatttctgccttttagtttttacttcttctttctttggaggcagaaattgggcataagacaatatgaggggtggtctcctcccatagtggcagggaagagaagtgccaagtgaagtggggaaaggccccttataaaaccatcagttcttgtgcgaactcactcactatcacatgaacagcatgagggaactgctcccaggattcaattacctcccactaggtccctcccatgatatgtggggattatgggaattacaaatcaagatgagatttcagtggggacacagagcaaaaccatatcattccaaccctggtccctcctaaatgtcatgtccttacaaacacaatcatgccttttcaacagtcccccaaagtcttagctcattccagcattaatcccaaagttcaagtcaaaagtctcatctgaaacaaggcaagtcccttctgcctatgagcctgtaaatctgaaagcaagtcagttactttttagataaaatgggggtacaggcattgggtaaatatgcccattccaaatgggagaagttggccaaaacaaaggggctataggccccatgaaagtccaaacttcaacagggcatcaccaaatcttacagttgcaaaatgatctcttttggctccatgtgtcacatccaggtcacactgatgtaagaggtggactccaacagccttgggaagctcagcccctgtggcttcaaagggtacagccccattcctggctgcttagctggctggcactgagtgtctgtggcctttacaggtggatcagtggacctaccattttggggtctgaaggacagtgggccttctctcacagctccagtagagagttccccatttgggactctgtgtgtggactccaaccccacatttaccttctgcactgccctagcagaggttctccatgagggaccacctttgcagcaaacttccgcctgaacgtccaggcatttccatacatcctctgaaatctaggtggaggttcccaacctcaattcctgacttctgtgtacctgcaagctcaacaccacatggaagctgccaaggcttggggcttgcaccctctgaatccatggcctgagctgtaccatttttactcacgtccctgtgaagagaacaccaaacaggctttgtgtgagcaacaaggctgtttatttcagccaggtgcaggtgggctgagtccaaaaaagagagtcagcgaagggagataggggtggggccattttataagatttgggtaggtaaaggaaaattacagtcaaaggggggttgttctctggtggtcaggggtgggggtcacaaggtgcttggcgggggagcttttgagccaggtgagccaggagaaggaatttcacaaggtaatgtcatcagttaaggcaggaacaggccattttcacttctcttgtggtggaatctcatcagttaaggcaggaactggccatctggatgtgtatgtgcaggtcacaggggatatgatggcttagcttgggctcagaggcctgacattcctgtcttcttatattaataagaaaaaaaaaaaaccgaaatagttgtaaagtgttggggcggcgaaaatttttgggggtggtatggagagataatgggtgatgtttctcaggactgcttcgagcgggattggggcggcatgggaacctggagtgggagagattaagctgaaggaagattttgtggtaaggggtgatattgtggggttgttagaagaaacatttgttgtgtagaattattggtgatggcctggatatggttttgtatgaattgaaaactaaatggaataagagaaggagaaaaacaggtattaaaggactaagaattgggaggacccaggacatctaattagagagtgcctaaggaggttcagcatagccttgccagcaaagattatttatttacgttaagagttaagagtggcagtttggggatagcaccaggagatatcagctgtgatggcttggagaaacagtgtaaaccggcagtgtaaacaagagcagggcatgcaggagtagttgagaacagtgaataggagtatgactagagagaagatagtagggatgacaagttttttggggcacagtccaagttggtctggtatctggaatgagactggggcctaataaaaaggagcatccatacaggagcttaaatgggctataacctgtagcattccgaggacaggcctgaattctgagaagggcaagtggtaaaagtattgtacagtcctttttaagttggtggctgagattggtgaggtgtgtttctaaaggaccattagtccattctacctttcctgaagattgaggatggtaagggatgtaaaggtttcactgaataccaagagtctgaaaaaatgcttggctgatttgactaataaacgctggtctgttatcagactgtgaagaggtgggaagcccaaactgaggaattatgtctgacagaagggaagaaatgaccatggtggccttcttagaccctgtgggaaagtcctctacctatccagtgaaaatgtctacccaggccaagaggtattttagtttcctgacttggggcatgttgagtaaagctaatttgccagtcctgggtgggggcaaatctccgagcttcatgtgtagggaagggagggggccagaataatccctgaggagtagtagaatagcagatggaacactgagaagttatttccttgaggatagatttccacgatggaaatgaaatgagaggttctaagaggcggggtagtggcttgtactatagcatagcctgcctttgctggtgtgtggcgattaggcctggtgggaactgccatcaataaactaagtgtgatcagggtgaggaacaagaaagaaggaaatatggggaaatggggtgaatgtcaggtggatcagagagatacagtcgtgggggtcaggtgtggtatctggaataatgtgggaggctggattgaagtccgggccaggaacagtggtgattgtgggagactcaacaaagagtgagtacagctgaagaagccagggagcagacagtatatgtgtcaggtgtgaggaagaaaatagattttggaagttatgagaactgttgatcatagttcgtgattttaagggcctctaaaagtattagggcagcggcagctgccgcacgcagacttgagggctaggcaaaacagtaaggtcaagttgttgggataaaaaggctacagggtgtggtcccagttcttgtgtaagaattctgactgcacagtcctgcacttcagctgtgggtaatgaaaagggttctgatgagtcagggagagttagggtgggggaagtctctaaagctgtcttcaaggaacggaaagaggagtggggaaaggatttaggatctatggggtcagataggtttctttttgtgagtttatataatggttttgttaggatggcaaaaccaggtgtctaaagtcgaaagtatctaaccatgcctaggaaggaaaggagttattgttttgtagaaggtgttggggtttgagagatcagttggacacaatcggcagggagagcatgtgtgtttttatgagaattacgccgagataagtaacagatgaggaagaaatttgggcttgattgaaagaaatttgggcttgattgaagtaatgggggccgtctgtgaagccttgcggcagcacagcccaggtaatttgctgagcctgatgggtgtcagggtcagtccaagtgaaagcgaagagaggctgggatgaagggtgcaaaggaatagtaaagaaagcatgtttgaaatccagacagaataatgggttgtggaggggggcattgaggctaggagagtatatgggtttggcaccacagggtggataggcaaaacaatttggttgataaggcgcagatcctgaactaacctgtaagccttgtctggttttaggacaggtaaaatgggggaattgtaaggagagtttataggctttaaaaggccatgctgtaacaggcaagtgataacaggctttaatccttttaaagcatgctgtgggatgggatattggcattgaggggggtaagggtgattaggttttaatgggatggtaaggggtgcatgaccagtcaccaaggagggagtagaggtgtcctatacttgtgggttaaggtggggggatacgagaggaggatgtgaaggaggctttgaaatggggaaaagggtggcaatgaggtgttgctgtagtccaggaatagtcagggaaacagataatttagttaaaatgtcttggcctaataagggaactgggcaggtggggataacttaaaaaagagtgtataaaagaatgttgtctaagtgggcaccagagttggggagttttaagaggtttagaagcctggccgtcaatacccacaacagttatggaggcaagggaaacaggcccttgaaaagaagtaatgtggagtgggtagcctccgtattgattaagaaggggatggacttaccctccactgtgagagttacccagagcatctgtgattgtcctgtaggcttccaaggcgattgggcagtgtcagtcttcagctgctaagccgagaagatctgggaaggagtcactcagagagccttgggccagagttccaggggatctggaagcggctgccag

SEQ ID NO: 87 - DNA, 759 bp, Homo sapiens
gtgggaagatggcatgtgagcgtgccctgcttgtgcagttgccagtcacagaacccaggaggtctggaaagcaaacctctgtttggccaaaggtactgaagggtggcagaatgtgttgcccccaaatatgccattttggcataaggattatttggagctaaaggcacttgaaaatagcagatgcatatgaggacccaaaggcataaaaataatagactctgaggacttgggggaagggtgggaggaggatgagggataaaaggctacacgctgggtgcagtgtacactgctcgggtgatgggtgcaccaaaatctcagaaattactgctgaagaatttatccatgtaaccaaacaccacctgttccccccaaaactgttgaaataataataaaaagaaaaagaaaatagcagatgcaaaaagtgaatcttaatctttttttcttccttaaaacaggagataaaagtcccacgtgaaagatgccctccctgtaccaggagaataaaaaacattctttgacgggggtcatacccaggataattctgtacaaacagaccttgctaaaataacccttatcttactttgccttcacacatactttaatgtaattacttttctgcagttgtactctttgctcaccctactatacaagcatttaggtttcggcacttctttaggtcttgaattttctataggggctcctatatgtaaaaatctgtatgtttttctcttgttaatctgtcataggtcaagttaattc

SEQ ID NO: 88 - DNA, 5061 bp, Homo sapiens
atttggaagatgcttccagtcaagtctcaatctcagtcggtcactggtccatgtatatttcatggacatctaccctgtgctgggcactgggcagacaacagtctactggacccagtctcactctcaaggggactgtagtccaagagagaggcaggtagattatcaggtaattccagctcaccacgattgatgggaaggtagggaaagtttgggatacatgcaaggccgtaggagaggcaccccaccggggcttgggggcaggaaagttttccaggagagagggatatctacgtggctttctggcgggggggggggggtcggggagagagagagagggagagagggagagagagagagatgaatgagatctgccaggagtcctcagtgcctggagctccaagggaggaaggctagggagggaagccatgcttgtcctggggccgagatgaggaggaaggggagggtctgctccaggccagccctggacaaggggataaattttgtcttcaccagacactgaattggtcatcctcacctcccaccttacagatgaagaaactgaggctcaaagagccacagcgggacggaggaggtggacccggctctgatgcaggtggctggttcgatggcagactcccctgtgccgagactcccagaccaaatccggaggtcctggagtagagtgggtgggtccgccagggcatggccaggctgcctgtctctggagactcccccaaggaagtttcttgaccttgaggatgataacgcagggcaggctcttgagggctgtgcagggactccctggagagccctgggaaaagcaggtccccgcctgcctgggcctctgcctctgctgcaggggccagcacaggtgtcaggtccccacacatttcatgtccaggccattttcccactctagggccaaggctgggcacttcccagtcagtggcacagctggtactgtggggtctctcgctctgcaaaggttggtttcaatcccaagtgtcactgctggaaacactggccaccccgggacatgtggtcttgccagtccttctgcagggctctgtttcttaggtcccaatcatctgcagggagcactagtccgagatcttccaagatgctgggcaggaacaagcctgctatgctcattcccaaaggactccacatctagataaatgaaggcctggaaggctctttggctctacactagcaaaacagcttacgtcaccctgcctaaagagacagtcaggaaatccccttgttcctgggcgaggagaagctggcccacacggagtgacggcattgagcagatactacccttggctcgctcatggatggggcggggcctgctgaccttgacagcaatcaggggagggggtttggagggaaggggttagctggtgaaggtgagggaaaggactggagttaggacagggtgcagcgaccacatcctgtgacgaggaggcatctgtgacctgtgtgatctgccaggcaggcagcacaagtcattgtactgctactatgcccgctactgagacaggaacaaagagaggctgtttctgcctcttggtgctctccattggacatgtctgctgggcagtgctggcttttaccataggtatttttctgctcttccttccctcctcctctccctctctcttttccagggcactcacacacacacacttgcacacatgtgcacagttgcacacacatgcattgaacacatgtgcacatatatgcgtttgcatccacttgcacacccacacacctgtgcactagcacccatttgcacgcatgtccacacacttgcacacatgtgcatttgcagaaatgcacccttgcacttgtgtgacacacctgcacacttgcatacacccatttgcatacaggcacagacacactcgcatacatttgcacacacagccacaaacttgcacaagcagcacttgtacactgacacatatccgtttgtgcctatacagtgcacacttacacatttgcacacagctgtgcttgctcacacatttgcacacacccacctacacacttgcacacatactacacacttgagcgtgcagcacacatacctatgtgcatacatgcacatttgcacatgcacacagcagtggcacacacttctctatcactctccctagtcactgttctcccctgtgattcccacccctctgaccgcccctgctcacttgctgccccctccactggaaggggcctggcctggtgccctgtctctgtctgtctccaccgtgcagggaggtttcacaaggactggctgatgtctcgcctcgagctggcctggccgcagctgctgctgagcggaagtctctgaggggcgaggctgagaggaaaccacactctcactggggttcccgcagctctggcctctggggaggggtgtggagatgtgtgggcgtgagatggctttgagggagggacagcatgaagcttttcgctgggtctgtcttttcagtctccaggacaaaactaggccactgtgctccaggagaagggaaaacccacgtccccccaggctgggcccaccggcaaatcgggctcccaggcccttctcagcccatgcttctgtctctgccttgtcaggcttattctttggggctttgaagcagcctttggtgggcaaacggcatctcagggaaccctggcctgtctcctccagagcttgtgccttggccctgggcaggggccaccatgggctgttgatgtaaatggcatccccagagttgtgcagtgtgggggcaaccctgaggtatcagcccagccccctgtctgcagcttttgctacccagcccagctccagctctgtctttgtcactgggggtggtgggggaggctggagctcagggacggggcactcctggcagattctccctgccccaggtggaaggggaggggggaagtacccatcctccatcctcctatcctgccagcggggtgggcgctactatgctggggagggtctggctgaataatgatgctgagctcgggacaccagccttctccgtgcacctactgtgtgccaagtaccatcccaagagcattatgggtggtaacttatacaatgactcagagaggcaccgctataatcacccccagtttctgtctggttccagtcctggccacacagctaataagcagcaaatggatttgatctgattttatctgaacccaggcaggctggcccagagcccactgtctaatcattgggccgtccagcctgtcaagactccaggctcgctggcgtcgtacccctctgtcatttcccagggaaacaagctctagcagcacctgccctgtgggtactttggccctgcctccctgcctccctgcctccctgcctccctgcctctcatgataggagccaaagaatggtctcctttgcaggaaaggagctcgacgggggtcttctcttgcaggctctgtcttgcatgtgggtcctgagctttctcattgagtaaggggagggggcagctggttcagtccagcgcagagtggatggaggccagttgaggctttcttgaaaccctaagcccagctgggatcctcggggaaggatccttcgctgggatctgactggctcttccagaggtcagtggggcatgtggctggagcccaagtaggagggaggaagaaatggtggtctgagtcctggggtgaccaggccctgaacctgccctgctgggaccccattccctgactctaggccccctttccccaccacacaggacaccaggctcttgccttaagacaggaaaggaaatgccttatggtgaacaattctccaggtccctattgtggctccaacagatgccagagggacatggcaggtgaccctggtctcctacgaccctgactttacttgctgtcatgaggccaatctcttaccttgacccacctcctgcctctgctttcagaagggcagaagagcgggcctcctctagcttcccagccgcctcccgcctcctgccgcccggcagcgctgggccccccagcagcgaggttcaggaggggaagaacctctcgcaggtgaacaaattgctgcacatcagacacattcttttcaagcctcattttctctccttttcatgctaactttcccactattaaagagcatttttaaaaagaagatgaaaaaaggcagagagaaaagaaggatgaaagtgtgagcgggtatccggaagtccttttcaattgcctgctgctgtgcagggtctgaactaagagcaagaaattggaggatgctggaggggcgaggtttcgtttcagtcctgcctattgggccaagtctggggcggggaaggagaggtgatggaggtgggcctggctgggccctgcggccctggaggctgcccctctgcctgccacccagcccctggcctgtgcctggcacaggaagcccgtcaataatttcttgttgaatgaatgaaagaaaagaaatcagtggatggagaagggctggattcttttgtggggaccttccacgccaccttctctgtggggctctagggctgagaaagaaaggacagatttggcaaaggtcaggcaggggctgggaaagcattaggtggaccaggcatgctacagcaaggccacgcctgcactgttgtcccactggtgacacccatgggtgcagccatggcgggtgggcgcagtttcacatgggattgggggtgagcctgggttgggtgggcgacccccaccccttccctacccctctccccaccagcaggtactactgggtctgcgtgaagataaaagctcaggaacatgccaggaaggtgtgaccatgatgatacctctgagatgaacccaagaagaaacagcagagtattacaaaggggaacaggactcagggtggacttcaagtatcattaaacataatcaaatatttaaaaagttattattgactgggtgcagtggctcacggctttaatcccagcacttagagaggccaaggtaggaagattgctttagcctaggagtttgagaccagcatgggcaacatagtgagaccccatctct

SEQ ID NO: 89 - DNA, 3081 bp, Homo sapiens
aggaaatggggcagccaggagtgctcgagaacagatggggccaggcaccatggcccacacttgtaatcccagcactttgggaggccaaggcaggcagatcacttgaggtcagcagttcgagaccagcctggccaatatggtgaaaccttgtctctattaaaaatacaaaaaaattagccaggcattgtggcgcacacatgtaatcccagctactcaggggactgaggcaggagaatcgcttaagcctgggaggttgaggttgcagtgagctgacacgccactgtactccaacctaagcgacagagcaagactccatttcaaaaaaaaaaagagaaggttctgctttagagaccacaggagatgaagcataagacagaaggggaataaaaggggagagggcagaagtgtccttcacatctcctcttctttaaggggggaccccagcaggtagctccagaggctgcctttccaccattagagggcagcagaggtccatttccgggctggggccttagggcatttctgggtgaggtgtttggggtatgcccattgacaaccctgttccttttctttccgggccctcccatatgtgatctctccaccctagatctacccctgggccttggggtgtttcttcaggtagggttccctccccgcatcagaggatgaaaaggaggggagtatcttagaaagcatgcacagactcttgaggcaaatccacccttttccagcatctgcatgttgccctgaagtttacctgtttgacaaagtgctcttgaggacagctacctttgcatctccagcatagaatcttgtacttagcaggtggtttaagtcatgttctgccattctttaaggacttggcggcagaacaatgacagcatctagtaactggggctccagacccttctaaccagagtgaccttggaggagaaagggatcgcctttgccttagtctgtttctgcatttgtaacctaaagggattcggatttaccattctaaaactccaggattaaaatgtgggtaagtctgtgcctttcagctaaatttggaagtatcacctctcagcctccccagggatatgaggcggcttgtgaggtcctctggagtcagaagatgccaccaccccagaggatgtgagcccacctgtggaggtcttgatccccaccactaggatggggcaggtgagaccagacccttccctcttccccaccagggtctccccgcaacttctgtccccactctctgttgcagaacaggcaagtggccagctccaaactagggccacgcccacagccagtgctgagcatgctgcaccagaacaggtgttcacctacctggccctgatccctttttgggagaactgggacagaaggctctgggtcctgggctgcacccaggatggaaggaggtagggaaacagcatctccaatgatgctgcggccagccaggcctgcccactcagagccttggcccagtacaccctaggcagcaggcagggaacaagcaacactcctgggtggccattctattcctgtcctcagccctcctcaagggtcatcattcctggcactctatttagccccaaggtgggtgactacatgaactccctgtggtgaggggtgagtagaagcccatggaagcctccccactgccatgcaaccccatcgcatctccactgaactccgagcagaaaacggctgcctgatgggaactgtcatttaggttcccaggctactttggtggatctgagaataaatccctcaagacaaggtccttgctctgcccttctccagggtgggacccagagttactggcccctccatcccatggagccgattctgcaaccctcacttcctaagcacaggtaaggctcacctgttctttaaagacctccaaaaagtgttctttcttggctgcaacctaactccctcctgccacacctaaggcccatttcttctggttctgccttcaaatgattcagagagattagaggcagagtcattcctagagtgacatttttactagtccacagtacaacaaaaaaattaaagacaaaggaatgtctatttgttggcataaagtccattgaccatcttttcttgggaataattgttttctttcttttttttttttcttttttttgagacaggttctcactctgtcacccaggttggagcgcagtggtgcgatgttggctcactgcaatctctgcctcccagactcaagcaatcctctcgcctcagcctcccaagtagctgggactacaggcatgcgccaccacaccaggctaattttttgtatttttggtagagacagggttttgccatgttgcccagtctggtctcgaacacctgagctcatgatccgcctgcctcggcctcccaaagggctggaattataggcacgagccaccgcgcctggctggaactaacagattcagatgatgtcactcctattttgagaattaaaatgtattttcttaggtcaggcgtggtagctcacacttgcagtctcagcactttgggaggctgaggcgagtggattgcttgagcccaggagttcgagcctggcctgggctgaagcaaaccccgccaacccccaacaaaaaatacaaaaattagctcagcatggtggtgcgtgcctgtagtcccagctattctggaggctgaggcggtaggattgcctgaacctgggaggcagaggttgcagtgagccgagatcatgccactgcactccagcctgggtgacagagccagaccctgtctcaaagaaacagaagtattttctttaatgatggtgataatagatcgtaggtatgttctccatgcccttagggagcgtaaatttaaagctgcaactctttatgggaacctggctttcacttgttttctggctttgtttttctgtcaaatccagaaatctggaaccactggttaaaaagaagtctgagagccaaaatacacacagccagctgtgagttactacctgccttacccaggaaaaggacatgagctgcccaagcacacacctctttgccatctatgccagcatttttaccttcaaggccgatgttctca

SEQ ID NO: 90 - DNA, 35097 bp, Homo sapiens
atagtgaaggcagaccacaggctggcaaatggaaatgcatgatgcttcctaaggcctaggctcagacctggcaactgtcaattccactttcctcatcttatgtaagtagaaactctaaagcaaatctgcacaaggaatgggattctgggaaatgtagttcccagccttagatgcctatagtgatggtggtaaaggtgagggtgatggtgtgatggtgatgggtagtagcggtgatgatggtggtaacagtggtggtaatgatggtgatgatggtgacagtggtagtgacagtggtggttatggtggtgatggtggtgatgctgttggtggtgatggtggtggtggtggtgggtgataatggtggttatggtggtggtggtggtgggtggtgatggtggtagtgacagtggtggttttggtggtgatggtggtagtggtgattatgctggtggtgaaggtgaatggtggtggtaatggtagtgatgtgatggtgatggtgatggtggtggttatggtggtgatggtggtggttatggtgatgatggtaccggtagcagtgatgtgatggtggtggttatggtgatgatggtaccggtagcagtgatgtgatggtggtggaggtgcagtggtggtggtaacaagctgaaaatagataattaagcgcagtatgaaaatgttcagtccctgagcacctttctagacataaggttgaaacaacttctatactttctagaattcaattcaaagggaaacatgatcacagaggctgtaagattcacttagggatgggtcatttataattcattggggagcaggttctttttgtgtgaagttttatcttcatcaatttcaatcatttctgttttttatctgatgattccactgttttctctgttttctttttctgtcacacttatgtctcatcatatctctcatttttttcatctttttatgtttgggaaaaattttcctgactccacctttatttttaaatctcaaatagttgttcttttccatttctttctttttcagaatattttgttcttggtttatgtactaaaaattttacatctctctattaattggaatattattcttagatattttctgtatcctaaattaccatattttttctgtttatatttttttctgtttctttgttcaggtctttcttgtttgagctagaaatcaaaaggtatctgagacaaatgtcaatcaatttagaagtttattttgccaaagttgaggatgcacccaggaaaaaaaaacagaagttacagtaggatctgtggcctgttctttatccgaagagagtttcatgaacatcaatatttaaaggcaaaagagcagacaggagtgaaaggaggaaagaaaaaaaaaaaaggagggcaggcaatgaggcaagcagttacattcttgtgaggctctgattagtgctcactgcatcgacattttacataaaaagagaggagtagggggaaaagtcaataatgcattcctctcgagctcagtaaatctacattttacataagataaagttagcatgtgaaattacagctctctgggaacaaagaaaggcaggttttgtttgtttgtttgtttctgttatatgtattttgttttgttttgttttttgtgaatcagttcacaggctgaatttttgcctctggcatagtgactttggggtcttaagattttatttttcttgcacagagtttaggtctcctcctctgcctggtgattcttggtcttctgtttgggattgagaaaacaggatgggtatgtggtgttggttctctctgtggctgagtctctatggtatggtgggtgtgttcaattattttagaaaataggctacagtggtttctcttggaacatctacaggccacctcttctatggatcaaggagtatatattctttgtgaacttgtgacttatcaggactttaataacccccctgcatacccagttaacatattctaggaagttgcttcaccacacgtttcattagccaacacatttccctctaactagcagtgtctgcattttccattaaataatccatgacttctcatactatttgcctttgccaacttcatcacatattcaaactccttctctaataatagggctatatgaactaaaaatcaacacagctttatggcatttttaatatttggaaaagtcatttcccctcataatactttctttcaaaacatttaaaatttattctcaacacttttttcttccacatgaactttggatttattttaacaagttttcccaaaaatagtatagagactttgtttggaattattttaattatgtaagttgggaaatttaatcatacaaaatagtcttatcatccaagacatgttatgtaaatattggtattacttattttttggtgtgtaataatagtatctataattatttgtatgttttccaagtggttatagacattataaagacctgattttttatatattactttcagaatcagccactgaattctatccacaatccatatgttattttgattgacaatctggggtgtttatatacaatcatactggctgcaaatagtaatacttctatcttcttcatatcaaatgtatattacttgtttttgtcttctgtccagagcctccaaagtaacattgtaatgtgttgataggaatgagaaacgaagaccttcactaagtttatttttctacagtttccctattccttgactacactgggcagaggtatttattgtctttgcaaataaatcattttttgtttcacttattaatcccatcatcttaaaagtcattaatttctgatttcatctatattatgttctttctaattccctacgttgaaggataacatatattttttttcttcttcatttggaaatgaaagcatttagggttaataattggcctctcccaataccttggaaagccttagttacatagtgtcttcctttttaataattttctaaatatactgaaataatatttgatatcctattagttatctgagagggcttttattttatttgttatatcttaactaattgggttattctttctaaatgtttattataaatcttgaattttagaaaattatgttcacgaataacaagttttgctctgaggattttatagaggcaaatatatgcaacttttgtaaatgttccatggacattcaaaaattagtagtcctattagtacgagctttatctttatcttttctaagtcttacattatcattgtgataggctgaacagtggccccttaagatatacaggtcctaatccctcaaacctttggatattactttataagacaagactttgcagatgtgattaacagtattgagatgggaagattatcctgaatcaacttaaaggaaaaaaaaactgaggcaaaattaataaaagtagagagtttatttgggccaaatttgaggactgcaacccaggagcatagatcctaattgccctgaatctacattctaattaacagcagttacaagtcggattttaaagaaaagaaggagaggcagttcctaagctgttcaccaacaatttacattaaaataacatagtctattgaatggctatacattgtcttttgtatcactaattccaggaacaggatataagggtgagacatctggtctgaaatgcttttaaacaattgcccccagcataggtgtggaagggcagggtgagactgaagccctgtgctcaagtatctctgagcctggtaagttctgcccacatcgttcagactgctctcagctatttttcttttctcacctggattatccaggtatgccctaaatgcaaatcacaagtattcttacaagagggaggcagagagagatttgatagagaagaagaaggccttgtgaccactgaagctggatgctatgctgctggctttgaaggtggagggaggggccaggagccagggaatgtaaggaatgcagctccaagctagaaaagacaagaaagggcaggaaaacaggtcctccccagagcctctggagacggtgaggccctactgacatctccatttcagcccagtgaaactgattacagccttctgacctgcacaattgtgagacagtcaatatgtgtcattttaaaccatcacatttgtggcaatttgttatggcagccacacgcaactaattctcttttcattgtttcctgatctaccatagagtagtggtactgataaactctccctaatagttgtattttgatcatttcttcttgacttttaaaatgtgaatatacagtgccagtactgtgtttctcagcatatgaaggctaaggaccatttttactgctaatacctttcataacacaacatgacttttattgccactttaaggctccttgagttgatgcctacattttcttcatattgaaataatcgtttcctctgtcatgtgaactttcctgtctatctttccccagtcttttattttaaattgtaaaagagctctccttaatatttatttcttgtatcatatcctatttttgcttcctattataagactttgctttgatatagcggaatttaaactgccaacatttatcatcataacgaaaatgcttgacccttatgcctctcatcttgctttgttaggctttccattgtatactttactgtagctttcttttatattcatgttatttgtacgatggtatttttaaaaattataccaatgaatacttttaatttttaaaatatctatttaaatgtgttctctaattatctaagtccagaataaagcaattattttgactcctttttacataagacttaaaatttattacactttatctcttcctatgcacttgattatttcctagtctttgttaatttactttcacattatagacctagatcgacgtatattatcattgctatttttaataaagtaaaaattatttgagattttttttctctttttaggccattttaatgtaactcatttattcatccaataaatatttattgaggacctatactatgagccagatgctgagctaagaagtggcagagccttagtgatcaagaccacacagcctctgcctaggcctcatgggctgtggtgctgtgtggtctctgtgttcgatccatttcagttctcacctaccctgtgttcaggccaccctgaactgggcttggttctttagaatcaccgtacctaccatgttaccaagccaccatgccctaaagccaccatgccactatgcccctataccaccatgctaccccattaccacaccaccatgtcaccacgccaccatgccacccatgccatcatgtcaccatgctaccacaccatcgtgccatcattccaccatgtcactatgccacacatcaactcaccaccatgccaccataccaccatgacatcatgccaccatgctgcaatgtccccatgtcaccacctcaccacaccaccatgccaccacatcatcatgccaccatgttaccatgccaccacatcatcatgccatatcacgtcacacaccatcatgccaccatatcaccacatcattatgccaccatgccacgataccaccatgtcaccatgtcacaacatcaccatgacaccatatcaccatgccaccatatcacatcttgccacaatgccatcatgtcacatcaccatatcaccatgccacatcaccatgccaccatctcaccatgatatggtgagatgttacttactgtaccactgtgtcatgatgcaccctgtcatactgaactatgttatcaagttaccacaccaccatctcaccctgtcaccatcccaccatgcaccatgccactatgttacctgtctcctggtaggtgtttgcctgtttatttccctcttgtcccttggactgtgggcttcacaagggcatggacctttctggttttgttcaaaattttgcttactagcacaatgccttggcaccttgcaaccattcaataaatgtttattaactaaaggggtgactaagtaaggtgctctttttttggtaattaattctttatattgattgcttttatgttggctagaatatctcttaactaattataaaagagaatgtgaatggtcattttctaatccccaatgtaaccaaggatgaccctgtgttgtaaaagtgtggctgggtatgatagtctttgtacctaactttgactcaatttttacctcttagaagtgtgtgaatttggggacatcatcccctggcttttgcagaaatgtctgatgtcagattaatttttgtttgtttttaaataatctgccctcttttctcttttgtctaaatatatgtgaatttttatctttttcctttaaaaaaatcccatgtagtgtgttggtcttgcctagtatatggtgagtgttcttccccctgtggattaaatgtttgttctacccagagaagttttcatgaattacaacctcccttgaactaccctgtccacgtgcaggtggccaagtgaccttcccccacccaccaccatgtcgagaactagagctcaaagatatagaggaggaataaaggtagatgaaagtaggaacaccgctgatagcttcagagatagtccttgtgcagtgaccttgtgcagtgagagggtgtccgctctgttttctgattaatgtggactcaaacaaagatcacccagggggtcaaagtcttttcctaccttctctgggacctgctatgctgatctcatgcagcggacttgggggaattccctgtgttcctcaattaaacccaagctctgctaaaatatacaaatagtcatcctaaactctaggtccaacattggcctagaaactctaggtcctaattttccaagctgttagatgtttttattttccggattttttttttttttttttttttgagacggagtttcactcttgtcgcccaggctggagtgcaatggcatgatttcagctcctgctcactacagcctctgcctcctgtgttcaagcgattctcctgcctcagcctcccaagtattacaggtgggattacaggtggccaccaccatccccagctaatttttgtatttttcggaagagatgggtttcaccatattggccaggctggtctcgaattcctgacctcaggtgatcctcccacctcagcctcttaaagtgctgggaatacaggcatgagccaccatgcccggcctgtttttgggatattttaatggaaagtgatggagtatgaatccggcctgctcaggtagctctaggtcagccatgaaatctacgtcctgataaggagcctggagaggcttcctcaaatccccaggccatggcattgccagcgcaacacttgcatctcctgacttagcccagcactgccaagcagacctcatgggtgtccttctgccaccttcgtgcttcctccatcctggtctccctgtctgtttacatcagtgtttctcttggcccagggcagggtctctttatctcacggcctctgtggtccagttagttaggagagagttttgagcaggtgcaattagtgtggagtctctggggcctgcactcacacacgcgggatcctgacaagccctgagtcctggaacagccgcaccctgcagtagcacccacggagcagcctttaggccctgatgctcctttcaaacaatcagaagcttctgtgggccagagccgtccatagggcctttgagagcctggggaggtagaagggagagtgaggcatccatagcagtgtctgcagggaaaggggggtttacctgtcccctggcacagttagatgtgtagctcacgctttgactataggatgctcttatgtgtccacacttcacaaagcacagggcagctctgtgttgttgcccagaagaaaatgaacccccccccgcaacttccactatatgaattctctgcatcgctgcctctaggcagcaggacagccagcagtaagctgcagacatcccaccatgctgcagcttgctgtctgcagcaggaagccccacatacagcctgacagtcaggccaagccatttggccattcaccagtgctgcaagctcaggcaggttgcttaacctgtctcagttcctgcttctgagaagtaaagctaatggggtctatgtcatgagattactggaagattaagtaaaataacaagcatcaggcagctgacacagaaagtgtgcctgagaggtggatggatggctccctagcccctctctttgtcttctgggctgagcccctcccgatccccacagggcaaaggctggctgattttcagtagtttaagctggtgtgtagcagctaaactccacatttctagaccgtttgaacaggaaacctgagatgagggagcgtttgaattggctcatgcaaaaaacaatatttgctggaggttagctgctgcattatgaatttttaacctcccataaatcaaactgtaaaaatggacaaaggctgagtttcctgtgccaggaccaaaatagacaccgcctgcgtctcttagacaattccgattatgtttccacaaccaaatcatgctgagatgaatagctggaatatttatatttaggtcctaacgtataatgtaaaataaatgaaaacagtctatcttcttggcactgaaattgtgccaccatatccatttacaaagacgataactcaaagaccaggctgtgcaaagaccatcatgtgcctggggcgggattttgcttctctgctcccattgcttttccctacgaccgtcgtcaccagatacccaatactaaatgattaatagaaaatccccagcgggatcagtccacagcaaggtttaaagtgaatccttttgtgaatgctttatactgacaaatacaaatgctttaaaagatccaggagatggaaccttgtaactgcagaggatggtattttaactaaagaaagcttttattaatttgacaaacatatctttccctggcaactcctatgagctacaaacttagacgaatatcataacaactaagagatttttattctttcaatttagtggtaaagggaggtattaaagcacctgatttactatgaggcagaaagaaacatgagctcgagtgttacaagcaaatgttacagacttctagaaggaaagaccgcaccaaaaaagtgaagttggagctgaactttaaaggatgataaaggttttagtatggaaaatagagctccagaggccaagagaaatgtggctacactgaggtgaaactggcaatagggtgtggagtgaaagtatacgatacaaaaaataaactgaaagcaagtatgggccaggcacagcggctcacgcctgtaatcccagcatgttgggagacccacgtgggaggatcacttgaggccagaagtttgagaccagcctggcccacatggcaaagccctgtctctactaaaaacacaaaaattagccaggaatggtggcacacaccagtagtcccaggtacttgggaggttgaggcaggaggttcgcttgaacccaggaggcagaggttgcaatcagcctagatcataccactgcactccagcctgggtgacagagcaagactcggtctccaaaaaaaataaagcaaagtatgaagcaatttggaataaggaagatagagccttataggagactggaggtttttaaaggcttctaacaaaagggctgatgtgatatcagcagtgtgaatgaatcgattcattcacttaacaaatatttacctagctcctcagtgagggatggagtggtaggtaacaaaaccaataggctcctgcccccatggacccacagtttcatggggtgacaagcattaacaaataaacctgtaagtaaatgtattaggttgatgcaaaagtaattgtagtttctccattacttttaatgcaattacttttgtgtcaacctaatataattacaggcagaagagagaactaggtaagaagggtgcttagggtgatgtccaaggaagcagggagccctgactaatactgggggttggagagaggagagaaggcattgctgaggacctggcatccacactgggtcctggggggtcaatggagttggaaagcagggctatgctggggccagggctgcagcagagattggaagcattccaagtgcaggactaggaacaaaggccttttggcaaatgaagaggtaggcattttcaagaaaacaaaagagaagagagtggcataagataactccagggggatgggacatctgcagggcctggcaaggcacattcaggattttatttttatttatttatttatttatttatttgagacggagtctcactctgtcacccagggtggagtgcagtggtgagatcttgactcactgcaacctccacctcccaggttcaagtgattctcctgcctcagcctcccgaatagctgggactgcaggcatgtgccaccacacccggctaattttttgtatttttagtacagatggggtttcaccgtgttaaccaggatggtctcgatctcctgaacttgtgatctgcccacctcggcctcccaaagtgctaggattacagacataagccaccatgcccggcccaatttttgtatttttagtagagatggggtttcaccatcttggccaggctggtcttgaactcctgaccttatgatccacacaccttggcctcataaaagcgctgggattacaggcatgagccattgcacccggccacattcaggattttaatcaggaagtgcaaggggaagccactgtctggagtgataagatctggttggttgaataacgtccctctggctgctgtatggaaggtggatctcagaggagtgagtctgaaagacattgtggtgatcctgaggactatcatctgatttttttttatcttgtccgaatttctatctcaagggtctggggagtcatgttctacaaatcataaattctcatcagatgggtttaatttaaccctatataggatgacttactttccaacctgactctggcataacattatgagacaaggaagaaaatcaaaatattttaccccaaaacatgtttctttgccatatcttgaaatggccctgcaaagctgtcctttgtgggggaaaatttgcatctataaagaatctctattaacctagctagttctttttcttcaagaccctcccaatcctaaagagattaactaaaagtctagcaccttctaaagatctgaataggaaacatttgtcatctgttatctctaaagggcagccaccataagacttcaaaagaaccttggtcttcacaatcttttatcttaacccgaacatttcctttctgtgatcccaggtctttagataaactcaaccaattgtcaaccagaaaatgtttaaattcacctatagtctggaagcccctgctttgagttgttctgcctttctggatcaaaccaacgtatttctttaatgtatttgattgatgtctcatgcctccctaaaatgtataaaaccaagctgtgccctgaccaccttgggcacatgttctcaggacctcctgagggctgtgtcagagaccatggtcactcatatttggctcagaataaatctcttcaaatattttacagagtttgactcttttcattgacaatgtgaaggagatatgcagcagtttgcacagagcagtcctggtgaaccaggaggcaagagggcaatttaagacctccttcaaagttacagcagacagatcttgctgatgggttgggggttgggagcagtagaggagggaaaagtcaaggagattccatgttctgacttgagccactgagcagaaggtggtagtttcccagagatggaaaagcctaaagtaatgttaatgcgtaggctgcaggtgagaggtcaagaaatcagcttgagatttggaaacactgaatgcctatgagacatccaatgcagaggtcaagtgggccattcacaatatgagtcagaagctcagaaaaatgaaaacaaccacagatcatctgggaggagggcagagtagaggcaacagctagaaagggcagtttccatcttggcttcctgtgcctgggatctgccccagctgacctttccaggaagtctctggtggtcacctgccgaccttatcacaaagctctccaaaacacatcaaccttaatttcaggttcaggttcacccaagaagaaaaacagtaggcttttgtcttatatccttttgcaatcacttacccttctccaaatctgggccccaagcaattatgagtttactttctcttgcgatagcttagctttgcctgttctcctcctcggttctttgaatgtgcctataataatctccaacaggtttctttgatattatgacaaattctagacacatcctgcattttccttgactgcagaatctgtattaactcttctcaagagccctggttcctttttgtgggaaatgatatgtagagaccacaatctgggttcaaagggtgctaattaatagtgattcattgttactaggccttttataaagctaggaaatttctgactgggcgtgttggctcacgcctgtaatcccagcactttgggaggctgagacaggcagatcacctgaggtcaggagtttgagaccagacttgccaacgtggtgaaaccctgtctctactaaaaatacaaaaaattagctggacgtggtggtgcatgcctataatcccagctacttgggaggctgaggcaggataatcacttgaacctgggaggcagagattgcagtgagctgagatcacactactgcccttcagcctgggcaacagagcgagactctgtctcaaaagaaaaaaaaagggctagggaatttctaaaaattaagataaaacacttcctaattcatactgctagcttccgatccagattctggatataggctttttactaaaattgattaatcttacttctattcttttttctcccacacagaaaattctggttctcaatgacaccagcatcattactgatttgctttctactcacacacaaatagcctccaaataagaatgccaacactatcaccaaaaaggtaattgctgaaaactgtttaagatctttagcaggtttttggtgggaagggcttgggggtttgggaggttggtttggcttttttttgtttgtttgtttggttgttgtttttttttttggtcctgacattatatcccacttggaatgtatactgtaattaccatatttggaaaccacttgaaatagtttctctttgtgtggtacgacatcaaatgcatacatcatgaaatttgttctattttgccttctatttttatgaatggttttaatggtggttttgttttgcaactatgtaaaaatatgtacatgtcccaagtcaaattccaaaaacaagacatattcaaagaattttagcttctctacctgctatccctttcctctagtcaaattccaaaacgagatatattcaaagaatttagcttctctacctgctatccctttcctctgagatagcgtttttttaagatttataccagcactgtttttacacatgcacatgtgcacacacacatacacatattccttgtattagctcattttcctactgctataaagaaataccaaagactgggtcatttataaaggaaaacaggtttaacagactcagttccacctggctggggaagcctcacaatcatggcggaaggtgaagaagaagcaaagacacgtgttacatgacggccgtcaagagagaagtgcagcatgaaatgggggaaggccccttataaaaccatgagatcttgtgagaactcactcactaccacaagaacagtttggaggtaacaactcccatgattcaattacctcccaccaggtcccttccacaacaagatgagatttgagtggaaacacagccaaacaatatcattctgcccctggcccctcccagatcttatgttcttacaattcaaaacataatcatgcccttccaatagtcctccaaagtcttaactcactccagcattaactcaaaagtccaagtcgaaagtctcatctgagacaaagcaagtcccttcaacctatgaacctgtaaaatcaaaagcaatttagttacttcctagatacaatgggggtacaggcattgggtaaatacacccattccaaatgggaaaaattggccaaaacaaagagtctgcaagccctatgcaagtccaaaatccaatagtgcagtcattaaaccttacagttccaaaatgatctcctttgactccatgtctcacatccagggcacactgatgcaagaggtaggctcccatagcctttggcagctctgcccctgtgcctttacagggtacagcccctctcctggctgctttcaccggcaagcattgaatgtctgtggcttttccaggcgcatggtgcaatctgtcagtggatctaccattctggggtgtggaggacagtggccctcttctcacagctccactaggcagtaccccagtgggaactctttgtgggggctccaaccccacatttcccttctgcactgccccagcagaggttctccatgagggccttgcctttgcaggaaacttctgcctggacagctaggtgtttccaaacaccctctgaaatctaagtggaggttcccaaacctctgttcttgacctctgtgaccctaaagactcaacaccacatagaagctcccaagatttggggcttgtaccctctgaagccacagctggagtggctaggatgcaggacatcaagtcctgaggcttcacacagcagggaggccctggacacagcccaggaaaccattttttcctcctaggcctccaggcctgtgatggaaggggctgctgcaaaggtatctgacatgccctggagacattttccccattgtcttggtgattagcatttggctcctcaccacttatgcaaacttctgctgccagcttgaatttctccccagaaaatgagtttttctctcctagtgcatcatcaggctgcaaatttttcaaactcttatgctctgcttcctcttgaatgctttgctgcttagaaatttcttccaccagataccctaaattatctcccttaggttcaaagttccacagatctctagggcagggcaaaatgccatcagtctccttgcatagcaacagtgacctttgctctagttcccaacaagttcctcatctccatctgagatcacttcagcctgggttttattgtccatatcactatcagcattttggtcaaagccattcaacaagtctctaggaaattccaaactttcccacatcttcctgtcttcttctgaaccctccaaactgttgcaacctctgcttgttacccagttccaaagtcgcttccacattttcagaaatcttaatagcagtacttcactctaccagtaccaatttactgcatcagtccattttcatactgctatgaagaaatacccaagactggataatttataatgtgtaaaggaaaagaggtttaatggactcacagttccacatggctagggaggcatcacaatcatggcagaaggcaaaggaggagtaaagccatgtcttacctggaggcaggcaagagagaagtgcagcatgaagcagaggaaaagccccttataaaaccatcagatcctgtaataactcactatcacaagaacggtatggtggtaactgcccccatgattcaattaactcctactaggtccctcctatgacacatggagattatgggaactacagttcatgatgagatttgggtggggacacagccaagccatatcattcctattacctttctgagatatatggaagcatattgtatgtaaacatattgttctctttgttctcattgcctaatatgactgcactgtggcctctgatcctcttccttccttttacaccctaatgctccattacatggaagcaccactgttattcaaccagtcatccatccatgaaaatttgtcatttgtaatcttccattattataaatagggttgcaataaatagtcttgatcatttgtctttttgtatttctgctagcaccactcatttttagggcacttactacattccaggccttaataatataccggcgggaagacataaatccctgctgctatgatcgaaatatttgtctacccccactcctaaatgtatatgataaaatgatggtattagaaagtggggcctttgggaggtgaggaggtcataaaggtggatccctcatgactggaattagcatctttataaaagagaccctagggagccacctcaccctgtctgccatatgagaacacagccagaaggcatcatctgtaaaccaggaagcaggttctcaccagatacagaatctgccagaacctccatcctccagaaccgtgaggactaattttctgttgtttataaacacctagagtgtggtattttgtcatagcagcccagatggactaagacacctgcccttaagaagtcctcattcttttggggttgggggaagaaggacattacagagaatctgttggaatgtggtaggggctctgaggaaaagtaaagctgggtaaaggggataggagccatgggatgggggtgggcgttctagcctattcagataagtcccctcggataatagggcagttcagcagaaacctggaggaagtgagggagtgagccacaaaggctccaggaagaggaacagcaaatgcaaagagaagcacacctgaaataggaacaaatcataggccagtgagactgcagcaaagtgagtgaggggaggtggtgggagagcagatcagaggcatggctgtggcctggatcatgaggctcacggaagggtatggtgcattccagaaggcccaggcacaggtaaggcaggcaactgtctgggagccccagcccccatacccaagcacccaagcccagcaccacactcccgaccagctccccaagactttgaaacttcaagcccattcccatcatctgtggcactggccctgcctgctcaggcctgggtagcagagtgcacaatacatggaatgtctgggcaggccaccatgggacagagcacagaggacacccatacagcagctgagaatgaccacaggccctctggacccagtcgccggctgctcccaaagctgtctgctccttcagtgtccagctatgccatctaccccagaagattcccccttggcttgatgacctggttgcagcatttaccttggtacacaatttgtattgttttaggtgattaaaagtaattctcaccaactccacatgccataagcctgggtaagaaatgccccacctggtgcactcccaggccccaagccctatgctaattgactattcaaggcattctctggcacccactcactcactatgcctcagttcccacctgtaggttagcaaatatgtcatgggacaccaggtaagcgtgactttgttgaggagttaagctgaggaggaaaactgaagtcaggataggcatacagtgggttctctgacttttgaatccttttggccctggtttcctcatttaaagggatgaggataaaagactggttcctgtatcataggatacatacatatcataggataaatgttaactgtcacacatgtagtggagtgatgtctaatatacactatgtgcagaaaatgtgttacacgatgacagtgatttttattatcattaccatacatggtgtcttagttcttttggactgctatagaaaaatatcataaactgggtagccgataaacaacagaaatatattttggatagctctggaggctgggaagaccaagattagggcaccagcaggttccatgtctggcaagggcccattttctggttctgagacagcaccttctcactgtgtcctcatggggtggaagtgctgagggatctcttaggggcctctttgagaagggcactaatcccatttgtgagggctccagtcccatgacataatcacctcccagaggccccacctcctaataccatcacctgggggttaggtttcaacgctagaaaaagtcaaactataccagcgactagaagaatttcataaaattctggaaagtctgtcacgttctgatagtgctgcttctctcctcctgggggtcatgcgtaaaatgcctcagccattccgagagccagtgaggtgatctgcggaagagaggaagagcagagctgggcacagcatcccctccactttggaagagaaccctgatggacaagggagtggtggtgatgctctcaagaggtgttgtgagggaaagggtgagacagagtgcagacagagggtgaggcagcgccaaaggacagatttgagggttccttttaaagactagatgtgccagccaggtgcggtggctcacgcctgtaatcccagcactttgggaggctgaggcaggtggatcacctgaggtcaggagttcgagaccatcctggccaacatggtgaaaccccctgtctactaaaaatacaaaaattagccaggtgtggtggtgtgtgcctgtaatcctagctactggggaggctgaggcacgagaatcgcttgaacccaggaggcagaggttgcagtgtgttgcgatcgcaccactgcactccagcctgggtgacagagtaggactctgtctcaaaataaaaagaaacaaacaaacaaacaaaaaaacacaaaaaacaaaaaacaaacaaaacaaagaaacccaaactagatgtgtctgttaaagccacattaacaaaagcaaaacctctgcagggatttcaaatagagagaatgcaacgcggggctcttactgcacagctggcagaggaggtgaggagccagcagggcaagctgagtaacccggggctggcatgtctgacagtcacagccaccttgctggagagaggctgggcagtggtgatgtttggggccggaaagctggggctggagatggagtgtggtgggctgcctttgggagctgctgccagagacccagcagtgagcagagaggtgatgcggaccagcaccccctcctcccgctcatccctaatcttcctctggggcctaccattggccaaacctgcccaggagcctggggtgagtgggcctgaggaatagaagagccagaactgtggatggacagctctatgggagatttgacaactttaggggtaggatgaaggaggtgagaatcagagccatggggtcgggggacgggggtcagagacgtggccggggtgggtctggctggaggagcaggaagcctgttctagcagttggagcaaagctggcgtttacagggagaaggtgcttcaccctcaagggagctcagaacaggccctgggaacgctggcctggggtcctgggtacgctggcaagggtcctgcagaggtttcctcgctgccactcccacaggagggatactgatatggtttggctgtgtccctacccaaatctcatcttgaatcctagctcccacaatccccatgtgctgtgggagggacccggtgggaggtgattgaatcatgggggcagtttcccccatactgctttcatggtagtgaataagtctcatgagatctgacggttttataaggggaaacaccttttgcttggctctcattctctctcttgtctgctgccatgtaagacatgtctttcaccttccactgtgattgaggcctccccagccatgtggaactgtggtccattaaaccgcgttttctctataaattatccagtctcgcgtatgtctttatcagcagcatgaaaacagactaatacagatgctccgccacctcacctctcggaggagaaactgaagcctgagacaccaagctcacagccccaaaagtggccaaatcaggatggaatccaggtgcagatgattccaaagatcaagccccttggagccacacatcctcatacacacacaccctcccaccttctcactcaggtgcactcacagcccctggccccctggcacactcacactcacacatgttcacacccctcgaacactcagcacatctcctcagtcacactcatgccacagtcgcccacctaccccgggggtcagagttgcccttggcacagcccggctgtgggaaagggcccagtgctctagggctctcctggaggaagctttcattgaagaccagacctggggcatgcggcgatgtccccactgttcgtgaggttactgcaggggtttccgacttgcccctttgcacaaggacagggccagtgcttagcacatggtgcttagtaaacagatgatggaggaatgaatgggtgaagccaggcgtgtctgggagggagccaaagccccgaggcagaagagaaggaaggacagacgtgaacttgcagggtgggtggtatgtgcaaagaggtggtggaatgtttattatcctgagacctggggtggaaagtcctttgagacagacgctggtgtttgttcaggatcctctctaggtgggtgggtgggggcagctgtgtcccctgagggctgcacgtgggcaggcaccctgcttcagaggagggaaagctgccccacctgagagtgagggagagaaaggaggaagagcagggaagaccaggggaagtggggagagggaggggaggcaggcaaggggctgggactagacagggaagatgacttcaaggaacgagctctccaggcgcctgacagcaccaagctgtctctattcagcttctgcaccactgccatgcaagacccttccagaaaagtcttctccactcatgaatggacatcctaactgacctcagcttgggtggtgggagggggatggacgtgagagagataaaggaggagctgaatttcatgctgggaccatgatgcataaacagttgtgtttgcttcactccacaaaggcagacacattcagggagggcgttctcagtagaggaagaataatggcagctcataaaatatcatggaaactgacagtagtgtcttccaggcaaatttgataagcctgttcctaaaataaacttaattcaaaaggaacacgggcagcagaatgtgaattatcttttaactttcttattatttttctggcgcttcattctttttactcaagatgctctagtagtagctcgttttgcctttacaaggagcaagggactccagactgtcagcatctagctgaaaaactgcttctgcttgggtagtcctcagtcctcccagagcgtgcacagcacagcggggaatttcaatcgctgcaggtgcccagggcttcagccctggagattcaggatcagtttacctgggctgggagacctgtacttttaaaaagcttcaaggtccttcaaatgggcactcagaaccaagaaccatgctgtttggtgctgaagctaatgccactccacccaaagcctcaaaggttgcttagatacccacacacttctgctgaaacaagcttccagaaaggaatgcacagatgaatgtcgttaacaaggcaggccaaatgttttgagttcagaagtattttttctttcttttttttttttttttttttgagacggagtcttgctctgtcgcccaggctggagtgcaatggcacgatctcatcacactgcaacctccgcctcccaggttcaagcaattctcttgcctcagcctcctgagtagctgggattacaggcacgcgccaccatgcctggctacattttgcatttttaatagagacagggtttcaccatgttggtcaggctggtctcaaactcctgaccttgtgatccacctgcctcggcctcaaagtgctgggattacaggcgtgagccatcacacccagccagagttcagaagaattttaacccagtaactgaattttctttttacaaatgtaatgatctttaaggtagatggtgtggtagcagggggttctgggaggtttggcttaataatatggaatatcaaaatgaggggagaaactgaataagggtgtgtttatgcttacattaattatttgtaagtgtatctatatagctttaaataactcaagttgtttttcttttcttattcaaataccacgaaatccaaaagctatgaattctctgaaatatggactaatgcttagaatgttacaccttcctttccccttccaaagtgtcgttactactttgatagaagctgtaggcacaggcttcataagtataatcatatcactttcattcatagccaagaaaaaattgagcttcttattgagagtacatgtcactaagaatccagcttctgcagagggggcagggggaaggttttctgcttagtcccaaattgctttggccatgattggatttcagtgtgaaaaattgaggcagcctgttcagggtgagataggaggaagagaatgtggagccgctagttgctgagcagctgtgagacagtcagcatacaggccatgcctcattttcccatctacaaccaggggtgattgcagtatgtggcatccaaatgctgaccactctacagcttccaccctgcggtctcaacagtactggggacctgagaacaagacagaggtgagcctggtacaaagcttcagccacacacctactcatctatgctgtcatactcacttggccctagccagaaccacagatgacatcatcccgggtaaattagcattatttccaccattactcacctctgcctgccctcttgccttctcttctaggaagttacgtatctgaaagtggtaattaatgcaagtgagagatctggtcacttaaatgtgtgtggcacctctcccctctcctcttcctcctgctctagctatgtgagacgtgcctgcttcccctttgccttccgccatgattgtaagtttcctgaggcctcactagaagacactatgcttcccgtacagcctgcagaaccatgagccaattaaacttcttttctttataaattacccagtctcagatatatatatatatatatttttttttcttttttttgtgtgtgagacagagtcttgctctgtcccccaggctggagtgcagtggtgccatctcggctcactgcaagctccgtctcctgggttcacgccattctcctgtctcagcctcctgagtagctgggactacaggcgcccaccaccatgcccggctaattttttgtatttttagtagagatgaggtttcaccgtgttagccaggatcagtctcagatatttctttatagcaatgcaagaatggactaatacacatgcttactttcaaaaacttaaatatatgaaaagtataagaaaaaaattaaaaggatggatactcccaaagtaagaagatcatctttctttacatgttgatgcactttcttgtagcctttggtctaaacaggcctctcaaacatcgctgggtcctccttgtacatgggttctcaggaggtaccagcactatttgttccccaattctcctcgctcatttactctcactctcccattctccccagttgattttgggcatccacaaggggctctcacacaggggaagaagtgactttcacaccagtcatcttgtgatttctagggcacaagcaacactcctcagcaccacggccactgccatccaagaagacatcaccccccttcaccaaagagcccctatagcagccccaaaccggcaagggccaagcagaactgtgctttcttcaggccctactcaatcatggcccaagtctatagttctgcaggagagggaaaaaacatcccttgtcccaatttattttgaattttgtcatctgtctttggaaaaatagtctcataaattttaccttgcactcctccctccccagttcccccttcaaaggccttgccagttactcaggaaaggagacacatacttgagaagtggggtgttggggtagggggcagggatgccaccagctccacagtcaatctctttacttctttttaaatatattcttaattgacaaataataattatatatatttatagggtacaatgtaatgttttgattatatatacattatggaatgaattaatccagctaattaacatatcacttcacatacttattttgttgttgtgaaacatttaaaatctgttcttggctgggcacagtggctcatgcctgtaattccaacacttcaggaggccaagaagggagggtcacttaaacccaggagttcaagaccagcctgggcaacacagtgaaaccccacctctacaaaagaatacaaaaattagccgggtgtggtggtgtgcagttgtagtcccaactactcaggaggctgaggtgggaggattgcttgagcccaggaggttgaaggtgcagtgagccgagattgcaccactgcattccagcctgggtaacagagtgagaccctgtcttcaaaaaaaaaaaaaaaaaatctttgaacaactttgaaatgcacattgcattattaactatagtcaccgtgctatgcaatggatcgcaaaagcttatcccgtgctgaaactttgtgccctttgagcagcctctccatacccacccacacccagcccctggtctctacctctgtgagtttggctttttcagattccacatattaagtgagatcatgcagtatttgtctttctgtgcctggcttatatcacttaacataatgtcctcccggttcatccatgttgtcacaaatgacaacatttgtgaatagtattccatgacgtatatataccacatttagtggtacatcaacatacatttagtttgttttcatatctcagctattgtgaatgacactgcaatgaacataagagtgaagatatctcctcaacgtgttgatttcactgtctttggatacatacccagtagtgggactggacagcaaccttgatgtagtcttagaaccaggctgtgcatgtgaatgtgtgtgtgtatgtttatgtgtgtgcacgcatgtgcctgtatgtttgtacacattacataattgtaaactttccatcagcacaattttatattatttttgcttcatgtcacttaagaatatattatgaatatctttacatgttaaattttgggaaacctcttacgtttgctgcacatatatgatttgcttctccttactgggcatttgagtaccttgcatatttttccattttaaatgatcttgcagggaatgtcttttgatatcaacctttgttatttgccttggagtgaaattactgggtcagatggcatttacattttaagccctaactctgcttatagaataaaaggcatgagcacaatagagaatttccaaaagcaaagcaagtgcagttgtcctctgggggctggggacagtcactctagaaccacagcaggtgggtggctgtctgctacacttatccatctaggtgcatatatatatatatcttagacatatttttgttagaaacagccccgcagctttagcctgcagctctcccctcttccccccagacatttctcttaagagtgatgggaatacattctatgaagctgctgttaggcgagacagctcccagtaatgccagccatcaagtgattcccgtgaggggctgtatgggtgaatgctcggcattgcaacagtgcacagcaggccaccagtctattatccaccaaatctcgagattcagcccaggatgcattcagttgctaaaactgtcacggcagccactcgctgctagctcttaggcaagaaaatgtgcattccttcagaaattcagggaaagccgttgtctctataaaacagaaagtccaaagcaattgcgcagctgcatgatgttcagcacattacatggattcttctcgcatctgcctcttaagttgtgtaaaaatgattatgcaattctaaatttggaaacttaccttattgtatgcaccagggactcaacagaaatttttatatcatattcaagaatagcaagtggtaccaggacactgatttggctagcataaatgttacaattgctaaatacatggagtcagactaccaaaggattcatttgtttcaatcaataaatattcattgaacactgagtctctgtgagaccctgtgccagaaccagggaatgcagtagagaaagaccagcctggttctgccccaggcattaagcttcccaccatgtacactagggcacttcatcaacagcaggcttatggcccgccttggtcatgagcataaagaccattgctactaatctttatagtaaagccctgcagagatgggagtgagagcccgtctctttgacattccaactcacatctctacattcccctgacagtgagctttcaatttgcccttgtactgtcctgtctcatgtttccctttgatctagaatgctgatctgcacctcttctattggcatacatcatacagccaatccttccatgcctcgcctgcctataacacttttaatggggagtcttgcccaaggctccaagcagaaacagccacgctctcctttactgtgcattgtgcatgcctctgtgatggtgttactatgccgggacctctaggccataattttacatgtattaatctattaatagctccttctccagatgtaagctaattggggactgggacataaagtacttatgggttgaatgaatgaatgaataagtgaatgcaaagctgatgcacacagattttagccacaaagaaaaatttccccagccattattgatagaatatgagcttggagttgtttttccagccttaagaacagcagggctgggcgcggtgggtcacacctgtaatcctagcactttgggaggttgaggtgggagaatcacatgaggccaggagttcgagattaggctggccaccatagtgaaaccccatctctactaaaaatacaaaaattagctggatgtggtggcaggtgcctgtaatcccagctacttgggaggctgaggcaggagaattgtttgaacctgggaggtggaggttgtagtgagccgagatcgcgccattgcactccagcctgggtgacagagtgagattccacctccattaaaaaaaaaaaaaaaaaaaagaacagcaggaccgggatgtaggatggctggaggcagaggtataacctatgtccatgaagctgagaatgaccaatggcttgtaaagagcttagatccataaccctggactcactgccccttgactgttgacagataggacccagaaaagtagtgtcacaaagcacgagacagaaaatcaaccattgtcccaattctataaaaatggactcattcaatgtaaccctgggagacttggttgaacttcaccaaaaccccagttccacagcctgtggcaggtggaagcccccaccatgatgcctgggtctccatagcctcactcctctcccttctgtgctcctgccacctcgtgggctgtcactagtggatgctgagacacagaactctccccttcagtagggtccacaggaaatccattcacatcaagtattttgtgatttttgttaaactcgcactgaagattttgtttgtcaaagaaacagtcatatcactcaccacacaaatacacttgcaccagcttgcctgtgttgacgctgcttccttctattttctgactcctttccttctagtacagtcaaaatattccccacttgattctggccctatcctttagtccatacccagttcctctaagaaattaacttctacctccactcactgtatcaatgcaatccctctgaacaaatacagggccctctcaataaggacttctggagattttgacgttctctctcccacttcatcaagcagttgttaaaatttgctgtttgcctcccccaacctcccaatccacaggactcttctttagatattagcataaatcagcatgatttgggggaaacaaatcgtatttccatgtttacatggtcactgctttctgagcaaaaggtgctggcaacctgggttaaaggacgtttgagtggcaacaaaccttggaagttaaagtagtaacttctggagagattggcagcagcatctcccctagcgatgggtatttatattccaatggttgatggacctagagaccttctcgttctctccccagagagcctttgtttacatttcagagcaaaagctctttctctttctctacctggggtgagaagaggaggagcagctatgtcagcagcttttatgtaagctccagaatttatactcctctccggtggcccaaattcctacatctggatctcggtttgtcactctgagggggatggatgcatggggactggtgcaatgatggctatgtgagcaattaaaaatctatctctgatctagaaacctggcatttcccaacagaacaaacaagcaaataagtaaagttatacaagtaaaagttataaaatggatctctcaacatgaactttgttatttcttcgataaatagattggaacgaagtagaggactgtgtaaagaaaaaagcagggaagaaattattaacatctctgtgaatatatttcatggtgacgtgtcatgtatttcatgaaacctaagatagcaaaagttataagatgcactattatttcgtgcaccactacaaaagaaagaaaaagcctgccaattaaactataatgcaatgatttctagtaccttagaacttttattttattgaaagaattattttagattaaaatatagacaaatctgtcatataagtgacataatttagtcaaggtattcctaaagcttttttacatttaaagtctgaaacttgtggatttcttttcaaatttcaggtgaacatcagtgtcattgatgttcatgttgatgacacagcatttttttaatgctggaaatgattacaattgcacctcacaaattagtcctcaatgtcaataatatcctaattgttgttgggccaacagagactgtaggaagctgtcaactgtagtatgcatcccaatttcgaagatatcggaaggtgaaaaaatgtgtcttttgaataattaaaaatatggtatatgagatagactttttgactttaaaaagaaggaaggggagaagacacaaaagtagcagttgactgaagttattttaataaaaatgtaagaaaaacatgtctattaatcaccattaatgatcacaataaacaatttttaaggtgacttgagtcaatttctgaatttccctttccttcaaaattcccagtaaatgattaacaatgaaaagacttaggcatatgaaaaatacatgggctgaaaaacaggaacagtacatatctgcgaacctagagggatgtcagatgatccttgagttatgagggggttcatcctgataaacccatcgtaagctgaaaatatcctaagtcaaaaacacacttaatgcacctaatctaacaacgaacactatcacttcacctagcctcccttaaacgtgctcaggacgcttaccttagccgactgacagtagggcaaaatcatctcacacaaagcccattttacaataaagtattgaatattttatgtaatttcttgaatactgtactgaaagtgaaaagtagaatacttgtatgggcttctaccaaatgtgtaacactgttgtaccatggtaaagttgaaaaatcattcagccaaaccctcattaagttggggactatctgtatggatagaagtgggttggaggtatcccagccactctgattccacacatgtgagagtgcagcactcctggacagtattggacagaatatactcaaatctgcaaagacacagcggcaggagctgagcacgagggcaagacagtgtctgatcaacagggatgacctactgaccacagcaagggctccagggtcacaccaagcagactggtgttggctcccaggatccctgagacagaaatggtgatgctccagtgaatggagcctgcaccccacacagggaaaagaaagttctctggggagcccagttctccctttgtggcctaggacctgacacactgactctgtctgatgcactcaccagtggatctccagagctcactcagaaactggcacacagccggtacttgggggttggctggattcatttattttacacatatttgagagcccagaaaggaacaaacagtggttgaatcaccgggcatatgggaataaaccaatgtcagagtctccaaggaagtttacattctaatagaggccataaagagatcaatatatcccaggtcaggaggagatgagcccagaaaggacaggaaagcaggtaagggaggcagggcttgggggataggggagcgtggctgcagatgaagtaaaatggttgggaatgaggctcacagaagttgctggggcagcagagaaatgaatgaaacaatggaatgagtcccatggacacctgtgggaacagcattgcagaaagagggaagagcaagccaaggctctgaaaaaaataagcaaatggatgcaacagtgaatttacgggactaacctccctatccatccaaacccaagcttcctgacttctatttcacctgagactaaagatttgcccacgtcatctctgaaagaaatgtcctcaagttcacattctgagcaaacatcacccttcctggctaagaatgatgggcaggtgggggcgggtggagggtgaggttgaagtacaaaaaatgtataaaaaggtgaaggatgtataaaagatgaaggagttcaagagaagggcacgattacggtgaactagaaccaatgtcccctaagaagtggacttgctccaaggagaaggaaagaattatttccaaagcgtttttttcatacacagttttactttcaacatgatgagagagacaaggcagttctagagagagaacatcatcctgaggtcagcgaaaattgctttcagtagaaaagctattaccaaattttaaaacacaataaaagagtttaataaggtgcctagttacaaaataaatctataaaaatcaatagctttgttttacagcaataataacctgacacaaaatgtaatgggaggaaaattccatgcaccatcatgatgataaatatgaaatacacaggacaatcttcatgaggtatgtcaacgtcctagatgaacacttcaaactttacttagagagagaagacatcatgttcattaaagggaacaattgatgttgtggttttcattttctctgtcgtaattttcattacctttgtattaatttgctctgatgtctgtattccccactatgctgtaaacttaataatggcaaagactcggttccattctttgctgggtacatatccaagtacatagccaagtcttgggacgcaggaggtgctcaataaacattacttggattaatgagtgaagacggagatgatcacaaaactaaattgtcttaaaatgacctccagaaaaatccaagattctgccctgaatcaaaagaatggtttcaaatcatggtaattcttagacaatcaggaatttaattctgccaacataatatttctggagcctcagcaaagagtgtacatcccaacacatttaggcatagtaaaagtgaaaaagatgcttccaagaaaattaccatcttggtaattttcccagcagtcctggggggtcagtgaggctccttgaaatgttccagagacttccgggagagcggtaattcctccagaacttccaacatttattacattgacaatatcatggaaggaaacgcttgtttggaaccaaacctaacttgatagctgaagccctttggccttcttagacgtggaaatcagacagcataatccacatagaggtgaaactcagtttccattccaccccttcttcttgacactgggaaggaaaggagaaggagctactcttgaaatggataccccatggtttagtagaagacactgatgacttttcagtctgcaagaagagctctagaacccagtattgggggcaaaaaaagagagaccacataatccttctgcatatggaaaggatttgctttgaggaaggagatgccacgagcagaacgggaagtcagagagcaaacaaaatggcagcaggaccctggagcccgtgctggtgagaattgtcaagggattgtcggaacaagtcccagtgctcagttaagtccaggtctgtaaacagatagttatacgaatcgaggaaaaggagccaagttccacatgtagattggtacaaagactaggaattggctgtgggagggaagagctcagcgaggctttgagttctgccagaagtcaaactcagcttgcaacaatcacagggagattggtgggaggtagggagggctgagggggcaggtggattacttggtgaaacttgcaaggaagggccaagaaggcttgtctgagccaaggccatcctggcagcaagtccctgttagccacatggaaggggacagccttgctattccttgcaggacaaatcacccttggagagctacagcccgagacatttacaacctagagcttctctgtaagttaccaggagataagtgagagtatacatacagcagatgaaggctgatggaaagaatttggggtgtttgggctaaaaagagaagtccatggggaaacaaaaaggtcatcttcaaaacatggatggactgtacttattattgttatgattctggagggcaaattggggttaaaagatggaagcgtgaggccaggcacagtgggtcacatctgtaatcctagcactgtgggaggccaaggcaggcagatcaacttaaagtttgagaccagcctagccaacatgatgaaaccctggctctactaaaactacaaaaattaaaattagcagtggcaggcacgtgtaatcccagctacttgagaggctgaggcaggataatcacttgaacctgggaggcagaggttgcagtaagccaagtttgcaccactgcattccagcctggggggcagagaaagactccatctcaaaaaaacaaaacaaaacaaaacgtggaaatagcaggaagaaataacttgcctcaatgcaaggattaatatttctggcaattggagaaggctaagtatgagggtgcccttccctgcacatcagttcctctctcacggggtaaggtgggtccacagggcagaggaggaaagagcccgggtccagggtttgaggagggatttggggaatcgctggggcaagaggaggtgcttccatgggatcccttgatagaagtcccagcatgaacaccagccccagatgcctccgtgggaagtggagcttctcacaggcaggacacagctcctcacagcagcagcgatcaagcgctttggggagcatttctagggtaagaacagacactcttgagcaaactcagggacagtcagacaagtgcccctactgactgtcaggtgggctcttcccaagggaagaggtggccagagcatctgcttcccggagtcatgtcacagaacggaggaaacatggggtactcccctatgcagaacggttctccgagctctcagcccagtctacggggcatttgtgctgagagctcgtaggattggctgggagggagtggaagcaaaaagcctgagcgcaccactagagagatgggaagggacgtatcctgactggcttgggaaaggtcttctcccttcctgtgcagcaagggcccagggaagtggcatctaaatcagtgactgtgttgacggccattacaatgagaagattggcctcggccgccgtgctcagaggctcaaggcagcctccattgctcacagtggccccccaggtgctggctgactaccccggtgccactgtagtcagcacaggatcaggagcaggaagcccggggtctcccatttcagagagcagttttcatggtcacaggcagcaccagagtgacccagcctgggcctaaataagaaatcgactctggagggagcaagggctcccagatatctctgaggacaccctctggacgctgttgctttggccttttggtgttgctaatgcccttggctttttcccatcccctgaagcgtgtagattaatacaaattccctgcatttcccataacccctccccaaaagcttggatacataacttttgagcctcgtaaagtgctccaagcattgtgcttcagggtgaaaccagctctccaacgttccaaggcaagaagcactggccagctaaataggatttggaagttccgaagagcaggctgggtaacacatttagagcagtcttagagcagtgccatagacaattttctggatccttggatacaatagcacagggaaaatgtggtttatgtggccaagcattgcttagatgggtataaaaagaatattggcttaaaattggctgttttacaccaataacaacctgacacaaaatgtaatgggaggaaaattccatacaccatcacgatgataaatatgaaatacacaggacaatcttcacgaggtatgttcacatgaagaggaatcttcacatgaatcttcacatgaaaaggaattctatagcaaaaatatctcatcaacatgaggctgacttgaggctgttttaacatgattgagttaaaagagtccaaaagaaaagaaatgaacaatgtaatttgctcttattgctcctactattatacttaaagtgacatgtttatttctattttaataaaagatagaagctaaaattctcttaagtgtgaaacagctgggtttagagagggtttgatcaattaagcaagtaaatgcctcacaaaaacaccctaccatttggctgaaagatagtttctgctcgggagagggctgaggctgcaacaatgaaaaatagcattttgctgaaaacagaacacgtcagtagagagcagattgaatcccataatcaattttgtcatttgaaagtaggctagatttctctcttagcacaggcattaattggatataagacagcaatcacaactgtgttttcaatctataggaaaaattatcttcgtttccccaaggcctgcagctttcataagaaggcaggagtttttggaggagagcgtcgtgttcgtctgtctgtagaccctgagacactgatttacagcaagactcacggtgacaag

SEQ ID NO: 91 - DNA, 6524 bp, Homo sapiens
gcagtttgatctcagactgctgtgctagcaatcagcgagactccatgggcgtaggaccctcggagccaggtgcgggatgtaatctcgtggtgcgccgttttttaagcccgtcggaaaagcgcaatattcgggtgggagtgacccgattttccaggtgcgtccgtcacccctttctttgactcggaaagggaactccctgaccccttgcgtttccggagtgaggcaatgcctcgccctgcttcggctcgcgcacggtgcgcgcacccactggcctgcgcccactgtctggcactccctagtgagatgaacccggtacctcagatggaaatgcagaaatcaccgtcttctgcgtcgctcacgctgggagctgtagaccggagctgttcctattcggccatcttggctcttccccccttaaatttttatttatgtatttatttactttttcatagaaccaccaagtccaatacaatacattttggcaggagttttcattgagattacattgaatttatagattaaggtaaaatcaatatttttctggttaaaaaaactcctatcccgaaataccctgtttttctctttaggtttttagcttttggttaggcgttacagaagatttctttatatatgcatagcgcattacttggtagatatattttaatgtgttttataattcttgttactgtgaatgggatagttttttgaaaataaaacttcttatagtggaaagtttcaaaagcaaaggcaacttgtgtgaggggaatgaggaatccttgtgttccccaaaccaagctgagtcatgcccactcttcctttctccctacgccacatactcctttctacctccccagttattttgaagcaaatcctggatttaacattatccaccattggctctttcatgttaattttgggcctgaaaacttacttagctttcttattcgttttaataacatattgttaatttactttgctttttcaggtagagacacttttgacttgatctctgcagtcctcaacatggtatgtaacacaagataggtccttaatacttgcatttgcttggttcgaaactaaacgcgtgaccgtcacgatgacatctctcagcttgctctcatgtggcaccactgggtcatccttcccatcccatgacagttgttagactcaagttcaggtttagttggtctatcctagccccccgtgttgtttaccattccacagacaatgcatttcttggctactgggaaaaaacatcctgcagtgtgaaccaatctccccctctccctgcctagccctgggtctcagtttgcagaggctctgccttgggctcattctcacagagcagcagcagccgcagataaaagtggggcaaggttcacctgagcacaaagcagagcccggactggctaataaattatgtagagattctattgctcagaacctgaatccattattcagctttaaaacaggaataaaatatgcaaatgcagcaggcagaagtgcacacacagcacacaccatgcttcagccttggcaatggctgggcccactggagtttcagagacagacactttatttcctctgcctacgagtgtgtagaaagagacagaaatctcagccatggcaaaaaagcaccgggccactgtttatcttcagatctggccttgggagacatctttagtggcccccagcagcagagaagtcaagaccagcctctggggagaggcttgggtcaacctgtccttgtctttcccctgaaagagggaaactctttgatggcagtttcaatgcaaagttgtgcccttcccgatcccattctcctataaaataacctattattggtggcatccatatatgaacataaatcccctttgacaatttttgtttgatattttgggttagcacattctgctacttattgggtaaggtagtcatgttttctttactctgatgttgacctctttctatcaagtaagttgctgagacgaggctgggcgcggtgggtcacacctgtaatcccagcacttttggaggccaaagtgggccgatcacttgaggtcaggagttcgagaccagcctggccaacatggtgaaactccgtctctactaaaaatacaaaaattagccaggtgtggtggcgggtgcctatacttccaactactcgggaggctgaggcaggagaatcacttgaatctggtaggcagaggttgcaatgagccaagatctcaccactgcactccagcctgggcaaacgagtgagacaccatctaaaaaaaaaaaaaagaggtctacattcagcttgtctactcctcagtcacgattttaaggttctcatccataagagaggcctgaggcttctcagttttaaaaacgtgtcctcatggcaactcccacaccatccttgactctgatcccccctgcttcttctctggctttggtatggctttctttggttctgccacccaaagtgaaactggcttggttgtgtgcctaggctgggaagatttaatctcattgaaaaagtagctgctatttaatgaaaagagggctggatttgaaatctgaaaatatgggctcaaggcctgcaagtacaatttactgctggggccaccctggtggagccgtttcgcatcctggagccgtcagtgtcatggataacactgaactcagtgaactcagacctttggtacaagagtcagacaggatgatgggtgtaaaagtattgggtaggatgtgttgtttatcctcatatcactaggactgtatccggctgacatgcaccagaacacattactggttgttaaaatgctgaagtatttctgtgccaggtcagaaatagctgtctttccaagaagccccacacccccaatgtcccagggttcctcagtgctcttcccacctcgacctctcgtttactgcccctgcattcccactgtcctgcaacgaaagagttaatggctggtactattcccgagactcacaattttctgcctttggctccaggcaacacacatttattttcagcattaactggagcttaaccccaatgttaaaaattagaatctgcagaagttaaaattggccgcttaaggcaaattctctctccctctctctgaaagtatgaattactgcttctactgtctgggtaagatgaacttgatataatagccccaatcttgtttgttccaatagaatatttcatacggtcgaagaaggctaaattatgtgttttgaaattccctgaagctgcaattcaagaagtgtataattaagccctggcattattaaggagtagaaaatatttttcttccaactttcctatggtttaaaaactattcaggctttggatttttgtgatagcagactaggtgacacattctaagaactaccgttaaatggtgaacgaaagtcaatgaatgtggccctcctgctgggagtaaaaagactttctcacagctttgcattggcagcaggcgtaggtattcccttcttggaggcggccctgagaatctgtgacaggtgcgacacttttcagctacagtgtctggaaaagatatggttcagccttcagatcccttcctggcaggggtgacgagagtgggccgtggcagtcattaagttcattgtttcagtgagatccatacctccttgagaactgcttatgtttctctaaagagataacgtcactaaagggtgaaggcttttaaggataaaatcacacaaaaaagaatatattcttgcattgcttagatgttgttttccgtccctggggctgttataacaaattgccaaaaacacgatggcttaaagacaacagagttttattctttcacaattctgtaggtcgaagtctgaaatcaagtgtgagcagggccacatgggcccattctgaagacccgaaggagagtccccctttccctcttccagcgtctggcagtcctaggccttctttggttgacggcagcctcacttccatctgtgcctgtgactcacatagccctcttctcaaagtctctgactttctcttctcttaaaagaacacctcggctgggtgtggtggcacacgcctgtaatcccagcactttgggagccccaggcaggtggatcacctgaggtcaggagtttgagaccagcctgactaacatggtgaaacctcgtttctactaaatacaaaaaaattagctgggcatggtggcacatgcctgtaatccaagctacctgggaggctaagacaggagaattgcttgtgcctgggaaggcagaggttgcagtgagccgagactgtgccattgcactccagcctgggcaacaagagtgaaactccatctcgaaaaaaaaaaaaaagtaaaaagaatccccaaaaaacccccacacctgctgttgagtttagggcctctcctcaatgcagagtgctctcatcttgagataacttaatgatatctgctgataaagatcctttttcccataaggtcacattcaccaatactgaagattaggacatgaatgtatattttggagtcacaatttaacagactttagatgtatatttaaaaaattcggaagataactaagggattgattacaatagttatctatctggggagagggcggaaagagaggataaggcagcagaggaggaagggagaattttgcttctatttcattcttaaacaatttaaagttttgagtctggtaaatctgtcacttagtaaataattaaacaagtaaatctaatttaaaatgatacattttcatttttatacttttttttttttttttttgggacagagtcttgctctgttgcccaggctggggtgcagtggcacaatctcggttcactgcaaactcagccttcccagttcaagcgattctcctgcctcagcctcccaagtagctgggattacaggtgtgcaccaccacacccggctaatttctgtatttttagtagagatggtgtttcactatgttagccaggctggtctcaaactcctgacctcaggtgatctgcccgccttggtctcccaaagtgctgggattacaggggtgagccaccatgcctggcagtcagtttcaatctttttcaatcttttttttttttttgagatgaaattttgctctcattgtccaggctggaatgcaatggtgtgatctcggctcactgcaacctctacctcctgggttcaagcaattcttctgcctcagcctcctgagtagctgggattacaggcgcccaccaccaggcccggctaatttttttgtatttttagtagagacggggtttcaccatgttggccaggctggtcttgaactcctgacctcaggtgatctgcctgcctcggcctcccaaagtgctaggattataggcatgagccacagcatggggcccagtttcaatcttttaccaatgaaaacctgaacacaaaacaataattcttaaccaatcatgatgaaacacagtaacttttttttttaataaaaggaagaagaaagtgttgaaaattgacatctatgtttacatatcacagcaacacaaagtgccagcaaaaaaaaaaaaagtggaaaaatgaaagtatcttggccccatgagttttgctctgcttcccactgtcatttattcagtacatgtgtcactagatccaggacttgctctagaagttggaggaagtcaatggcactgtgagaaacgtgaattaccaagggactctgtcatgtccttcgttactcatgtgacttccttacatgaaaggaaaatagatcctggggcctccaaatcactcagctaaagggaaaagtcaagctggatctgcttagggcaaacctgcctcccatttattcaaagtcatcccactcttcactgagataaatgcatatctgatggcctcctttggaaaggctcatcagaaactcagaagaatgcaaccatttgtctcttatctacctatgacctggaatttcagtattaaaccaatgtttatcttgcatatattgattgatgtctcatatctctgtagagactacatgaaaattttgttgttgaaataattcgttgtactgagcttcaattgaaatgcttaaataccttgaaaacatttccatttttgcctttactcaaatcaggtggtggctactttctaatgaatgcaaatcccagtatgtgaaaagtgtgggttaggacaataaaaggggaggtgacaccattttaatggtttctcagaagctgtgctccgatgtccttgggcacatgtcatcagtacctcctgaggttatgtcacaggtgcatgtccttaactttggcaaaataaacttcctaaattaactgagatctgtctcagatattcaggcttcagagctatgccagctaaccccttatgctgaaaacgaggacttagaaggaaagggcaagagagccagacttgctttttccttttttttttttttttttaagtctttccttattcatcaataagccaaaagtagaggttgttagtagaaaatgtgtgcaccaagaagtgaaataaaga

SEQ ID NO: 92 - DNA, 6462 bp, Homo sapiens
aacacagaactgaaaacctcgctgtctattggtggctggaactttggatcccagggataagacctagcattcaggattgaatcatttccagattaatcagtctcttccaagctccaaggactgtaagtttctctaaagtgagtgaaccccgggcctcagaccccagtgtagacatcccagaactcttctctgaccaggtctccctgaagtctgctcttccttcatcatagctcttaccacactatttttttaaattggacatttcatgattttttgttatattatttttaacttagttttttaattgacatacaataactgtacatatttatgggatacatagtgatgtttcaatatgtataatgtagagtgatcagatcagggtaattagcatattcatcatctcaaacatttgtcatttttttgtgttgacaacatttaatatcctctttttagccctttgaaactatacattattgttaactatatagtcatcctataccacactgtattttaagttccatttacttatctataccttcctctatatgagctcctccagggcagaaactattttattcaccactctatcccagcaatgttaataaatgacagaataactgaatgacagtaaatgacaatagatgacagaataactgaatgtatgtccaggcaaatagtaaggcggataagtggcaagacagagtattcaggagcttaggctactgtgatttaggctacaatgacttattgactccagattctctgatgtggcggccactgctgagaaccgccagaccttcatgcagtcagccatacagtttctgaggaagtacaacttcgatgggctggacattgattgggagtatccaggcaatcgtggcagcccagctgacacccagcagctcttcaccatcctgttgaaggtgtctcaccctcactgtgtccaaagaatacatgatctggcccacagcgggctgggagttctggagaggggttctgagagaggctgaatatatgctggccaggggtgtggatctcaccctttctggctcacagcctcatctctttagtgtaagagcagatctctcttttggggaaaactccgactggcagtgagaagtatatctttgagcaccaatgttagcttcgatgctcttatttccccttcttccattttttctgatgattagatgcaatcacatatacagtttgcagtgctggaggccatttttgtctctttaatacaatctccctccttttaaaataaaattctactctggacattatttgtttattttaaaatttaactttcagaggatgaccgaatttccctcatttccaagttttcggaagacagcttactgttatccccagataccaacaacagcttttggatcaaaggactctaaaccgagcacgttgcagctttcttcataagagctgtgacctcgtcacatgcccacttgtccctctagcctgtgttcagtgtcttctgtttcacaggaaatgtatgaggcttttgagcaagagtctacccgcagcaaaaagcccagattgttgatgtctgctgctgtgtcagctggcaaaggtaccattgagactgcctgccagatccctgagatgtcgaggtaagcaaacccaggagctcatattcagagctaagtgacccttagaccttccccgggcattgtcaaatgcccagataccagtgaccaatgctcaggtacccaggatagagaggactctatctcagaggaatgaaatgacctcaattcctgaggaagaggcagagggagacagtatgaatgctggccttgtttctaagtctatctccaaggttctctagggcaaacggccatttggagaaggttaattgagtctcaagcttctacaagtcctgaaggtctgagtgtaaccagatagtgatcatggaatgggtgccttttatattccaggtgctcttgagatgaaggtgagggagaatggaataaagaataacaatgcataagggaaactttattgcatagtggcaaacagcagatttggctgtttgtcaaatctgcaatcagccgatttgggactaggagtgttaggggtagtgggttagaaagaatgatttcccttgggtcatttatttcctcttgctctctctcccagctacctaaggtacatggacctcatcagtctgatgacctatgacctaaggggctcctgggagggcttcataggcgaggacacccccacttgcaggacctaatgaccagggagactacaaatacttttatatggtgagtgaggaagccagtcctaacagacatcttcaaagcctgtcactggatcccctgccccagactgcaaaggagaccaagaaacttgatggacagctcatgttctctacctccctgtccctgtgactgattgtatccattcatctttcacaaaaaaggaagcagaatagtggcttgggataatcccaaacattggggaattttaaaaaatatattttccatttatgctaggagcacatctcatgatccatcttcttcccactcttccttccctcccttccaccctctttcttcctaatttatgtggtttaggcagctgtaatagttagtctgcctaatgattagtaggtgagtaaatgggctagatgtcatttcagtggagatttcaaccagggatttaaaaattgacatgggaaaatctcccagtcgatgctccatgcacgaacaattctcagcattgtagtaagcccatttggaagacaagtggatgcatggctgaacaccagtcatgccccagatgaactccagtatgaggaaaaagaggatctctggctaacactgggccctgctactaaagcaatgaacctctcttaacacccattctagaaggggcagcactcctttcctttcaatgagattggactgtggaaggggtttgactggatgctgtacctggagatactagggaattaggcagaaaacctggctgttccaaggcctctgggtacatactcagctgctttctcatgatatcttcctcatcttgcctccaggattaggcaatgaactactggaagagccaaggtgcctctgctgagaagctgatggtgggctttggggcttatgctcacaccttcactctcagtaatcctgccaatcatggcctggatgctcccacttctggccctgggacttctgggccctatacacaggaggctggaacccttgcctactttgaggtaatgtcctcagagggcctagaggacccactctctctgttctcaaggttgaagataagtcaatggagagagtctacactctgatttccagtagagggtaccctgttgctgactgctctgaatatatgtggcagtgagaggaaggaagagtgaaagattgataaaacatcttaaatgttaaccttttaaagtaaacatgcatctttaatattagaactagctaatgcttactgagtgcaaatggagagccaggttgtgctccaagtgacttttatatatcatctcatttaacaaacaataaggtactgcattctccccatcttattcaagaggtgactgaggcacagagaggttaagtaatttgctcaaggtcacagaattagtaagtggcagagctgggattcaaacttaagttgtccagctccagaatctcagaccttacccattatgctatactgtcctcttattagctgttttgagacacaactctttcaaacggaacaaattcatttcaaaaggaaaccaggacacaaggcataaggaagctgcttgttcattgttgcacatgaggttattggcagacaaaggactgaattcatgtctcatctctctagctagagcactccactgtcccatgggacaaaagcagggcagggagctgggtgacactggaaccagtttctattatttccagcaaaggggaatgggctgggatgaggatcttagaaaagaaatggagggaggacagagaattggcctgagtacagcagggccaatctgagttatgactgctccttctgtacctgccccagttctactccttcccgaaaggagccacctaggtgtggaatgccccctgggaggtgccttatgtctacaaggggaaccagtggatcaggtacgacaactccaagagcttcaccctcaaggtaaggccctccacactcttcctaatgcatggttggggagagttgggggacctaccctccagttgcccttgaattgcaatcccaggagacccctgagggaggtgaggagagacacagagaggttgtgaagtttcagggtgagccagtgacccagccacggagcctgacagttggagcaaccccttcacctccttttccttcctttccttgactcctgcactttctccttcttcccacccctggagactctcctttggccccctcccctgctcttctctggtcctcatgcagctctttgattcatgcttcctgcttcttgatacaggtgttcttccccactccaaagacaaagtgtagaccacagagttttttgctctcctttgcctatctcctgcccatggcaaattcacacaggctgagcccaaatcgggaggcgatagagcctctggtctgtgaggttatgctcaggtctggggaggacataattgctgtttatcaatcccagggcccttcaccctacaccttccatctagagccctctcactttgcccaggtactttgctttgtgaagggccctatatctctatagcactcaacccacccaaactccagctctgaggtgccttctcagaaggtggttggtgataacaaagggcagggggtaagagctgcttggggccaagactcattctctgtgacttagtcctacagtcctgtacatacaaatatgttcatgaattcctcaaagttgcctcctcaaaacccacccccagtctctcctctccatgactagatcatggtcctcctgccatcctgctggagttactccctgcatttgtgcaaggacagcccagaatccccctggttctcttcctctggtttagtggctcctaaagaacagatttggaggggccattgtctgggccattgacctggataatttcacaggcactttctgtggatgaggcaaataccctctcatgaatgcactcaaatccgcgcttggtgtctccgcacccagtaagtagtgatgacctaacagccatgagataacaaactagacatggttaagaggaagagaagaccagagctcctcccagtctcacctcaaacaaggcctcctccagatcttccagctgtcttagtgtgtccagttggaacttgcatttaggacccagaaagcaagacccagtggacttactaaagggcaggccatgagtgagagccctggcaagtaaaaggggacctatcaatattctggaggattctcctctgtagagctactcagggaagcttctataaagtaaactgaacatgctggagcctgggtagggaaggggacaaaaacaccgtattccctgtcactgctgctcggctccagcttttatgaactttgtgggtcagaggaaaaaaaaagcaagggagggattaaaaacttagaagatgaggaaaggaatgagagaaggagaactctaaaggggctcagctagcatctttcctgaagtggggagcagagctacagatggtctcaacacatgattctatcccagccccgagaacagggcaagtccaggaagaaagaggggctgggaagctgcggaaaaagctagtgctaatgattggatctttattccgtgtcaagcctgctggttcttttagatttcgtataattctcataggcactcttggtgccagctgtattagtttacttacaaataaaagctaataattatgtggtactcactatgttatatagcgtgcacattggaaaatgctttacctaataattctaagagataatacaattatgccatcatttcagagaggaaattgaggctcagagaagtgttaatgaatttctcatggtcacatagctcatggcagagctgggctatgaacttgggtatcctcgattcaggctcagagcattaaaccactggtttaggtaggatgtgtactgagagaaacccacagtgaccttacagacatgacactcatcctgggaaaggagtcctctcctgagcttatggggaccattttccttctctcttcagattgcagagtacccacctctatcctgggcaccagcttggcccccatcatcactgcagcacctgggggtggcagcacaggtggcagtggattctgtactgggaagtccaaaggtctgtatcctagtcccaccagcaagcatgctttctacaactgtgtggatgagcacacatacgaggaggcttgtcaggaaggcctggtctttgataccagctgctcttgctgtaactg

SEQ ID NO: 93 - DNA, 647 bp, Homo sapiens
attttgcttaaatttaaaaaaataacattaaaacttagtttatctttccactgagtaaaactgagaaaaagttggcttttagatcatatatttatttaaaaaaataaaatgggaaattgacaaagttaccacattattctgcatgctaacaggatttcccaagcctgtgagagaatcatttcttgagcaattaaaaaaaaaaaaaaaaaaaaaaggacttcctcaacaatgtaaagataggaaacttttcaatccaaattcaaggtctttattactagttccacctcacaagctagtgggatgtatctgtgtcacaagctgaattcctcagtaaagaaagcttgagaagacactaaacaaggatgttactaaaagacaatgatttgttaaaattataaagcaatcatcttttggcctgcaaacagtcaacattagaactctccaccactgcggatctggctccccatcacagtattattctgaatccaggataattacaatcacatggcatttttttctgcatgctttcttggcccaaaccctgcatgacaacatatacaatttacaagatgggacttgaaattcccattctcacacaggatagttagggcgtgttaccaataataaagaataaaagttatacaaca

SEQ ID NO: 94 - DNA, 91325 bp, Homo sapiens
aaccagcagcacccagtggccagcagcgtactctttcacctcttcttgggtgactttgtggaatgctccaatgtgacatctccctgtgaacgcctttcctgacaccctaaaaagtgtcaggaatttccagcaagttccagagagcaggtttccagcaagtttggtcagtatgacaccacagcgatatctctgccattcactgaacttggattcttccttcttcagtgaggtatggatttcaaccctggattgggaagtggctggggacccttccctgggcactgtatcccagccctggggacagtggctgcttcatattcccgtatccattagcattctcttctttttttttttttcctttccaacttttattttaggttcaggggtacatgcgcaggtttgttacatgggtaaactatatgtgatgggggtttggtgtacagattatttcatcacccagataataagcatagtacttgacaagtagtttttcaatcctcaccctcctctcaccctccaccctcaagtaggcccaggtatttagtttccttctttctgtccatgtgtactcaatgtttagcttccacttataagtgagaacgtgaagtatttattttctgttcttgcattaaattgcttaggatactggcctctagctctattcatgttgctgaaaaggacaagatttcactgttttttatggctgcgtagtattctgtggtatataatatgtaccacatgctcattatccagtccaccattgataggcatctaagtggattccatgtctttgctattgtgaatagtgctgtgatcaacatatgcatgcatgtctttatgggaaaattatttatgttcctttgtgtatatacccagtaatgggattgctggcagttctgtcttaaattctctgagaaatctccagactgctttccacagtggctgaactaatttacgttcccaacagcagtgtgtatgcattccctttgctccacaacctcaccagcatctgttattttttgactttctaataatagccattctgactggtgtgagatggtatctcattgtggttttgatttgcatttctgtaatgattagtgatattgagctttttttcataggcttgttggctgcatgtatgtcttctttggagaaatgtctgttcacgtcatttgcccattttttaatggggttgtttgttttttgcttgttaatttatttaagttccttatagattctggatagtagacctttggtgtatggtttgcaaatattttctcccattctgtaggttgtctgtttactctgttgataattcccttttttgtgcagaagctctttagtttaattagatcccacttgtcaatatttgtttttgttgcaattgcttttgaagtctttgtcatgaaatttttgccagggcctatgtccagagggtacttgctaggttttcttctagggttttcatagttttaggttttacatttaagtatgtaatccatcttaatttgtgtatatggtgtaaggaaggggtccagtttccattttctacatatggccagccagttatcctagcaccatttataaaatagggcatcctttccccattgcttgttttcattgactttgttgattatcagttgtaggtttctggctttatttcggagttctctaacctgttccattggtctatgtgtctgtttttgtatcagtatcatactgttttggttactgtggccttgtagtaaaatttgaagttaggtagtgtgatacctccagctttatactttttccttaggatttctttggctatttgggcacttttctggttccatatgaattttagaatagtttttctaattctgtaaaaaatgtcattggtagcttgataggaatggcattgaacatataaatttctttggacagtatggctgttttaacaatattgattcttcctatccatgagcatggaatatttttccatttctttgtgtcatctctgatttctttcagcagtattttgtaattcttgttgtagggatcttttacctccctgtttagctctattgctaggtacttctttgtgttgcttttgtgaatggggttgcattttaaaaaataatttaaaaaattttgaggggtacatattaggtgtacatatttatgaggtacatgagatgttttggtacaggcatgtaacacataataatcatgtcatacaaaattggctatttatcccctcaagtatttatcctttgtattactcttttagttattttaaaataactaaaattatgcttttagttattttaaaatgtacaattaaattattgttgactatagtgcccctgttatgctgtcaaatactaggtcttactctttctttctattttattttgtacccattaaccaaccccacttcttccctgccctcccactacccttcccagcctctggtaactatcctgttctctatctctgtgagttcaattgttttgatttttagatttcacaaataagtgagaacatgtgatgtttttctttatctgcctagcttatttcacttaacatgatgacagccagttccatccatgtcgtcgcaagtaacagaatctcattcttttttttgtggctgaatagtactccattgtgtataagtatgacattttctttatccattcttctattgatgaacacttaggttgcttctaatgttggctgttgttaacagtgatacaacaaacatggtagtgcagatatctcttcagtatactgatttttttcttttggtacatacccagaagtgggattgctggatcacataatagctctattttagtctttcaaggaacctccaaactgttttccatagcggttgtactaatttacatttccaccaacagtatatgagggttcccttttctccatatcctcaccagcatttgtttttggctgacttttggataaaagccattttaactggagtgagatgatatcttgtaattttgatttgcatttctctgatgatcagtagcattgaccactttttcatatgcctgtttgccatttgcatgtcttcttttgagaaatgtctattaaaatattttgcccatttttaaatcggattattagatttttttcctatagggttgtttgagctctttatatagtctgcttattaatcccttgacagatgggtgttgcaaatattttctcccattctgtgggttgtctcttcactttgttgattgtttcctttgctgtgcagaagctttttaacttgatgtgatcccatttgtccatttttttctttggttgcctgtgcttgtggggtacgactcaagaaatttttgcccagaccaatgttctggagagtttcctcaatattttcttgtagcaatttcataatttgaggtcttagattgaagtctttattttattttattattaaactttaagttttagggtacatgtgcacaatgtgcaggtttgttacatatgtatgcatgtgccatgttggtgtgctgcacccattaactcgtcatttaacgttaggtatatctcctaatgctatccctcccccctcccccgaccccacaacaggccctggtgtgtgatgttccccttcctgtgtccgtgtgttctcattgttcaattcccacctatgagtgagaacatgcagtgtttggttttttgtccttgcgatagtttcctgagaatgatggtttccagcttcatccatgtccctacaaaggacatgaactcatcagtttttatggctgcatagtattccatggtgtatatgtgccacattttcttaatctagtctatcattttggacatttgggttggttccaagtccgctattgtgaatagtgccgcaataaacatacatgtgcatgtgtctttatagcagcatgatttataatcctttgggtatatacccagtaatgggatggctgggtcaaatggtatttctagttctagatccctgaggaattgccacattgacttccacaatggttgaactagtttacagtcccaccaacagtgtaaaagtgttcctatttctccacatcctctccagtacctgttgttccctgactttttaatgattgccattctaactggtgtgagatggtatctcattgtggtttttatttgcatttctctgatgaccagtgatgatgggcattttttcatgtgtcttttggctgcataaatgtcttcttttgagaagtgtctgttcatatcctttgcccactttttgatggggttgtttgtttttttcttgtaagtttgtttgagttctttgtagattctggatattagccctttgtcagatgagtagaatgcaaaaattttctcccattctgtaggttgcctgttcactctgagggtagtttcttttgctgtgcagaagctctttagtttaattagatcccatttatcaattttggcttttgttgccattgcttttggtgttttagtcatgaagtccttgcccatgcctatgtcctgaatggtattgcctaggttttcttctagggtttttatggttttagatctaacatttaagtctttaatccatcttgaattaatttttgtatacggtgtaaggaagggatccagtttcagctttctacatatggctagccagttttcccagcaccatttattaaatagggaatctttcccccatttcttgtttttgtcagctttgtcaaagatcagatagttgtagatatgtggcattatttctgagggctctgttctgttgcattggtctatatctctgttttggtaccagtaccatgctgttttggttactgtagccttgtagtatagtttgaagtcaggtagtgtgatgcctccagctgtgttcttttggcttaggattcacttggcaatgcaggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatactcttttacttcactgagcactggtttgtagttctccttgaagaggtccttcacatcccttgtaagttggattcctaggtattttattctctttgaagaaattgtgaatgggaattcactcatgatttggctctctgtttgtctgttattggtgtataagaatggttgtgatttttgtacattgattttgtatcctgagactttgctgaagttgcttatcaccttaaggagattttgggctgagacgatggggttttctagatatacaatcatgtcatctgcaaacagggacaatttgacttcctcttttcctaactgaataccctttatttccttctcctgcctgattgccctggccagaacttccaacactatgttgaatgggagtggtgaaagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagacaatcatgtggtttttgtctttggttctgtttatatgctggattacatttattgatgtgcatatgttgaaccagccttgcatcccagggatgaagcccacttgatcatggtggataagctttttgatttgctgctggatttggtttgccagtattttattgaggatttttgcatcgatgttcatcaaggatattggtctaaaattctctttttttgttgtgtctctgccaggctttgatatcaggatgatgctggcctcataaaatgagttagggatgattccctctctttctattgattggaatagtttcagaaagaatggtaccagctcctccttgtacctccggtagaattcggctgtgaatccatctggtcctggactttttttggttggtaagctatgaattattgcctcaatttcagagcctgttattggtctatcagagattcagcttcttcctggtttagtcttgggagggtgtatgtgtcaaggaatttatccatttcttcttgattttctagtttatttgtgtagaggtgtttatagtattctctgatggtagtttgtatttctgtgggatcggtggtgatatcccctttatcattttttattgcgtctatttgatgcttctctcttttcttctttattagtcttgctagcggtctatgaattttgtcaatcttttcataaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttaatgctataaatttccctctacacactgctttgaatgtgtcccaaagattctggtatgttgtgtctttgttgtcgttggtttcaaagaacatctttatttctgccttcatttcgttatgtacccagtagtcattcaggagcaagttgttcagtttccatgtagttgagtggttttgagtgagtttcttaatcctgagttctagtttgattgcactgtggtctgagagacagtttattataatttctgttgttttacatttgctgaggagtactttacttccaactatatggtcaattttggaataggtgtggtgtggtgctgaaaagaatgtatattctgttgatttggggtggagaattctgtagatgtctattaggccgcttggtgcagagctgagttcagttcctggatatccttgttaactttctgtctcgttgatctgtctaatgttgacagtggggtgttaaagtctcccattattattgtgtgggagtctaagtctctttgtaggtctctgaggacttgttttatgaatctgggtgctcctgtattgggtgcatatatatttaggatagttagctcttcttgttgcattgatccctttaccgttatgtaacggccttgtctcttttgatctttgttggtttaaagtctgttttatcagagactaggattgcaacccctgccttttttttgttttccttttgcttggtagatcttcctccatccttttattttgagcctatgtgtgtctctgcatgtgagatgggtttcctgaatatagcacactaatgggtcttgactcttcatccaatgtgccagtctgtgtcttttaattagagcatttagcccatttacagttaaggttaatattgttatgtgtgaatttgatcctgtcattatgatgttagctggttattttgctcattagttgatgcagtttcttcctagcctcgatggtctttacaatttggcatgtttttacagtggctggtaccggttgttcctttccatgtttagtgcttccttcaggagctcttttagggcaggcctggtggtgacaaaatctctcagcatttgcttttctgtaaagtatttcatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtgggtaacctggcgtttctctctggctgcccttagcattttttccttcatttcaactttggtgaatctgacaattatgtgtcttggagttgctcttctcgaggagtatctttttggcattctctgtatttcctcaatttgaatgttggcctgccttgctagattggggaagttctcctggataatatcctgcagaatgttttccaacttgtttccattctccctgtcagtttcaggtacaccaatcagacgtagagttggtcttttcccatagtcccatatttcttggaggctttgttcgtttctttttattcttttttctctaaacttctcttctcacttcatttcattcatttgatctttcatcactgataccctttcttccagttgatcaaatcggctactgaggcttgtacattcgtcacgtagttctcatgccatggttttcagctccatcagatcctttaaggacttctctgcattggttattctagttagccattcgtctaatcttttttcaaggtttttaacttctttgccatgggttctaacttcctcctttagctcggagtagtttgatcgcgtgaagccttcttctctcaactcgtcaaagtcattctctgtccagctttgttccattgctggtgaggagctgcatttgtttggaggaggagaggcgctctgctttttagaatttccagtttttctgctctgttttttcccatctttgtggttttagctaccttttgtctttgatgatggtgacatacagatggggttttggtgtggatgtcctttcactttgttagttttccttctaacagtcaggaccctcagctgcaggtctgttggagtttgctggaggtccactccagaccctgtttgcctgggtatcagcagcggaggctgcagaacagtggatgttggtgaacagcaaatgttgctgcctgatcattcctctggaagttttgtctcagaggagtacctggccgtgtgaggtgtcagtctgcccctactggggggtgcctcccagttaggctactcgggggtcagggacccacttgaggaggcagtctgtccgttctcagatctcaagctgtgtgctgggagagccactactctcttcaaagctgtcagacagggacatttaagtctgcagaggtttctgctgccttttgtttggctatgcccttcccccagaggtggagtctacagaggcaggcaggcctccttgagctgcagtgggctccacccagtttgagcttcccagccgctttgtttacctactgaagcctcggcaatggtgggcacccctcccccagcctcgctgctgccttgcagtttgatctcagactgctgtgctagcaatgagcgaggctctgtcggcataggatcctccgagccaggcatgggatacaatctcctggtgtgccgtttgctaaggcccttggaaaagtgcagtattagggtgggagtgacccgattttccaggtgccatctgtcaccccttgtcttggctaggaaagggaattccctgaccccttgtgcttcccaggtgaggccatgcctcgctctgctttggctcacgctcggtgtgctgcacccactgtcctacacccactgtctgacaatccccagtgagatgaaccgggtacctcagttggaaatgcagaaatcattcatcttatgcgtcactcacactgggagctgtagactggagctgctcctattcggccatcttggctcagatttaagtctttaatccatttttatttgatttttgtataaggcgagaaatagggatcaagtttcattcttctgcgtatggatatctagttttcctggcatcatttatcaaagagactgtcttttcccccaatatgtgttcctggcacctttgttgaaactgagttcattgtaggtgtgtggatttgtttgtgggttctgtattggtctatgtgtctgtctttatgccagtaccacactgttttggttactatagctctagctctgtagtataatttaaagtcaggtaatgtgattcctccagctttgttttttgtttgtttgtttgtttgtttttttgtttgttcagaatagctttggctattctgggtcttttgtgattccatataaattttatgattttttttctacttctgtgaagatttcattggtattttgatagggattgcattgaatctgtaggttgctcaaggtagtatggacattttagcaaaattgttttttccaatccatgaacatggaatatctttgcatttttctgtgtccatttcttccatcattgttttataattttcattgtagaggtctttcatttctttggttaattcctaggtatttggaattgcatttgtgatttggatctcagcttgaatgttattggtatagagaaacgctactgatttttgtacattgtttttgtatcttgaagttttactgaagttgtttaccagatataggaccttttgggcagagactatggggttttctgggtataaaataatatcatctgtgaagagagatagtttgacttcctctattcctacttggatgccttttaattctttctcttgcctgattgctcagctaggacttccagtatgcatttaatatgagtggtgagagtgggcttccttgtcttgttctggttcttaaggggaatgcattcagcttttgcccattcagtatgatgttggctgtgggtttgtcatagatggctcttatattttatgcataatttgttgagggtttttaacatgaagagatgttgaattttattgaaagccttttctttgtctattgagatgatgatgtggtttttatttttccttctgtttatgttatgaatcacatttattgatttgtgtatgttgaatcaaccttgcatcctaggaataaagcctactttctcatgatggattagctttttgatgtgctgctggattcggtttgatagtatttagttgaggatttttgcatctgtgttcatcaaagatattggcctgatgttttgtgtctgtgtgtgtctgctgggttttggtatcagaatggtgctggcctcatagagtgagttagggaggagtccttttcctcaatttttgggaatagtttcagtagaattggtactggctcttcattatacatctggtagaattctgctgtgtagccatatggctcagggctttttctgattggtaggttttttatgaatgattcaattttggaactcattattggtctgttcaaggttttaatttcttcctggttcaatcttgggaggttgtatgttttcagtaatttattcatttcttctaggtttctggtatgtgtgtgtagaggtgttcataatagtctctgaggagtttttctatttctgtggggtcagtgctaattccccctttgtcctttctgattgtccttttttgaatcttctctctttttttctatataattctaactagtagtctatcaatcttatttattatttcaaaaaaccaactttaggttttgttgatcttttgcatgttttttcacatctcaattttattcagtttggctctgattttggttatttgttttcttctgttagctttggggttttttttttcttgtttttctgattcctctaggtgtgacgttagattgttaatttgagagctttctaactttctgatgtgggcatttagcactataaactatcctcttaacacttcttcatttgtgtcccagagattctagtatattgtatctttgttttcataagtttcaaataatttttttatttctgccttaatttcactgtttacccaaaagtcatttatgagacagttgtttagttttcatataattgtattgttttgagagatcttattagtattgatttctgtttttattttgctgtcttccaaaggcttggttggtatgattttgatttttctgaatgtgttatgaattgttttatggccaagcatgtggttgattttagagtatgtgccatgtgcagatgagaagaatgtatattttgttgttgttggatggagtgttttgtagatgtctgttaggtctatttggtcatattgtgtttaggaatatgtaacaaatatgtaacaaatatctttgttagttttctaccttgatgttctgtctattactgtcagtggggtactgtattagtctgttctcacactgctataaagaactacctgagactggataatttatggagaaaagaggttaaattgactcacagtttgcaggctgtacaggaagcatgactgggagggctcaggaatcttataatcatggcaaaggcaaaggggaagcaagcacatcttaccatggcagagcaggagagagagaaggggaaagtgctacacactttcaaacaaccaggtatcttgataactcactcactatcatgagaatagcaagggggaagtccacccctcatgatacaatcacctcccaccaggcccctccttcaacactattaattacaatttgatatgagatttgggtgaggacacagtgtcaaaccatatcattccacccctggcccctcccaaatcccatttccttctcatatttcaaagcacaattatgctttcccaacagtcctgcaaagtcataactaattccagcattaactcaaaagtccaagtccaaagtctcatctgagacaaggcaagtcccttctgcctctgagcctttaaaatcaaaagcaagttagttactttcaagatataatgggggtacaggaatttggtaaatagaccttttctaagagggagaaatcagccaaaacaagggggctacaggccccatacaagtctgaaacccagcagggcagtcattaaatctcaaagctttaaaataatctcctttgactctatgtctcacatccaggccacattgatgcaaggggtagactcccaaggccatggacagttctgcccctgtggctctgcagttcccacagctgttttcatgggctggcattgagtgcctgcagcttttctgggcatgtggtgccagctgttggtgggcctactatcctgaggtctggaggatggtggccatcttctcacagctccattaggcagagccccagtggtgactctgtgtgggagcttcaaccccacgttttccgtctgcactgccctagttgaggttctccatgagggctctacaccacagcagacttctgcctggacatccaggcatttccatacatcctctaaaatctaggtagagactccaaaacctcaactcttagcttctgcacacctgcaggctccgcaccacatggaagccatcaaggctttgagctttcaccctctgaagcaatggcccgagctgtacattggcccattttagccatggctgaagctggagtggctcagatgcagggcgccatgttctgaggctgcacagagcagcaaggccctgggcctggcccatgaaacatttttttcctcctaggtcttcaggcctgtgataagaggggctgccatgaaggtctctgaaatgccctggagacattttctccgtcgtcttggcagttaacattcagctcctctttacatatgcaaatttctgcagccttgaattcctcttcagaaaatgggtttttctttttatattgcatggttgggctgcaaattttccaaacttttttttttttttttttttttggagacagagtctcactctgttgcccaggatggagggcagtggtgtgatcttggctcactgtaatttccacctcctatattcaagtgattctcatgcttcagcctcctgagtagctgggattacaggcatgcactaacacacctggctaatttttgtatttttagtagagatggagttttgccatgttggccaggctggactcgaactcctggcctcaagtgatctgctggccttagcctcccaaagtgctgggattacaggcataagtcaccacacccagcccgaattttccaaacttttatgcttgcttcccttttaaatataagctctagttttaggtcatttctttgtttatgcaaataagcataggcttttagaagcagccaggtcatatctggaacactttcctgcttagaaatttcttccgtcagaagaaatttcgtctctctcaagtccaaagttccacagatctctagggcaggggcacaatgccactagtctttttgctaaagcatagcaagagtgaaaaataattattccagtttctagtaaattcctcatctccatcagagaccacctcaggctggacttcactgtccatatcactatcagcatttaggtcacaactattcagcaagtctctagaaagttccaaactttccctcatcttcctgtcttctgagccctccaaactattccaacctctgcccattacccagttccaaagtcacttccacattttcaggtctctttatagcaatgccccacttctctggtaccaatggtggaatggctttttgaagtcacaatcacaacgccaactaggtgtgaaaatactttacaaggtttgggcaaagttctccagaaggctgtgtatgctttgaatcagcatccaatatatggtactgtttttcccatagcgggattcatgggttcaggaatcaaggggtggaagtggaagtggcagcattcaccatcacccctagtgacccactagcaaaatttttacattcttttcccacaacattatcttctactggcctagaggtcttagttccagaggaaggaatgctgccaccaggagacacagcaatgattccatttaaccggaagttaagattgccacctggccactctggcctcctcttgcctctaagtcaacaggctaagaagggagttacagtgttggctgaagtgattgacccagactatcaagatgaaataagactactactccacaatggaagtaaggaaaagtatgtctggaatacaggagaccccttagggcgtctcttagtattaccatgccctgtgattaaggtcaatggaaactacaacaacccaattcaggcaggactacaactggccagaacccctcaggaatgaaagttttggtcactctaccaggtaaaaaaccgtgaccagccaaggtgcttgctgaaggcaaagggaatacagaatgggtagtagaagaaggtagttatgaataccagctatgaccacatgaccaggtacagaaatgaggattgtaattgtcatgactatttcctccttattttgttataaatatgtttgtgcatacatacacctgtactgagaaagtgtcttcattttatttcccttctttttcctttatcacgtaacgtaagatttattgacttcatatcagcatttaagtgttgttaactttatttaatagcatttaggttaaggattagtgtgcttcttgttgtatgaaggatagttgtattatgttaggcataattatgacctattattttctttatttggagattaagtgtgatttcaggagatgtgtatgagtgccaagttgacaaggagttgacttgtgatagtcaatatgaggtgacaacctgattggattgaagaatgcctagatagctggtaaagtattgtttctgggtgtgtaagttaggatgttgcctgaggagattgacatttgagtcagtggactggaagaggaagacccaccctgaatgttcaatgggcaccatccaattggcgccagtgcagctagaacaaaagcaggaggaagaaggtgggataagacggcttgctgtgtcttctggctttcatttctttcctgtggtggatacttccttttgtttctcctgcccttggccatcagactccaagttcttcagccttttgactcttggacttctgccagtgtttgacgaggggctcttgggccttcaaccacagactgaaggctgcactgttgactttcttgcttttgaggcttttggactcagactgagccactactggcctctatcttcctcaacttgcatatggcctattgtgggactttgccttgtgatagtgtgagccaattctccctaataaacttcctttcatatatacgtatatcctgttagttctgtccctctggagaaccctgactaatacaggtactgatgtcttccgctattattttgtggttgtctaagtatcttcctaggtctcttaaaatttgttttatgaatctgggttctccagtattgggtgcagatatacttaggatagttaagtcttttcgaattgaacccttaatcattatgtaatacctttctttgtcctttttgtcatttgtcagtttaaagactattttgtctgaaattagaatggcaacccctgctcttttttgttttccatttgcttgcttgattttctttttccagtcctttactttgagcctaaggatatcattgtatgtgagttggatctcttgaaggcagcatacagttgggtcttacccctttagattcttaattcttcaccttttaaatggggtgtttagaccatttatgttcaagtttaatattgatatgtacagatttgattctatcattgtggtgttagttggttgttatgcagacttgattgtatagttgctttatggtgtcaattgtctatgtactgaagtgtgtttttgtgatggctagtaacagttttttgtttccatatttagcatgcccttaaggacctcttgtaaggcaggtctggtggtaatgcattcccttagcatttgcttgtctgaaaaggattttttttttttttcatttatgaagcttagcttcactgggtatgaaattcttggttggaatttttttcttttgagaatactaaatataagcacccagtctcttctggcttgtaggatttctgctgaaagacccactgttagcctgatagggtcccctatgtaggtgacctatccgttctctctaactgcctttaatattttttcttttactttgaccttgggaatctgatgactatgagtcttggggatggtcatcttatatagtatctcacagaagttctctgaatttcctgaatttgaatgtttacctctctagtaatgttgggggagttttcatggacaatatcctcaaatatgtcttccaagttgcttgttctccctccctctttttcagggataccagtgagtcataggtttagtctctttacataatatcatatttctcagaggtttgtttattttttttctttattttgtctgactaaattttttttaagaaccagtcttcgagctctgagattctttcctcagcttggtctattccgctgttaatacttttgatttattatgaaattattgaaatgagtatttcagatctatcagatcagtttggttctttcttaaaatgtctattttgtcttttagatctcttatcattttattggactccttggattgggttttggctttctcctgaatcttgatgctcttctttgctatcctgattctgaattccttgtctgtcattttagtcatttcagtatggttaaaaacaattgctggggagcaagtgaagtcatatggaagtaagaagacactttggctttttgagtcgccagagttcttgcactggttctttcttatctatatgggctgatgttcctttaatctttgaagttactgccctttggatgggttttttttgctttctttgatgcccttgtggtataaattggattcagttaactggcttcattgctgaaagatttcagggggctacagctcagctcagcacagctgggctgtgtgctgtaatcctaggcagctggtagcaggcccatggctttattctctggtacttcaaggttaagcacctcctgcactggaggggctgaggtgttcccggcctgctggcaacaacgatctgatgggggatgctggcaaaactgcttctttggggtatggcagcagggtccttgcatgtatgtgtgcactggtgggagcagggcagcagagtccgtgcacacacatgcttgtgccagtagcagcaaggcagtggagtgcgcatgcacatgcacgggcagggcctgtctcacagggttcttgtgagggttaagggagataatacatataaattatttgaaaccgtacctggaacataataagtattcaataaatattatctgttgttataagttaatctgagtggatctgagattgaatttggttggagggccacaaagacaaatgtagtgcctgacaggagcatatgccacagtttacttagccattcctgcgtggcagacattttgttgtttttgatgttttactgtaataaacaatgctattattaacatatttgtgtgcaaaacccatgtacttgggaactttatttatagtggggaatggcaagtcatttatctttaaggaggtgcttcataaaccaacataggttttggcctcacccaatacagcaagtagaattattataaagtatagaataaatcttgttgaggatcttagtgactcaaagtttgccaacttgtcaagaacctctttctaactgcttcttaacatgtgacaaagcaaagtttttcttttgagaaaataataatattcaatacacagtaagtaatcttatcatagtttttaggatgtcctttggctctaagttaggcacattgaaaatgcccattctgagttagttagttaattaagttaatacttattcaaatgtcaaatggtttagaaattaaacaattttgggatgggacttcaggaatgacttaatagttatatgaccttgggccagttattttaacctctgtgaattaagcaattattttggcctctctcagactcagtttcctcataagtataataaaaataataatgcttatgttaatttttatgcaacaattatatattgagtttctattacatgacaggtacttttctaggtgcttgggatgcatcagtgaaaaaaatctccctgttccaaaggaccttacattctagtggtagcaaggacagatgataaatgataaacataatgcttaaataaattatatagcatattagaaaatggtaaatgcaatggaaaatggaaaacacagtgttggataagaaggatcaggtatgcatggaaggatcaatatttttaaaagtgcagttagggtaggtctcactggggtaatatttgaacaaaaatttgaaagaggtaaggcagtcagccatgcagctatgtggggagaggtattccaggtagagagaagcaagtggaaggcccttaggtgggagcatgacaggcatattttaggaatagtaaggacagtgtggctgaagcagagtgaatgagggggaagatggttggagacaaagtcagtgaggtaacaagtcccagatcatgttggaccttctaggcattgtcagagcttcagattttgctctgggtgaaatggaaagtcatggaggattctgaacagaggaacagttgaacttatgttttatcagaatcattctgactcttgagtgaggataaactctgggggtgcagctgatattgtcactccttctccttcctgttccccttcccatggaggatacagcctggcagctgaaaatgtgaggcagcgaaggggttggggcagccatgcagaggcataggctggggttggggagctgcaggctgtgggtcagaagctgagggggtggtgtggaggtggtaggtggaagacacagccagcatggcgggtggtagagtggggagagggagttggtcacactgagcaaattagtaaattgatggtgaatgtaagaataatgggagccaagtttttcactgctggagaaggaatttataaacagaaatgaggaaggctagaaggaactctgaagttggacaggaattggaggtatcagtatgaacatatgattgtctgtctagctagctttgtaattatagatgtttaagtgtgtgccatatatatacacatcatgtccaagctctgttcaccgggagggcttagtagcaataacaccttagtaacaattagtacaatgagcacccagacattggtttctaaaaaccatctttcactggaagataccaaggctccttggagtgatggccaatggctgattccaggttggttggggtgggagtggggagacttggaaagtgtaagatgagcctgcaacgtcttgtactggacaataaggaaaggctcagtgaatggtgggaacatttcaaaaggacacaggggctcctattggtcaaatcagggagaatttttgcattaaagaataataatggattacaactcattgaataaaataggaatctgtgaatccattccgatgcgaatgaataaatgaatgaaaagggtaagcttgactttactataaaatgccaactaataaatgtataaacaataatgtttggcaactttcacagatgtagtttgatttgggctaaagtcatcgatgaagtctcacagaggatggatgctaaggctgaaaggtgaaggtttcatgaggaacaggatattctgacatattctgagaataccttcccctaacatataaatcaattacaaagaaaaaatggtaaatttaagtggagaaagctggcagacatcaacatgaccaggagaccaaggtgggataggttgacattgtatcacttctgatgtgatgccctgagaagagaatgtcattgtttctgtggaattcttgccctggatgaagtgcctgagtctgatcgtaaggaaccatcatcctacagggggtgatcctaccgaatgtaacacttcctactgtgccaagtgcatggaagatggggaaagactgagacacttccagatcaaaggattctgaagagatataacagctaactgtgatgtgttcgtgaaaaactcctgaaccacagagggaaaagagacattttagggaaattagcaacagctgaatgggatttgatggtagtgtatcgatgttaatttcctgattcaaagagttgtatgctgattatataggacagtgttgttgcttttggaaaatccacactgaagagtacttttggggtgacagagcttaccctcaaaagcttctgattatgtagttaaaattatttttaaatacttttatttctaaaagaaggctattggaagtgagagataatgatgatttagatcagggaggtgatgtggcagtggtgggaaatggtcagactcaggatatattttgaagatagaaccaatagaacttcctgatgaattggatataggttatgaaagaaaaataggggcaagaatgattccaaggttttggcctgagcatctggaatgataagtaaactgtgggtgagacaggtttttggagggaatatcaagagtaccatattggatgagttgagtctgagacactctattagacatcctcctaattaagatgtcagggaggcagttagagacaagaattggaagttcaggaagggatttgtgctggagatagaaatttgggagttatcagaaagcagatggtatttaaagtcatgaggggatgagatcaccagaagaggaaatgtagagaagagggcattctcaggactgcttggcaggggtattttcagcctaggtaaactcactgaaaaattactgaaaaatgtccaactatgtaaaaatccacggctaaagtcttcaaagaggtaacagtttgacatatgcaaagaggattaacaacataaagaacaagattattataaacattaacatttacattgtgtttactatgtgtcaggcacaatgttgctttatatagattatcacatttaatcttcatctcaatcttgtgagaggggtaatatcatttctagttttcatgtgaggaaactgaagctcaaagaatttaaataatgtgttaaaggtctcacagctagtaaatagtgagcctgggattcatatccttgtgatctgcctacactaccttccattctaatggctgcactatcctgcctcaagtactggacgaggacagaaagaagcctgtcatggggctctagacccctcttgactgcccaaaacaaccacatcaaaccaacattttcacacacaccacaccacacacacacacacacgtgcacacacaatcaagagctgaagccttagaagatataagaacattccatctttcaggctgactgcccctcacttacggccatgtcagctccctgagagaggtcttagaaattttagtgtgttggaggaaggacttacagtggagtaaacccatgtttccaaggaccatggtccaacaataggcagtggaaagagtatcccaggctccaaagagcaacatcagcgtctgggttatgaacacgaccaaccctgtgtttttaagagctccatctttcctgaaatatccttcttttggcttgctgttatttgccacttttataagctactgagccacatcactggtgtgaacagtttcaaagcttacatatttcttcttgtaatcagtttagtcgatcttgtaactataaagagtgagatggtaaatcctgagctctcattctgagtcagaatttatgataagaacaacgtgcttgtgcccaaacagaaccatgcatgtatggtaatatggcacttgaaatttatgtacttccttttatccaaggaacagaaagtgcttctgtaaaatggatttagagccaactgtctacagcaggcaatgggaacagttcaaaaaaggactgccgagagaatcatttaatttatgcaaggccagggttcacactaaacaaccatgtgccccaatttgtttcacagaaatggttccaggagaccactgccatttcaacccctgctcaacagggatgaattcaactgcatctttgcccaccagttgtatatgaagacattctttcatccctgcggtttagtgctggttgctgcacaggactagcccctggtattagctgaggagatcaccagcagaatgggtcccatcattcctttccactgactaactggttggctcttcttcttagtaagggagagcctttatgattaactgtgctagcatgaaaaaactctagtcttgtaggtaagcccactataatttataaccccactataaaatattatggcttctctctatcacacacttcaaaatgcacatgctacagtaggtccttgtattagttacctatcgctgcataacaaattatccaaaacttagtgcgttaaaaggtttattatgtcccagtgtctgtgggtcaggaatcctgacatggcttgactgagtcttctgcttcaaggcctctctcaagatcttacccagggctgtagtcatctccaggctagactaggggaggacttgcttccaatcatgaggtatttggcatgattcaattctttgagggctgtgagactaaggccccagtttctcacaggctgttggttggaggtctccttcagtcccaagagagagcaccagcacgaatgaagtcacagtcttttgtaacctaatcacagaagtgacatctcatcacctttgccatattctatttgtagaagcacgtcaccagttcacatttacgggcaggggcttacccagggcatgaaaaccagaaggcaggaatcattgggagccactttagaagctgcctgccaccatccgatgtatattgtcacacttgtccttataatgatcctccaatgcagcgttagtcctctcatttcacagatggggcaagttctcagactttagtacttgcacctactgacacatttatctttagtgactcatcgtgttcattcatgtatgcatttattccacgactatgatgtgaaagtacaaaatattaggtatgctactgtgctaggtgccagtaagttttattcttggtaaactataggtgtatacagcatcctagtagttcttcaatgagtatttactgagaggaagaactgttcattatatatgtatatatatatatgtatatagtagtgcctaatttattgtgttataccaatagtagatggtagtagtaattagtatttatattattaaatataaaaattatattttatgtattataagaatataataattctcatgagttgttaatctatttttataattttaaaatatataactgggagtactcttctggtttttgagggtctaggattcaataacttctgtttcagagatgaataaatatagatgaatagtggttatgatatagacgatgccccagaaactgaaatggagaatttcattccagtcctatttgtagcccaaactctatgtacaaactacatgggaaaagctgacatgtaacttgagtcagctccacgttaaacacacattgagtacctgccataggcattagcaaggctcatcattgtattgctggtgagatcatgtacaaaaataattttgcaaattgaaaaatacacataaatataaaagaattttttaaattgtttgtgctgcttccttaactcagggaagcctacaaggtgccaagttctgtggtaagtgcttcttaaaatgttacttaatccttctcacaactgctctgaaaagcaaggtcagagctcctggttgctggtggttcaaaaagggttcatttctgtctgctgagagggctctgcgatctgtgagttcgtggtggccaaacatagggagacttccaagtgaaaccctcgttgatgacatagtgaaactgtgagtttattgaagtgggaatacaccccctcctaacttaccccacacagaaacagatctgtgcaaacatgcttgtcctttttaggatgatacaataacttttgagataatggaagatactctggaatcttggaagtcagtgagaggaactactggcatagtagttcttgactaacagaaaggcaggagttctcacagactagggttagctgagagacagtgatttggccatctccaacctatgcaattactcaggggccaaaggaaagacaagcccagtttaataaaacccaacagcagggatgtagagaatcaataaatgttggttgatgtccacagggcagcttggaagcaactggaagaccttttacagctggttatttttgaacaacaatctaagatgtataaaagcagaaataaaaataactgaagaaaggagccctgacttgctgccttgaaatcatgagtgtgctgtggttgatttgtagctttttgcagtatggtcaagatgacccctgattcaatacctccttttcctaccacctgcctcccctgggtgggggaggggaaaaccgtgctaaaatattctatagaaccagtactctaagaagcagcctctatagcaaccaagcaggtaggaggtagctgctgtagtttctatcttttacctttttcctccaaatatccagatttctaaggggtgagaaaacacaaacaccaaaaacatcattggaattttggattaaagacaagacagctatctgtcttgtctcatttttgatacaccagctgataattgggctatatctgagtctaaaaataacacatagtacattaaaataatattccttggctacaattccaaagtggtattctgggatttctgtgcattaatcctgtaacaataacaggatttgggcttttaactcccctggtgtagctttgaaaatctagcctaaagcagctaatgttgccgtttaaatcatcctctcactatccttagggaaatgtggagattaaaaaaatgacagcccaactgctcaaatgacctatacctgggagaataagagaaacaacctatttcctctcaggaactgggccgatcaatataaatatttcaaaaggaccatcatgcaataaaggccttggaatttgtatcctacatcagagcaccctagatatttccaacatagacctatcaggttttccacaagggagggagacattgtaacagttgaataactggaactgaactgggttgcacgtgtgtgagcctctgtgtgtgtgtgtgtgtgtgtttgtgtgtttaggaaaggaagggaaaggaggccattattattgtgtatgtttctggtaaacattctttttttcccctactgaaacttgggcgtatcccagaaattaggtgctgttaatcgtgtcagctaaaaaaaaaaaaaaaaaaaaaaaaaaagcatgttctaaaatatgcacacagttctaaattgaagctctaaatagctttaaattgaagtggcaggagtttttcaatgataccattaattgcatttcattaattgggaaaaagagcttttgtgtagctgtggttatgatgggctggatttaatcagtgtaggtaccactaacaggctggcactgctttcggcctgcaatgcctttgaaattctaaaatggaaaaggaggccaacacactgagcaattatttcagaacagattgcccgttaacatttcataatatcaccgaaatacatcctttctgggacagagacttgctttggctatgaacatccaagaggtggcagcaccccatgctccgttggctttctgcatccctccagatgagagctcaccgcagaggtctcatcattgcgtcacctgaaagccagttaggagggcggaggtgggggggaggtgatggagggaagaggtagcgttttgtatttcagttcttctggaagagttcaggaaacagctgcatggattgttttaaatggacttgaaaaggtttttcttttcttttcctccctgaaatctactgccctgtgcagtatctctctatgaagaccacatgagtgcacttacgtgttctctgattcactccctgagggaggaaggaagagtttcaattgcctgggatcccctgagacctcattttcaattctctgcacttgtcttttataaacacaggaaggtgggatgaagacggcattattgacaattattttttgagcatgtatgtgggcagggcactgaccacatcatcaagaatgtgacacagtcggctgctaggataattctcttcttccctaactgttcctccaggtcccccatacacatagaaatctcatgctaaaaatattttacacaacaaatagctgttgagatcgcatcaaaccctgaacaataaggagcaatataaccttacgtgctaggtgtcatgtgcctgatatgagaagcatctggtgacatgggtgaaggagtgtcagggctggtctagcctggccactgtccaactatctgtggaaactggccctcgtcatgctaggaagtgtgagggcaagagctggaatacactgaggcagccttgctgttgggggttattggcagctgttgggggttagagacaggactctcatgggtaagtagtgtgcaaaatgccacaggaggctggagctgggctcagcaacagtctagggtccagcacagctcagctgtgggcctatccccatcctatccagcacagggacttggcctctgtgtacaccactacggctgcttggcctcaccttcaactctgtgtaccttttccttaactcatttcttcagcttagtcttgaccttgacaccctcataccctctgtcccatagctttcctacatggcacctgctctctgggtacatctttttagcttctggtcccactaacaattcagagactattttccctgtatttcctggttaattttgagggaagtgtggagggggaagggaaggaggaagggaagagagactcattggctgagttaattgcattcttcctgtctggacagagctttggaggccaggccatctcccaggggatgagttaggctctgcttggccacctttgagtcacttttagacctgtgcagggctgtcccccagcctgggctatgggcatggttgttcccttcaggaggaccgtggatgtggtagacaccaaatttgacatattgtccctttccccatacaaaggaaggctcaacgatgctggatatcctgctgtcagggtactaccctggtgagttgctcagactctaggaagagagaaaggaacctcttttcttctttacaagaaagcagtcatgaagcttggagaatacacataagagtgataatttacactcaatcttcaatgattccagaaacttggggaaagaggtacagatccttcatttgaaccatgatgccatgtattttgcatagcgcagcttggtttggactaggctgagggaggggagtggctgagttagataccagtctccttgttatagtcaagtcttccttaataaggtctcaagcttgcattttaatccaaagacagattctcgagtgctacctcttggtgctacttctaggcgccatgacatattcagcaatgagctcctcacctgttgcccagtgcattggcagcatccctggttgatgcagccaagccatctggagcagggcaaggggggcacacggggtatgaaagccagatagctgccagatgctgcagtttcttggctgtggccttggccttcctctagtcctttcactattatgctgagggcatgtggcaaaacaaggcaggccccacgggcagcttatttgcttttggctacttccagttgagccaccaagaacttgaggagctttttcttcttcagctatttttcttgagagcctgaacatcccctccatctcttccacttgtagcgcttgtagtcagcctcagccataagccactgacaagagtgtattaactgcagatgtgaggatgaagcaagggcaaactatggttagttttcagaggtgactgagccccttcaacatatagatagggatttccatatatggtgaattttgtcactaagtgcttggctttgtggcatcctatttaccagtatttgaagcttttatttaacagttttattatgtggttctctctggtgttgagtttgagctcactaattagatcattaagttccttgaaagaaagacagggcttctatactcctaagcatttcctgcaatgtgtaacacagcactgtcattgtacaaggaattggcactcaatgggtgtttgttaaattgatttgacccaatctcaatttcatgttcagctcaggagatttcttattaagttctaaggagtttagatcctttctggtcatctatacctgaaggtataaattcattttgaccaattttccaactttaattttctcttgtgcacttcaggaagaacagcaccccagacatgactttttcagggacttggaattccagatttcccctgggattcaaggcatctgggagtttgacttcctattttttacttttcatctctgtcctcttgaagttaagcatggtgatgtgacttactttggctaatgaaatatcagatgtaatgtgtgttagcctcctctgccaaattaatctcctttcctagaaggataggtgaagttatgcagtggtaacaacagcttccaaaacttagtcgagattctgtttgacagagtgactcagggacccaattgacagacagtctgtcatctcagtgtgtgctgccgggatcactgtggcaggggaagctggcatggataatcgttcaccaactcttagctaactcttccaccctgaagtgacacacattacaacagatagttcattcaagaggatggagaagtgcagtcctttcctggctctggaaagaaccaagagccaaaaatacttgtgacctctgtagaactgaccacacctcctcagagagcccagaagttgctgtgtttcagttcattctttaataaggcatgggacgacccttgggaataatataaatactttatcctttgaggttcacaggagttaagaaacaaacccgtattaaagatgatttatgtattaataattaaagattagatttttaaatattatgtaaatatcaggttattttccaccaaatcagtgatcagcagtactcagttgtagcactctctaaatgccatagaaacagatggctgatggaagtgattggacgtgtttagagttgccagcccttttcatgcttctgatgcttcttacacctcacagtcactcaaaggcccagcagctcagagcccttctccatcatcagagtcacttcagactcctgggctctggggatctgatctttattccctgccctgtgattgactctgtcagtcacaaagcaagactccaggttcttcaaaagcaaacagggagtcatcctgcctcacttagtggtcctgtgttccacactcactcgataacttccctccttccaaagatacaattctaggccaggctcagtggttcatgactgtaatcccagccagggcaggggaggcacttgaggtcaggaatttgagaccagcctggcccacgtggtgatacccgtctctactaaaaatataaaaattagccaggcatggtggtgcacgtctgtggtcccagctacttgggaggctgaggtgcgagaatcgcttgaacccaggaggtggtgtttgcagtgagccaagatcgtgccactgggcgacagagtaagactctctcaaaaacaaacaaacacaaaaccaaaaacaaagatacaattctaaccataagaaccaggagtttattcacaagtgtaatgagtttagtagtcaatgctcttttagcccaagtcaatggactattattccaacatgccaagtaagagccaaccatgatatgattgaaagagcttttgcattagaatctaaagactggttcaactcccggctctgccatgttctagctgtgttacctaggaaaaatcacttggcctctctaaaccttcactggtaaaattaggataattacacttaccttctaggatggagtttcctactgataaaatgtaaattataatgcctacctcttgggatcatgggaatttaaattattttgacaaagataatttatgggaaaaatatatatgtataagtatgtatatcccaagctgggaacttcttccctccttttttgcttgctaattaagagtcataaataaaatgctgatgagctgcagtctgccgtctgtgctgtagctggagggctgttttgacttagcctgacaaatggctaaccagccgctcccactatgcccaactcaagtgttcagcactgagaaatccagctactgccaacagcatcttataaacttgtcactatttacttacttggtgacagtgtttttgttcagtgatcatccctgagattttactcgtcagggtgtgtctgtttctctcaaaatgccaaaatgccaaaatgccatttaaatataatcctttctcaaaccacatgaaaatagtgaaggtctctaaatgagactttgatgcccttatagttcatccccattgcagtgcagttggggtgggatgttgtctttacaaagcagtagctgcatgtgcacagggctttattaaatggacacaaacttcagagctacttcaataagctactagtcaggatttccaggtaacctgttgagtggtgtgctagagacagctcatacaagcttggaagaactgattgttacattttcaggaattttgcaaggtggttgaaatcatgttggtagactgaaattggccatggtgagagtgtttacaccatggaaattagcaaacactacaaaatcaggcagtttctcccagagggctggttgctaaacatttaccagctcaccaatctttgagcacctgggtaaaacacagatgtgactgagaatgggagaaggggcatcccaaatcggaagtataaataaaaccatgatgcaggactcacttctctcgagtccctgctgtgtgctaagttctatgctagcctagattgagactgacatatatcaggaggtacctagcaaattagcgatgtggggcctaccaaaaatgtattcatatgaaggacagagagcctgctaggagcttgactgcaagctggtcatgggagagagggaataatgctagatgtaacatggtacttgtcactcaggtttcaagccaggccctagctgagatttgtagagggtgggttggggaaagctttaagtaaaaacagaaaaggctgctttgggaacactctgtaggacaagatggcattgtttggatttgacatcttgtttgttccaggacctcagctgcagtagttttgggacagcagaggcttggctgacccacacagtgcagtggggtgggctcccttgcaagctcttttgcaagagcactttgtggaggaccacagtgtgaacaaagagggggaaagggacagtagaatttattttgatgaccccatatgtactggtaaggcaaaggggaagctggttgcatatacattttctcaacttatcctcacaacacccttatgaaaaaggcattatcatatcctctttgtaggtgaagaaactgaggcttggagggtccgaataacttgcccaatatcacagaaagtaagtagcagagctgggattcacacatgaggctgactgcaaacccttcttggggcctctgtgaccaccctgaattcatgtctgcatattcatttattttcttctaatttggggggaagaagtctctctcttctttccaaggtcaacctttccactcctgcccataaatcctgtaccttcctaattcctgctccagagtctttgtaaagcaccgcattgctctgttgtgcatctttagcctttcttctgtcagtttattcattaatctttgccatcttttaacagaaatgagtgactgtgtggggactttcttagccttctctcttagcctctgtgttgtactgaacacagaacacattctcctttattcttgaaactctctacttcccatcttctgtgattggtttttctcttccctctcaggtttttcttctgatcacttctggctcttctccctttcccaacccatgaaatagaagcattactccaagagtctagtgttggctctcttcttcttgtggtccccatgacctcagcactctatgcagacaaatatatgaatatatctacagctctagttaggaaatgggcagaagtaactcaaccatgtccccaggaccaagagcagtctctggcatgtagtgggtactcagtaaatagtagggatttcagatgaagagaacattgtgaacagaggctgtgcatgtatgtattgatttatttggaggatacccctttcaggctgctgaactcctcaaactcaggaactgtgctttttcctcatttttaatttcctgatccagcataatacatagtagctgttcaatacatgtttgctgaatgaatgagtgagtccaaggtcgatgataaattgatgcaaaactgtggcagtccttatataggaatttaggctttactgtatgtgcagtaggcttgcagccatgcaaggctttttctcatttgagtaactcaattgaagctgagctccaggatgactcatgtggctgccgtcagcattgaaaccttgtgccgtcttcctcccttgcccttgctgttccatctctaatcagtagcccaatcttgttgattttacttccacgtgtggctttatggcttgtatttgtgtttttgtttctattctcatggccacctcccaaggtcagctctaattacctcttgtctggatgtcagcataggtcactccccactctggttgctgttgatcccttttctgtaagccacggccttggctatgctactgatgactggctctgtttgaaaaaaagaaaacagaacaaagcagaattggttctgggaaagcaaggataaagagggctaaagtaacactccattatctgcctttaatcccacaggcccttaaagctgttgcctgctttgggttttacccttgagttgcttgagtgggcttatcccctcattgctccttataacaaagagtaggatccattctcacaataaagttaaattgtagggaaagaaagcggaccaatgggaagcttgtgcttgactatgttgttgaaaagaggcaaaggaaatggaagaacaatcctttagagaagggagaacaagagaagggaaaatgtaaaagaggagataggagaaggccattaagataataattctagagggaaggaagaaaaaaaggagagaagaccagagctgagctcctgccatttttcatagctaattatgattaaatgggccgtttctgaaaatgctcaataaatgtgcactattaccttaaggttttgctctattgctatgcaatgcatgggcattgcatgaactttatcagtccagaattttacctaataaaacagtgagctaatggactttagggggcctctctggggactcttgagcttaagcgatttaggtcagtgttatgcaaagtgtgatttgcctcctgcaaggaggtaagtacagaaatccacagtctgtatttagaaactttatagcattgcacattgctacaatgatgtgcaggaggtgggtggtaccagtcaagagagccagagccagagagatcgtgggcatttcttcccatttttgcagctcagtaacttcactgtggtagcttgaaatcagccataatgggaggtatttttatcatgcaaattgacaaatgctacaaatcaggactcctcccacccttaagaaccgggtactaaacatttgcggcacgccactgcttggctgagaagtccaagcatctgatgaggaaatactatggaacggcatgttgttccactttcttggtgagttacttgtgactggagctgcctacccagacgtgcatggtaggatcacctatctgtcactaaaggaatagaggaaattggtccttcaccatagggagtttgaaatgcactgccctagatcaccttcagcttgttctgagatccaacagagtatttcaacagaggtcttcatgataaccaaatgtaatagcccactggtttagaaacctcctactccagattttgagtcctataagacagttaggatcaagggtagctgtggcagacccagctggggcagagaagccaaatgtgaaatagcagaaggtatgtgtattagtctgttaggactgccatgaaaaataccaaagaattggtggcataaacaacagaaattttttttttttcacagctctggaggctgtaagtccaagatcaaggtgttggcagacttagtttctcttgaggccactcttcttgccctgcagatggccgccttcttgctgtgtcctcacatggtcttttctctatttgcatgcaaatagagaaaccctggtgtctcttcctcttcttacaaggacaccaatcctataggattagggccccacctttattacctcatttaactacaatgatcccttaaaggctctatcttgaaatacagtcaccttgggggttgggactttatacaaaatttgggaggacacaacccagtctgtgtcagtgtgtcactgtgctttacctgtcggggctcactctgcattccaatcaagcatggtatagtgggtcacaagactggagccaaggaggcttgacctgactcccaggtctaccttcccattggctgtgtggctttgggcaccctaatctttcttatcctgcattattcatctgtaagatgaatataatacaagagcttccctcacagtgtagttatgaagatcaagtgaagtcatggaggtaagcttttagcacagtgtctggcccatgataggtgcttaataaatgtatacttttaatttatggttttgctctattgctgtgcatttcatatacagtatatttttaggtctcagaggaggcctaggtgtggagagctgatgcaaagagtcttgtatctcatttttagatccccagtctatcgtcctcatctccaatatcatgggtaagaaaaggccaaggtttttctgacaccccctgttttacacattcactctgaacttgctaaggccgactttgagtggagagccatgatttcctgaagatcaataatgccaaagaatccaaaggcatcacttgttaaccaatttcccagtggcctggcctgcagtggggtgagaggcatcagaaaacacacaggaactgagaatcaatgcactgggaagaaaaccagctccctcaaaggggctaattttcccagtgtgtaaataaattatgtaaacaaatatctgatcatatttataacctctacttctgaaagatccacctaggtgaatttatttgacttttacccactagaagaagtttgtttaaacaatattatcaagaaaaatcatgtagtcaaattgttagactttaaagtcaaaatgggcaattttatacatgaggaaactgatatgttttaaaaaaaatctcctggtgtattaatttgaagacgacaagcttttaattaaaaacacaaaaataagattcttagatgaaaaataaagtatattatacctggttcaatattcttttggataattcaaattttggtgatcagaaaaaagatgcataggcttttgctgcataagatcttgccaagatgcttttactgcctggcattgattttccctctcacccactccaggcattctcacttctgttggatgccccttccactttctagcaatctccaacctcatcaagggctatccctcctccagttccccctggagtcccatctctgttcttgtcttccctgactactcctgcttgaaaagaaatcttcctcacctgaatcactctagcacttttactctgtattgttaatttgccaattaatcacatccacctttgcaatgcctttcatgatatgaccttgaattgcatggttttagggcttgtctatctttttaagctgcaggtaccctgagaaagggacctcatcttactctttgacactcctcccccgtttagtgataattagctgtgtgccttttatagagtaggaagtcaatgaatatcacagagttatctgctttttcctgaaatggttaagatcattttatgttaataagtgtgtgtctagtcaaacttacagcagtaagcactgaggctttttcttttttaattgtagatatcaagctggaattctctagtaaatgctcctggaatgtaatctgggggtgccattgttccagtgagttacagtaatttttaaatctaactctggtgtaaaagagacctgggttgagttctagttttcttggttaccagctgtctgaccttgggtaaattactacctctctgtgatggttaattttaggtgtcagctaggttaagggattcccagacagttggtaaagcattatttctgggagagattgacatttgagtcagtggactgagaaaggaagatctgctctcacccagtgtgggtgggctccgtcaaatcagctgagggcctggagagaaccaaaaggcagggaaaaggcgaatttgctctctcttctggagcttctcctgccttgtacatgaggacttcagggtctctggccttcagactctgggacgtttgaaccagcagcccccaggttctcaggcctttggcctctgaccaagagttacatcattgtcttcactgattctgaggccttggaacttggactgagctataccactgactcctctgttctccagcttgcagactacctgtcatggggcttctcagcctccataatcacatgagccagtttccgtaataaccctgctcttgtctgtctgtctatctatctatctatctatctatctatctatctatccatccatccattctattggttctgtttctctggagaactttgactaatatactctctaaagcccagtatcttcctctgttaagtgtgagtaataataacaccttatctcataaggtggtggcagaggagtaaaatagaaatagtagcactcaatgaatattagatttttatcattaatattattgtgacatacagaggtcaaaaagtagaaaccttacccatggctatcagtctccattcgtctgaaccaagggtaaagagtaagaccggtggccgggtgcgattgctcatgcctgtaatcccagaactttgggaggccgaggcgggcagatcacgaggtcaagagattgagatcatcctggccagcatggtgaaaccccgtctctactaaaaatacaaaaaaaaaaaaaaaaaatagctgggcatggtagtgtgtgcctgtagttccagctactctagagggtgaggcagtagaattgcttgaacctgggaggtggaggttgcagtgagctgggatcgtgccactgcactctagcctggcgacagggcgagactctgtctcaaaaaaaaaaaagtaagactggcacaccagtggcgaattggccatgcaggagctgggtctttacttccctgtgcccagtgctgctggataaggaatataatatttcctgtgcagaattcagaaggagcactttcctatctaggaagaggtgacttgtgaaccacctttggcctcatgttgtcatcacctccccaattcccacttccctttgtaaagcataaaacattttaatacctacaagacactatattttgtgttgttactctggagttgggcaggttgcactgccagtacaatcatattcattaaagataagtcagcaggacatttggcctggaatgaatgatgaaaccaagtcaaaccatattcaatgttttctcagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtatactacaatattaaagcttatttatacacactgtaaagtttcccctgagtgtcctggcaggcacttgcatggctgggcagtatccgtggactgattcctttgtgaattacatggagctgacagggctgaaacccacagctgactcggaggaggatggaagcttgtgctgggcaaggggctgaagcccctctgtgtaagtcatattaatctcctctgagcagagtgctacaaaattactaaagctgcttcttgaagacacttctaatgcagtacctaatgaaaatgtcaggtgcgacaagttattagttgctgcactgctgttctgaagtcccaggtatttctctacctgttatccatgaatgtgagttttgtggggaaggcagtcacaggctgaggaaagcatcagcagtcatgtgtgctgtcaggcctgtaaagtgagtgaggacaatgaagctggttgaagtgccccaggaaatggccagacttccatagtggaggtgaggtgaagaattgagtccgggcaaaggtgtgtggggagaagaagctgcctggtgtacgatgctgagtaatgatacaacccaaatcatctgactctgcagatttgaaagttgccgttattattaagaattcagatgggaaaagaaatatggtttgggttatttccatagtcattccagaaatccaggctcagtttggcatttattgacataactgtttatattggatctgtgtagaagtttgtatctttctgacttgcatgatacttcagcctttccttggagtctctgtggcttctcttcctcctttgctcacctccagtcattgtcaaatggctttgtgcaagttactctttctcggcctccatttttttggatcctgcctttgccgccctccttgcctgtactctgtccagtccaggccctctggacctcttgcctggacctccaagctctccctcctcccatctcttccctttcaaccttcctacccagagcacagcagtagtaacagctaacaccatttaataggtatcctttctatgccaggccctggggttgctatgtcacatatattatttgtaatgtttgcaataaccctggaaatggtattattacctccattgtacagtttggaaggcaccaaaaaaggcacatgggcccacattcatgcaagctaatgaggggcaaaactggaatgagaacccagggccactgggtccctcagcttatgctgttccctaaccatactgcttcctccactcagaatcctttagtggctcccattgcctaatagatcaagtctgggctccttatcttggcttctgggtcctctaaaatgtagtctgctaggtttccaggctttcctctccacccctcacacatcctactctttagccaaaaaaacagacaaaaaccctaaaaacaaaaaaatccatttttttatttatacccgtgctttctttcctaagtgcttttatatgtgctatttctcctgccaggagcagagactgtcatgctttcctctgtataagtaagtgttgcccaagaaaacattgaacagaggtgggctagagatccatttattttctggttcacaaagggcatattggatctttattaaatagtctaaaatgtcctttcaataatgtttttctttaatatctttttaaaagacatttaaagtgaatcagaaagcaattaaatgattaattgctgtggctgaattctgctgccctcagcctctgtggatgctatctcaccgattaacctccatttctaagctctgtctgattgagggaagcaatgacagaaaacgcttggcctgtcacatgactgatccttgctgtcatgagccatcgttttctaactgcaagctttcattttcaaagccctggcatgatttcaggagctgtaaaccctcatgtgagtaagtgagcagtaagaactggcagtttttcaatcttaagtctctccagctttaaacccacatttagctgtgattctttttttctccttaagttggacatttttttagtgaatacttttttgataaataaagtggggtgaaggtgaacttgactgagacagatatgggttggtccgtttagggctgaccctggaaaaaaaaagttatatcagtcttgacattaattccgtagtcagagtaggtgagagaggagtagattagtatatagggttcccagccttcccagtacaaccatggactcagagttggggacactaaaaatgtacatgaagtttatgatttcactggtagagatggcccacaatgccagtttggacaggcattactctaaacgtggtggggaagtcaggagacatctactccaaggcataacctctaggacagtttgtggggtatcagggaaggatatatcattggaaagatttctagttgccatacacaaataattgggcttcagtttaatgcataattaactgttctcagtgtgttattagttggacaattggattattacattatttacattagtgtttataggtaatctgaaaacaaaaatgtgaatataatatgaactacctcaaagatttgtctctgcttaatagttttatttcaaatttgtatatcaaatgtttcattacccttttttcattttattttttagctttcaaaacaaattagcaagaggaggaaagaggagagggagaaactgtgcacaccaccagaatgttatagtaggcgatatcatgaaagcaatgttggaactttatactcaggttttgattgtgcatctatctctttgttgtcttatcctttatcttcatttttaccaagtaattattgaccatcaaatgccattatggtaccaacttaagaaatggatgtaaagaattctacagggaaaaaaagcacattgtcagtgtatgaaatttatttagaagacagttacagacacatataaaaatgatagcagcttatgtttgcgaagcactcactatatgccaagcactttctgttagctaataataatatttgctcatttaatattagctcacataataatattaatattattagctcatttaatcctctcaacaactgtctagggtaggtactattatccctattttatggacaaggaaattaagtcaacaagagatgaaataatttgtttacagtcacatagctaggaagtggtagagtcataagttgaacccaggcagtctgaatccagaataataataataaaaaaaggtataaccagggtggaaacttattttgctcttttcaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggtaggtgtggcaatatctcccattctgtgcttacctgggcctcgactggtaccagcagacagggatgggcagtcagttaaggagtgtggctagcgactgttgtgtcatgcattgcactggttttctgctcctcaggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggccaccagacagatttgggatttcagaacttttcagatgttagaaaggtaaatggtatatattgcatatgtagtatttccagtagagtctgggtcagcacctcataagcaaatgtattaatattttgaccacaacatatatgcatcgtcatcctcaggtcagtagtgactatgtagaacctcatgtcaaaaaggtcagattttttgccacctatggagtttttatgtcaaatatgtgaaaaacttttggttgcagggcttttgggattttggaactgaggataaggtattgtggaccatatcattaccagttccttcctctttcatcaagggcatgagcatgaagatgctgacaaagctgttcctacacttcctgtgctggctgggaagggatctgattcgggctgagccttaagaatcacagttccaagctttcttctcattccagattttagtcgggaaagtaggcattctggaagtagagtccgtatctatactttatatgttccccttaggtttgatgagcaaaaagtaataaaggaaacacaaactcaggaaagaaaagatttttctaggaaagatctatttacactacttaggcctctacccttcttcccttgggagtttcttagcttagcttggaagatcacagattaaagtacaatatagcaagtattattaaaaacaacctgtaaaactgcattatcccaaagatttagcagctaattttctgttgcctttagttctcacatcattttttttttcagggtataaccttctttaaattttatgccctgctctcaaattccttctgggtttaatgactaatctctttatttgtgtttaccctggtgaagcctgtagaaagaaaatcataaattaatggcatatatttgcagctataaacgggacagattcagaaatatacaaacatgcctagtaaccaatttcctgaaattgcaatgctcaactcccaattaaccttagaatttacaagtctaatcaaatggcccagtccatttccattgaaaagctgtgcactgtgtataatctttcacttgacctaaatctgtagtagactttgggaaataaactcctttgtggagccagttgttctattggatgaagtcaatgtccctttttaggaacttgagctaccactttatgtactctaagacacagtttgcaaaggaccagtctgccataccccatgcaggaggaggactgtgttggctcccaccacagggtgtgttctgtggtaatggaaggctgtgctgagtcacttacactgtgtccctgggtcttccttaaggacagtgtatggttttagaagataatagtagcaaacatttatctaccacctctctagatcagctaggcattcttttttttttttttttgacatagagtctcactctgccggccaggctcgagtgcagtggcatgatgaacttagctcactgcagcctctgtctcccgggctcaagcaattctcctgccttagcttcccgagtagctgggattacaggcgtgtgccaccatgcctggctaatttttgtattttaatagagacggggtttcaccatgttggccaggctaatctcaaacatctgacctcaggtaatctgcccacctcggcctcccaaagtcctgggattacaggtgtgagccactgtgcctggccgggtattcttctaagccctttctgctgtgagctcatttaatcttcttaacaaacaaaggggcaggaaccattataatcactgttcaagagatgagaaaactcaggcacagagaggttaagtaaattgtccaatcagcctcagctagtgactgggggagtggggctttgaacctgacagtctttcctaggatctatccacataaccatgaagtcacattggtttctgggatattgcatagcctatggcaaaacctgaatggtgtggagcttgccacacgggcttcattagaacgtaccctatcccggttgcagtgagcggagatcacgccactgcactccagcctgggcaacaagagagaaactccgtctcaaaaaaaaaaaaaaaaaaaaaaaagtaccctcccccagggcttttcaaaccttggggctctgcagaatccctgagggtcatgggaacaagaggcaaaggaggctctggacttctacgcccacatcagccagaaccagtcagcgttttaaatgttacttgctagcactaagagtttatctgagtagggggctctgcagctcacaagaagcttaagaactatagctctaaacaatcaagccagttaactcatacaggggtcataccagttgcaaagggaaatgagatgtagaaaccctgaccccagtgctgtgtgttgctgtcatactctttcttactatagtcagtgtcatagttgtgaagtcagtgtgcattttggtgatgacatttcagggcaaaccagaggctactgcctaggtgccacacggtggtgaccagatcaggtgctttcacagtagaagatgaaaaagcccagccaatgtctagggaggggtaggagagatgaggcaaaaatgctcaacatggtaggaaaggcatgagattaaaaaaagtggtgaacagagccaagggcaggtgctgaaatgagggtccatactctgtgaattagattgttgaaagtagggctgggagcagcagaagagaaacagattgaagatggcaagatgagaaagacaggatggaaacttcccaaggaaattgtagaccacagaggaccccaggaaagagactcttgggtgaagagaaataaaaagctaggcggtaatttttttgttaaagtttatgagattggtatatcagagtaaaacaaaggattaccacaaagcattttaccaagtacctcaccaagttttgaatcaccttgattaggtggtttcaaaactggctaagtgaactttatccaaagctgctgcctactgggagacagaccatcttggagggcaggtatggctctgaactcttcagccttattttgtaaagcaaatgctctggggctggcacagtggctcatgcctgtaatcccagtgctttggaaagccaaggtgggaggattgcttgagcccacgaatttaaggtcagcctcgacaacatggggagacccccatctctacaaaaaatttaaaaaattagtcagacctaggggcgtacacgtgtagtcccagctactcgggaggctgaagtgggaggatctctgagtccaggagtttgaggctgcaatgagctgtgattgtgccattgcactccagcctgggcgatagagtgagaccctgtttctctcaaaataaataaataaatgcaaatgctctgacaaggctctgacactatatgttactaaagaatgatgttctctgatttgtcctgtgtgtgtctatttcctcattgtttatagttgttaatatgggatttctggatgagcctagagggcccatgaatcctctgagattattatactaggaatatctacttacttttctgtctctcttgctagaataggagcaacttgaggaagtgaaacaagtcagaactgaccaaagaaaagtagtgtacatattgatccatggttgagctataattgattcgtgcaatacttattgagtatctcaaacatgcttgcggttgagaactaggcacacaggaagagggatatgaagaaattaacaaacagcaaaataagaattattgttgtaatgtgctttgatagaggaagcacacatgaaaggcacctgctgtagcctgaagaatgagagttttctttctgaagaggaaacatcagctgcttttggaaagacacatgagagttgggcatcctgtaggaggcaaggagagggggttccaggacagagatgagaaatagcatggtgtatgtgctaaaatgcaagttgtttgggatggggatggtgaagggcacctgtgagggccgaggtagacaggtccaggtggaacaggcttctataccatattaagaatttagatttttatccccaaattagatgttaatggccccaaagccactggggccattaaaagattgaaagtagagagtggcatgatggaatttctattttggaacaattatgctggcaacagtgtgaaagatgcaataggaaggggcaagatcatggaccagggaacattgtagaaggccactacagtaactggggtgaaagactgtgttgccgagtgggtgctgtcactctgtgtagcttctattaccacagggacggtcagcggggagcgggatcgtcttagaccatgagggaggatgaggtgctgagagctggaagaatgaagagaaaagtggcctgatgaggaggtggaggtgtgagaagtgacaaagagtctgtgaggagaatgaggaagggcaacccgagaaatcaagaaaaatcaggagacaaatctcctagaagccaagaagatggtggtaaactaataagtgatgagagcagtgaaggaaaaaaagaactaggagggctgggcgcggtggctcacacctgtaatcccagcactttgggaggccgaggagggcggatcacgaggtcagaagatcgagacaatcctggctaacatggtgaaaccccgtctctactaaaaatacaaaaaattagccgggcgtggtggcatgtgtctgtagtcctagctactcaggaggctgaggcaggagaatggcgtgaacctgggaggcggagcatgcagtgagctgagatcgcgccactgcactccagcctgggtgagagcaagactccatttcaaaaaaaaagaacctggagtgtgtttatattgctggcaaaaagagtttgctttcaattgccttgttagcacacctgtgatctgactaagttacatcagtgggaggcacaggatgaaaggatgccggcctctgagaccaacttcagttctttgagtgtttgagaaacacttcaagtcttagccaatggctttggtcaacaatgggtgcctcatgttgaggatgaccccctgagggctttcactgcagagacaagccgacttgttcaaatccattctcaaatggtaaaacacaggcaaaggtacaacatgcagaactactgcaccatgatcaaaacatgtactctgtcacatctaatgacttcaggccctccttgaacttttgagttagcaaaaaagggcaaataaatatgaaacttgcctttcagttctccttatgtgttttttaattgtttcctccttggttcctctgcaacagccctgtggtctctgtctgcatgttcagtgccatgtggggtgacccacacttgtctcagcatcttcaggggagttgagaacagctggcccagccttctgtacttgtcaggcatatggtgggggagacatagccctggcactccaacctcttccctgatttaaagtgtcaaagcattttggaattcaggtctcggtgttaaaaactctccatgaactctgataggcttcagtggtagtcactaccttaggatgctgacgaggaacaactgctatcctgcccatggtgacgaccttcgaaaagcccatgaacagaactattttgaatcatgagtaggaagattagggaaaggccgggcgcagtggctcatgactataatcccagcactttgggaggccgaggcaggcagatcacgaggtcaggagattgagaccatcctggctaacacggtgaaaccccatccctactaaaaatacaaaaaattagccgggtgtggtggtgggtgcctgtagtcccagttactcaggaggctgaggcaggagaatggcatgaacccgggaggtggagcttgcagtgagcagagattgtgccactgcactctagcctgggtgacagagtgagactctgtctcaaaaaaaaaaaaaaaaaaagaagattaaggaaaaactaatctctgctatttgcttattctctgtcagagacacaagaatttgtatgcatcttttcaccctctcccccatcttcttgcagctatttaaagtattttacaaaggagacattccaaaaaggagctgtgactaaaaggtatccataaaattcagatgtcttttggtacagccattacagaaaacagtatggaggtttctaaagaaattaaaaatagaactaccatatgatccagcaattcctcttctgggtatatacccaaaggagataaaatcaccacctcgtaaagatatctgtactctcatgttcattgcagcattattcacagtagccaaaatgtggaaacaacccaaacacccaacgatggatgaaaggataaaggaattacagtgtatatacatatatatacacacacacaccacagacgtaccacaatataaatttatatataccataaaagaagcatatatatatacaccataatataaactttagtatgtgtgtaaataagtaatattgcattgtgtgtatgtatatgtctttatgtatacaatggaatattatttattgttgaaatattattcagtctttaaaaagaggtcctgccatttgccacaatacggttaaagcttgagggcattatgctaagtaaaataagccagacacagaaggaaaaatattgcatgttctcttttatgcgtggaataaaaaaaagagaagctcaagctcaaatacacagagatagagaatgaaacagcaattaccatgggtgaggggtggggagaatggagagatacaggtcaaaggatacaaaatagcagatacataggatgaacaagtctagagatcatgtggtacatgagaactatagttaataaaattgtattagggatttttgttaaataagtagattttagctgctcttgtcacacatacgcaaagtaactaagtgagatgatagatatgtattggtttcactatagtaacaattttactatctatatgtgtcccataatatatctgaagcctcaaatatacataatgaaatttattagaaaagaaaaaacacattcagagtttttttgtttgtttttttttgctgtaaagttcagggggctctcctggcattgacaaagacctaaataacaaatgttttcgcctcacttcctgtcattgctgtaaaggaaacagtcccagcatcagagcaacctttcttagtgttctctgaagggtcatttgtcagttgagagtaaggcacatgcttgaagaagtttcaagtaattctcgtttgcactacttatctttagtcaatctggggattaaccgaagattagagataggcctaccctggctgagctcccagctggtggatgccagccatgtacatgaaccaccttagagaggcgtccttaggcccaggagagtcaccccagctgatggtcaatgacacaggagcagagatgacaggtccctgctgagccttgcttaaattgcagatttctgaataaaataaatggttgttatttttagataaaaattttaattgacaaataatatttagggagcacaactgtaatgttttggtatgtgtatacattatagattaaatcaagctaattaacatatctatcatctcacatacttttttttggtggtatgggcatttaaaatctattctcttagcaattttcaagaatacaatacattattattagctatagtggtcatgctgcacaatagacctccagaacttattccttctgtataactgatactttgtaccctttgactggcagctccatttcccctctctccaccccctgcctctggtaaccaccattctgctcttctatttctatgagtttgatttttttagattccacacatacatgacatcatgcagcatttgtctttctgtgcctggcttatttcatctagcattgtgtcctctggtttcatccatgttgctgcaaatgacaggatttccttctttttaaaggctgaatagtatttcgttgtgtctatgtaccacattttctttatctgttcatctattgatggacatttaggttgattccataacttggttattgtgaatagtgccgtgatgaacatgggagtgcaggtatctctttgacatactgatttcaatccctttggatatatacccagaagttggattgctggatcatatggcagttctacttttagttttttgaggaatctctatactgtgtataattgttatatttttaagccatagagttttgggggtgtgttatgcagcaatagacagtcgggacgcttgatttccaggatagcatgcttctggttttcttcctgtttcactggcactctttgttggcctcctttgattgttcttcttcatccctctgtctttgtttttctcctgtcattatgcaaaattttagccatacacatattagacagcaaagtataatgaaactccttgtgcccattacccagcttcagtatttatctactcagagccaaccttatttcatctacgctcctacctacttccctccacccactccatattacttttaaacaaattcctcagacactctcttctctgttatattcccttggtgatctcacctggactcataactaaatatcgttcacatgcaaagactcctaagtttattaatattacctgtgctgtagcattgtggctcaaagcatgaattctggtacttatattcctgcattcaaatcatggctcttccacaaactactcttgtgacctcaggtaagttccttaacctctatgtggttcagtttcccaccctgtgaaataagagatgataatatttcctgctatgtcttggggttgttgtgaggattaaataagttacatatgtagaatgcttagcacagtgcctgccatatgcaattattgcatttttttaattgtatcttcaggccagacctgcctgaactgcaggcgtatatatccaattgcttacttggcattctcacttagatgccaaatagacatctcaagcttattattctaaaaccaaactcctgatctcccccgcaaactccacgtagctcttctctgtctcccatttcagctaatggcagtgcattccatctttcctttccttagccccaaattccctgatgttatccttgacttctctctttctttcatatcctacatcaaatcctgttggatctgctttccaaatatattataacagagccattcaccattattacccttgtagaaacctccatcacctcttgcctctaatacagcttcctaactgggccacctacttctgcccttcactcttcctctccaccccctcctccaataattgattctcaaactcctggcctcaagtgatcctcccccttggcctcccaaagtgctggaattacaggaatgagccaccacacctggccaataatctactctcagtacaacagagtggtctttttaaacacttaagtcagattatgtcactgctctgttcaaaaagttccaatgctgtctcatgatacaaagtgaacaccaaagtccttgcaatcctctctgatcccattactgtctacagtggctcattttgttccagcctcactggcgtcctttctgtttctgtaacattatggtagggctcccaccacatatcttcaattcagccatacctcttaaaattctctgtgctcagatcttcatggccaactcccttctttgtcttggcttcagtgttatcttctcatctagtgaacattctgatcaataagtctgagtcctggccagccatccccctcctcccatcaacactctcaatccctcttactctgctctacgttttcctttttccatgatgtttatcactttctaacatatttcatgatgtactcatttactttgtacatcatttattctttgtctccctctactaaaacgtaagcttcatgagggcatctttatctgttttgtttattgctgaatctcaaacacctaggacagtgcctggcacaaagtagacaatagatagacagatggataaacctgttttagaaagatcactcaaaaaacaatatacaggatagtttgaaggggagagagaatggaagcttttaagatctgtgcaataatccttgcaagcaataattatgagagcttgagctagaaaagaagcaagaagagagatgagtgggtattttgttggtagaaccaatagaaatggatgacattctgattatgcggtgggaggaagagagagagagaagtcagtgtgactttcaggtttctggcttgggggtgtcacatgaaacaagttttaggaaaagtcacatgtgaaagtatcatgttggaagactgtggaagaaaatatagacctggaattagaaatggatctttacaattaagcacttaatcgcatactttaaaaaatcctatttcaattaatgtatgtgaatagtcttttctatttagattgccacctcatttttttgtttcttctactcacaatgctgagctaatagcaggactttgacaaagagttgtgattgactgataggctaaaacatatattttttaaaacttagttaactacttcctccccaatatttgctagaattacagatttgacacactgctagatgatttacaaattcattttccccttcttccagagtaatagaattttatctggacacatgattactcagctaaaaactatattttccaggtacgcttttaattggatgaggccatgtcactgaggtcaggccaagcaatgatagtggaaacaatatgtgccatttccacaccttagcctaaaaaacaggactgtgctcccatttgatctggtctgaagtgaaacagacccttttgagacccagctttgacatgaagattaagtaaaatgccttggggcatagtagagaaatgagttggaaggaacctggatccttgaatgacctggtggagcagagctgccctgccaagataggcttgcccgactattatttaggagtggaagaaatatgtatcttatttaaacctctgtattttgggagttctttgttttaaaaacttaaccttcattccgactcacaatagataaatgccatcgatgtctttttttcttggtgtcctctgttattcaaacaaaagatgaatacattgaactgagtttttaaaacattaataaaatactcctaattctgctctttgtgttgcccaatagttcttttctaaatgtgatgaggaattacggaatcataaaatggaagcagagttaaactcagacatgtgggcactcaaggtaggtaaatattctggtattcatgacaggttagtcatttgacacatcaacaaactgataatcttaactttctccccatagtattcagtatttttcttacagttttaactcattcctctctttaatttttaaaaacattcttattttatagattgttgcacattattttactatctcaactctttgggcctgctaattctccccatttttaagtctgctgactcattctctctcaaggtagattatttctgcatgtgctttgtgagctcatcttcagcagggttgttttctataaagtctgtgtgccctagagaatggtttggatttgcttctgctatgtgccagtctggaaccagtttttgtattaatttctagcatcttttgacataaatttggactcccaacctggacaaagcacaggcctggatttttgatttttcacccaaaatctctaggaagagacacactcctttgcttatgtgtcacttccctggtctgatgcacagatgttttaatccctttcattgtgggtgtgtaactttgacatatcagctttatttaggagtttcagttctggctctctatttcacatgagcccaaggccatgtctcttgacactcatcatactaaaaacctaccacttaacagatgaggctctgtagttattccagtctcctccctgggccaccgttaccacttcagttttatgtttcctttgcatttctgatacctgggatagcctgtctttcaatttcaaccattttgaaaacattgctggttatattatgtggctcatttttagtctataacatgaagggcattgtgcgttttgcttagttagctactttgggggcatgagataagtttaagtatttttcaatattcatttagcagatctcaataaagctggaaaaaaatgagaaaacctcaaaaaaaaaaaggctgaggtcttttttttgccgttttgtgcactgttttatccccagtacctcaaacagaacatatattaataataatcactcaaaacatatgtattgactgactgactgactgactgactgaatgaatgaatgaatgaacaaacgctgggtgacagtgttcagcctgtcctgtgtagtccagctctggatccaaatatacagaccacactctaccaaagaagagccctgttgccatcccgaccttacctccttagaacacagttgaggactcatcagccgtaacgttatcacaccctttggcggtctctttctcttaacccaagcagattattaaagcatccctttccaccacatacactccctgagaggaggcctgataaatgtaattttctgcactctcaagttatatttccagtggaacttgagcttccaatcatgctatagtactcacaaaaggctggagtcctgggccactgcccagctggtctgttgcttgttcacctctgaatggtggaagccattgtctttccatgcctttgtccatgcacagttccaggaaaagaggattaatttgtagtcagcaggtttagtgctttctgtataactataagagctgaatcaaaaatctccccaccaggcaattaggagctttctgcgatgagaaagggatcagactgatccttaagactttatgcaaccccagagtattgcagccacctgcatgccgaaggtgtcaagagtgttctcactgctgcctataggagggtcttcagcctccagtgatccaaagtaccaggtaaaatatttaagccaacagaaagaacgtgttttattgtgttttacatgtcataaagcattctctatcatgagatatcactctgtatcggtaagacaggcttgaatttctgtcttggttctgccactgactagctttattccttaggctaacctgttggaatctcagttttctcactgtaaagtgaggataattattttatgaggatagttatgaaaattaaataacataatggttgcaaaacacttagcacagcactaagacacaaaatagacaataagtgttagttacctttattcctgtcccctttcctatccagacaaaggctcagtataaggacaaatattgtttagaacttctttttaaacctacgagccttacctttcaagaaccgcagatttgttcctgaaagttacctgtgtagtgagggttttataaatcaaattttactttcaatgtacagaggagctctttgacagagtcccttttcctgagaagtcattgtgggtttggcatcctgttcagcctggctggggccaggggagctgaactgtaatgacaagcagatgtactattgttctatgaaaatagtgtctggctccagatggggtttaggaaaaagtagtgatgatttctgttgaggaggatgggaattctgacccactgagctagctggtgaagaaggagagtaagacatgtgggtaaatgcaggttaagaaaaaggacctctagatcaactgaaagcctactagaagaacattaaaagcagataagaaaacaaggaagcaaacaaaactcgacaagagaaagaagagaccattaggaaacatccaggataattgctgtcatcattaaagctcccatttgttaatctgttacatatgaggcccaacactggatgatttaccaacatttaacctatcctctcacttttcaatgaattggatattgtcaaccccattattaatggaaaaatgggagctctagaatattgaagtcacttggctattaagtgatggagccaggactgggattcagaatccaacactcatattctttccatgaggtgtagattccattgagaagaaggtgtgtgcctaacaccgtgagaaagtcttggccctggtaatgctggtgaggccagtggctgagaaaagaatagctcttacctaaggctgagaacagaagacccaaggttgtggaaaactgacagtggtgcccttcctcacacagagtgcaaagattggtggcttacctgcttcagactcttggacgtgctcttaaatgcagatcctggcagtcagagaggaaaggctgagaaaagttcactctttgccaaagtaataaatccttctctttgatccctcaaaagttgatagacgaaaactcctcaaagcacctaggggtaggaaccccacttgagagttgtgggttctccatttcatcacagggatttgctgtgaaggaatcctgtggtaaactccataagaaaatgtaaataacatcccctctccaatttatcttttctgtaaatctggcttttcatatattaggtttctttacagtaagttgaaaccttaagaatagatttcaaaatatttaggaaatggcctatttattttgaatgatattcaacaccattaaactagagtgttgggagaatatttggacattccataatgatttgacttgtaacttaatataacagaactaaaaacaaaaaccacatgatcatctcaatagatgcagaaaaggcttttgatacaattcaacatcccttcatgttaaaaacccttgacaaacaagacatcacagaaacatacctcaaaataataagagccgtctatgacaaacccacagccaacatcacactgaatgggcaaaagctggaagtattcctcttgagaaccagaacaagataagaatgtgtcctattcaacatagtactggaagtcctagccagagcaatcagataagagaaagaaaaggcatctaaataggaagagaggaaattaaactccttttgtgaatataacatgatttgatacctagaaaatcccatagtctctgcccaaaggttcctagacatataaacaactttagcaaagtttcaggatacaaaatcaatgcacaaaaatcagctgcatttctatacaccaacaatgtccaaggtgagaaccaagtcaggaacacaatctcattcaccgtagccacaaaaagaataaaatacctaggaatacagctaaccagagaggtaaaagatctctacgagaattataaaacactggtgaaagaaatcaagagaagacaaacaaatggaaaaacatttcatgctcatggataggaaggatcaatattgttaaatggccacactgcccaaagcaatttacagatttggtgctatttctatcaaactaccaataacattttttatagaattaaaaaaaaactattctaaaattcatgtggaaccaaaaggagcctgaacaaccaaagcatttctaagcaaaacaaacagacgaaaacaaaaaacccaaacaacaacaacaaaaaccagaggcacactacccaacttcagactgtactacaaggctacagtacccaaaacagcatggtactggtacatagacacatagaccaacaggttaaagaatctagaaataaaaccatacacctacaactaattgatattcaacaaagtcaatgaaaacaaccaatggggaaaggactttctattcaatatatgatgctgggataactggctagccacatacagaagattgaaactggatccctcccttttaccatatgcaaaaattgagccaagatggattaaagacttaaatgtaaaacctaaaactataaaaaccctagaagaaaacctaggaaataccattctggacataggccctggcaaagatttcatgacaaagactccaaaagcagttgcaacaacaacaacaaaaatagataaatgggacctaattaaactaaagagcttctgcacagcaaaagaaattatcaacagagtaaacagacaacctacagaatgagagaaaatacttgcaaactatgcgcccaacaaaggtctactatccagaatctatagggaacttaaataaattaacaagcaaaaaccaaacaaccccaataaaaaatgggcaaaggaaatgaatagacacttttcaaaggaagacatacacgtggtcaataagcctatgaaaaaatgctcaacatcactaatcattagagaaatgcaaatcacaaccacagtgagacaccatctcacaccagccagaatggctattattaaaaagcaaagaaggctgggcatagtggctcatgcctgtaatcccagcactttgggaggctgaggcaggtggatcacgaagtcaggagatcgagaccatcctggctaacacagtgaaaccgcatctctactaaaaatacaaaaaattagccgggcgtggtggcgggcacctgtaatcccagctactcgggaggctgaggcaggagaattccgtgaacccaggaggcggagcttgcagtgagctgagattgtgccattgcactccagccagggtgactgagcaagactccatctcagaaaaaaaaaaaaaaaaaaaaaaaaagcaaagaaataacagatgctggtgaggttgtggagaaaagggaatgcttatacactgctcttgggaatgtaaattagttcagctactgtggaaagcagttcggagatatctcaaagaacttacaacagaactaccatttgacccagcaatcccattactgggtatatatccaaaggaatataaattgttttcccataaagacacctgcacatcgcaacactattcacaacagcaaagacgtggaatcattctaaatgcccatcaatggcagactggataaagaaaatgcgttacatatacattaaggaatactatgcagccataaaaacgaatgaaatcctgttctttgtagcaacatgggtggagttggaggccattatcataaatgaattaatgcaggaatagaaaaataaatactgaatgttctaacttataagtgggagctaaatgatgaatacacatggacacaagaagtaataaacactggagcctatttgagggtggagtgcaggagtgagtgaggactgaaaaactacatattgggtactgtgctcgttgcctgggtaatgaaataatctgtacaccaaacccccatgacacgcaatttacctatgtaacaaacctgcacatgtaccccctgaacctaaaataaaagttggaaagaaaaaaaaaatgaacctctgagacaatattataaaaattagcacattcaaaccacggaaattgtcaaagtgtagctaaaatattaaaccttttagatatgttgtctagatataattatcccattttatagccagtgttatggacatccaaagacaatgtcaattttgctaataaactgcatcaaataagtgcatgggaaaaaataaaaagttgatacattaaaaaaatgtttttgatacataacttttattttgaaaacttgaaataaattgccattgtgaatttggcagcttttaccctggcatgcctacaaagaatgtgatatacatttaatcacgaagaatgccacccagtgataacagtggtactggggttatgattatgttttaatttgttttgtgcagaaaggcatgaccatttgcaaagctgtcctatgaaacgtatcatgtactagtcacctcatgttatcagcatgctcctggaggagtaggcaatggattttttcaccagttcgcactgtgcaatctcttcctcatgtgtgtgaactttgtgggatgtcaagtaccccattaaaattgaatgaagtatttgaggggctcccacaaaccctctagtgatcttctttcaacaaacagcattttattgtgtaaattagaaaaacaacacagagtctggcttaaagaggatggaaaactggcattacaccaagaaagaacctgaacttcagtctttgacctcaggagacatccaagtattaaaacagaattttttttttttatttacatggaaaccctgatggaccaggaaattctttataatgtagagtctggtgctaagtcttactttcaggtgaacccaaatgaagattattgaactcactgttgaatctcatcccctgtctttttaacagcagtaagacccctcttggtcagccacaatatggggaaactcctcagcagctgctgttatccctaatattattgatatcacttctacttgctcttgctatgtttgtttcttttcagcagagctttcacagtactctaaaaagtagaggctcttaacattaaaagtttccttagccttttcaataaccctttcctggttgtctatgctggtggcagcctcaacctgaacctgagtgaatttgtttttctggcctgagctttgctgagcctcttaaggggtagaccgtctatgtgtgtttcttttatgtgagataaaacgcacaatttattaaatatcttctgattcttagacaggatctcaagggtggagctactccagggctcattgattttcatggctttttggctgtttgaaaaagagcctcctttgacatcatgtgggtttttgctatttctatttaagggtatatcttacatgtcagatatattattattgctgttttagttctagacagcaagtgatatgagcaaacaacaaagcttccatgctgtgaaattatgcatttattaaagctatcagttgacacttagctttgaattatttatatttttctataaactgtcgacaatcataacgggaccagaaccataggttcatatgggaaggtgatttactcatcttcctttcttgcccttaggaggagttgcagacagagtattatctttttttttttttttttgagacaaagtcttgctctgttgcccaggctggagtgcagtggcgcaatctctgctcactgcaacctctacctcttgggaccatgcctggctaatttttgtattttcagttgagacgaggtttcaccatattggccaggctggtcttaaactcctgacctcaggtgatccatctgacttggcctcccaaagtgctgggattacaggtgtgagccaccaggcctggcccagagcattatctttatcatgactttttcctttatatgtattgactatttgcaggtgtatcacaactacaggagacagaaagggaagcggtatacctctttctgcatgccttgtgtttaaagcgtgcctagattctgataaaggcttgcctgacagaaaaggcagaatgccaggggtctatcccaagatactgagtcattcctgtgtccttaaatgccaaagaggtaggatcaaaacaccagatctaaaacttgacaatataagttgttagacttaatctccaccagactcaacttgtatctcagcttctcactaatctcctatttctcattcactcactggtaccttcagcttattctctgttttctcctttgtttgtcaggttttggcatgatatctcagacactttttttctccttgcttcattcagccagccccaggtgatttgccttcccagaccactggctttctcctgaaaagagaagacacaattgacttctggtctttcttgctgtccatactacatagattgttattccaaagcttggtccaggctgagttcttggacactgctttaaatgagtggcccttgaccagaagggagatctagaaacaaacacaattttcctggggaagctgaggcattgtgtttgaggcccacgtatctttgtactccttccgtcctgtgatccagaagtctatttatgccagtcttgcttcaacctctctcacaattgcaggggaaaagtctactgaagggagagaacatttcagctaggggatataacttaaggtgagaaataaaagtgagacgaagaaaacatgtttggtgaactggtttgaccagaactcatgtttcaagttggaaatgttcaaataggaggaagataactaaggtaaaaatattaaagactactattaaaaatttggaattcaatagttaaacaccacaattagagatatttttatgacattactgatattaggattgtcatttactgagaaaagtgtgtaaaaatctcccactatgattgataatagaatgtttattttccttgaagttatttcaattattactttatttattttcgagactgtgttattcattgcatacaagttgaggattgtgatatcttcctcgtgaattgacttttgtcatcatataatgactttcttacctggaacaatgcattttgcctttaggattactttgtatgatattaatactttgtcaccagctttcttttgtttaatgtttgccccatagtaaaatattatcttgccttttggaacatcttggaatttttcctcctgcctttctaacctatcttcactgtgtccttctatttcttctttttttcctcctactcctgattacccccaaaacccaggccttgaacataggggtatatctgtgtgtgtacgtagatgcacgtgccaacttttttatctcaaggctttaactgttactctatcattgaaactgcatttcacaccttctctttagtctcaaattcccaactgccactcatcatcttcccttcccttgcctatatctctactctattctctttttctcttgggcttgcagccttggagtcaaccttttttccgctttatgctctatattaagctgtcataaatgccatgacctttgctgaaatgcctaacagattctcagcaataagctcacagggaaagggcaaagccaggagtgcaggacgaggggaggatcagtggcagccatcctgtagattatctactgaaattctttccattcctttgaatttctgctcctttgaagccctggattataataattatcttggaaagtttttcagtccgagatccaaaaattcttaattgggacctcttcagtgaaaatgacattcagtgaaaatccctggcaacattttcctagatgagaaaaagaattaggaatcagatgaagacgtgagaaagccatgacttcacaatgtgtaaagcatgtgctgatagcttgtggaagagtgtcttaggaggtccctgtcccaatgaggataacttcttaatcagaatcttgtttccaagttctccctcaactccaggataaactttaaaaaggaaaacaaaatccttgctagaaaattttccatcatttttctcttttctgtatgagtagcatggatgaaagagttctgtgactgagttgaggtttgcatctaactattgagccatggcaaaaaatattaagcatcactatttgttgtcatataaggaatttagtggggtttgaggttttaaatgttattgtttttctctatagtaatatcccttcaatccccttggttatctttctagagcaatataaaatgacctgacttctgtgagaagtctttagcttttggaaatcctcacctaggtttctttcacctagagaattggtttctgagaaaatcctccttccttttactgaacagtgaactgggagcctttaaatggagtggaggtggaggaagatggaagtgaggcaggtagaatttgtcattctgtccccctgggagaatgaggaaattagcatccagttctctagaacctagagtttcagggatctatttgagtgggaaaaagcattccttgtttttttgtgacctacttaaacattctgtgaaagttgtaatcatttgaggttttctaagaaaagaaaaaaaaaagtctaaatataatcctaaaagggagctaacctaacaacaaagaacacccggttgcagagattatttctctggaaattggcaaaaagagacaaaaatcttccctggcgattactggctatacctgctgctacacctgatttcatgctttttattcctggcagcactattggccttctccaatgtgggcttctccaaacttcacacccaggggcacacaaatcctatttctcccatctggaaagctctgctcacttcttcccaagtccgcttcccacctgcctttgaaatgcagctaaagaccacttcacagagattccctcaatgctagctcttccgctatgcccttcattctttctcttaaacccctagaactcttagaacctgttaacagtgtatgacatcctaagtgctctaattcagggacagcagagaatgcagtccaggctcctggtccagtagtggggatggattgtgctggtccacccgcatgctgccattcagtctgctttatcgtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaaaggtaatttgacatactatctataaaagtgtgaattaccctggggattaggaggtgaggttctgtagtaattaggtatgccaaaaataattttttaccctcctccccctcttccttctttcttttctgcatttacatgtattgctcttggtctctcatgtcattctttcaggattttctaatgtaatgaatttctctttctctaccctagagagtaccattatttccattctttcatggaactgtaagtgtgtgcaatttgttgacctcgtggtatttcaaagaactgtaaaatctcaattatcaggaatgcccagggaaaggggcttttaatggaatggatttttctcttaaactgaaggttaatcaggactcttctctcccccccgtttcaaatttattggttgcaattttttttccctaatctgtgagtgtactttctgggctttgctgaaatgggaggttatctgattgactagcaatcataagccctatgtttaagtccacattcttccatttgccagctctatggtttgaggaagttatgacactgagccatttgaaaaatggagatagcaacacttgtcctacctatgtcacctgggctgtttagtgtatcaaattatataaagacaatggacttgctttgtacaagtcttaagttttattttaatgaattatgacaactaccaagttctgagtgcctaggggccaggtgctccatacacattattgttatttccacaataaacctactatatatatagatgtatatagatgagaaaagtaaggcttgggagataagtgacttgcccaagattatgtaaataacagtggaactaaatttctttacagcaaattgataccttgattaatcaaaagtctttattctaagtaccatttcttgtggataaagagagtatagaagattgcctagaagcatactgaccttaggatgcattgttttgcttagggttcttttagttataaggaacagagatgttaggtttcagagggatttcagagaaacccaatgacagaaattgaattatagttgggtgttaaggaagctgtcatgaatcaagcctactcttgcctctcctctttcttctcctctccttccttcttttcgctctctctttgtccacacaggcaaaatcttccttacatatgtggccttcactctcttttgtctattgactggcttcctcataactgtagcttgcatatggttcatcatatggtttgggtctgtgtccccacccaaatctcatgttcaattgtaatcccccatgttggaggaggagcctggtgggacgttccttggatcatggggatggtccttcatgaatggtttagcaccattctcttggtgctgttcttgtgacagtgagtgagttatcgtgagatctcgttgttttaaagtatgtggcacctcccctgtctctctcttcctcctgctccagccatgtgaagtgccttgcttcccttttgccttctgccatgattggaagttccttgagacctccccagaagctcctgtatagcctgcagaaccgtgagccaattaaacctcctttctttataaattacccagtctcaggtatttctctatagcaatgtgagaatggactaatacagaccgtagtagggactctacacctccatatagcatagtatctcttgatctgtccatttagcttttgccctgttgcttactggaaattctctaggtcttgtgattcagattcctgaaggaggattcttactggcccagctcatctattctagtcagatcccaggtcactgactgctacaagctcatggattggctgcttttgcatcaggtgtcctgctttggtgctgcccacttagcaaagctaagggaagactaggaaataaaagcaatgtgacagctacatctatcatcactattaaagaaggctatatatcacgatatatttgtttttgtaaaaatccttaatattttattgttatcttttagttcttattctcttcttttcaacgtagtccctcgtctttcaaaatatttctcagtaattgggttcctgttgactcaaattttatgacacagaaccttgtttataacctcctaacttaccattactaatatcagttctgtagtcatatataccacaattttatatgtttttgaagaaggtagtaggaaaatatgtcatagtttaagttttatactaagcataagtcatgtcatagtagaagtcttttttctattaatagaagatgtcatgtctcaaggttattgttggaatataccgtaattaatttttttaatccttaaaataggagaattgagggtttccgagtagtgtgaatacatgaaaagtgaaaaaaatgggtcatcttctaggaaggcctgcagaacttaaaactgagaacaggccttagacttgctttctttcctctcctggcacttcctgggttttgttttcctccctgctggtaggttttgatgggaaggcattatatttctgtttatctgaatatctattttactcacaaacttttttcttttatcatagctgatatgaagtgaaaacatgtatcacttggctcagcctgaactgctgtgtgataggatgtccctgtatcaaccatgaaccagaagtggaacagggacctaattaatatttatgctgaccttggtggctgttgtaaaataaactaccatacatctaaaacctcaccacactgggttggatagctaaaacttctatactattcatggcttaacttctgagatttatatgcctcttgaagagaaagtactcatcactgctgaaagtttaactttctatttttgttatggcctccattacatttccaaatattcctttacttaattttatccataaacctgaagccttcactttcttagtgaggtactagattctttgtatataaatttgactgtattggaaagcctgggtccatgtgtttttagtccttaactctccagtccttgtagatttccttgtatataaacactttaactgagttatagaacctcttcctctgtgaactggtgtcaggctctggtggtaggtcctcttcctactctacatgctgcctaccctcttgtatggaaaaagattaactgttttcctcacactcagcgcaaaacacttctggtcaccaaaacgtgtgggtttctcccacacaaagcaattctctgacaccagctggatatcctacagttcagttcaattctgtgctaactgaagttggcacagactccacgtgttaagggctcagcccctcaagactgtccccggcttcagatgtcagtcactagtggtagtttcccatgttacccatgacttgtgtcagacttggctgtaaactggagggtcccaaagcccccttctctggtttgatcacttgttagaacagctcacagaatgaggaaggtgctttacttattattagccattgattataagatgatataagtcaggaacattcagaaggaagagatgcacaggtgaaggtatgtgggaaggggtgtgaacttctgtgccctctctgggaccaccactctccaggtacctcctcctgtttggcaacccagttatggaggcttcattacataagcatgattgattaaatcaggccactagtgattttttaaaaaatttaattaacacctaataattgtacatctttatggggtgcaatgtgatattccaatttatgtatacatgtgtaataatcaaatcagggtaattagcatatccatcacttccaacatttacaatttgtttgtgttgggaacattcaaaacctctcttctagctacttgaaaatatataataaattaacgttaactatagtcatcctacagtgctaatagaacgctaaaactttttcctcccatttagctgtgattctgtatctgttaaccaaactctccctcttccctacttccccctacacttcccagcctctagtaactactattctactgtctatttatataggatcaactttttcagctctcacaaatgagtaagaacatgtggtatttttctttctgtgcctggcttgtttcacttaacataacgtcttcccagctcatccatgttgctgtgaatgataagattttgttcttttttatggccgattagtatttcattgtgtacatataccacattttctttatccattcatctgttgatggacactaaggctgattctatattttgtctagtgtgaatagtgctgcaataaacatgggagtgcagatatctcttcaacatactgatttcctttcctttggatatatacccactagtgggattactggatcatatggtagttctatttttagttttttttgaaaaatctccatactgcttcccataatggctgtactaatttacatttcaaccaacagggtataagaattcccttttctccacatcttcaccagcatttgttatttttttgtctttttataataaccattctaactgaggtgagatggtatctcattgtagttttgatttgaatttccctgatggttagcaacgttgagcatttttcacacacttgttggtcatttgtatgtcttcctttaagaaatgtctattcagatcatttgcccattttaaaattgggttatatggtttttttgctgtttgctgtttgagttctttgtgtattctggatcttaatcccttgtcagataaatggtttggaattatcttctcctgttctacaggttatctcttcactctgttgattgttttctttgctgtgcagaagcttcatagtttgatataatcccatttgtctatttttgcttttgttgcctgtgcttttgaggccttatccataaaatctttgcccagaacagtgtcctaaagtggttcccctatgttttcgttgagtagtttcatagtttttatccttacttttacatctttaataaattttgggttgattttatatatgatgagagataggggtctagttttattcttctgagtatgaatatccaattttcccagcaccatttactgaaaagggtgttttttcttcagtggatgttttcagtgcctttgttgaaaatcagttggctataaatacatgaatttatttctggtgccatttgtctatgtgtctttttatgccagtaccctgttgtttggttactatggctttgtagtgtattttgaagtcgggtagtgtgatacttccaccttcattctttttcctcgggattactttcactagttgaggtcttttgtagttccatacacattttaggatttttttttcctacttcagtgaagaatgttaaaggtattttgataggaattgcattgaataaatagattgctttaagtagtatgatcattttaacaatattagtttttccaatccgtaatcttgggatgtctttccatttttttgtgtcttcttcaatttctttcttaagtgttttatagttttatagttttcaacgcagagatatttcaccttcttggttaaatttgttcattttttttatagttattataaatgggattgccttcttgtattagtttgttttcacacggctataaatagctacctgagactgggtaatttataaacaaaagaagtttaactgactcacagttccacatggctagggagacctcaggaatacaatcatggcagaaggtgaaggagaagcaaggcacatcttacatggtggcaggagagagtgtgtaggggaaactgccacttttaaaccattggatctcatgagaactccctcactatcatgaaaatagcatgggggaaaccgcccccatgatccaatcaccccccaaccaggtccctccttcaacatgtggggattacaattcaagatgaaatttgggagaggacacagagccaaaccatatcacttcttgatttctttttcagctagttaattgcagtatagaaacactattgattttggtatgttgattttataacttgcaatttcactgaatttgtttcttttctaagagttttttgatggagtctttcgatgaaggtttttccatatataagaatatgtcctcagcaaacagggaaaattttacttccatctttccaatttggatgccctttattttgttctcttgcctaattgtgctctggctaggactttaagtattatgttgagtaagagtggtgaaagtgggctttgcgtcttattccagttcttagaagaactccccccaaccgccattcaatatgatgttagctgtgggtttgtcatatatggcctctattgtgttgaggtatattatttctgtacataatttattgagagttcttgtcatgaaaagattttgaattgtagcacatgctttttctgtgaatactgagaggattatattagtttttattcttcattctgttgatgtgatgtgtgatgtatattgatttgcatatttgaaccatccttgcatccttgagataaaccccacttgatcatggtgtataattcttttgatgtgctattgaatttcttttgctagtattttgctgtggatttttgcatctatgttcatcaaatatattggtctatagttttctttctttgttgtgttcttttctggttttggtgtgagaataattctggcctcgtagattaggtttggaagaattccactccccacctccattttttggaatagtttgagatgaattggtgttagttcttatttaaaagtttggggagtaacaacagcataatgttagaggtgcctagtattcattccccttacaagaaaaaaccaaggcaatgaatacacagctaagatttgactggagtgtgggaaggagcaccttggaaggcagcaaagaggtggagatgcacctgtggtaaatggaagtccaggagggcagcacgcaggcactcagcctctgaagctctgtctgccccacccagattagatatgtctgaagtcaggagacacttcctgttctggcaaaaatctgagtagaagacccttgccagcttccattgccactgccaatacctacagtccttataacaagagaattccacaatcctttcaagccatgagcccaattgggagaactgtggggattatactaaattagcagtacaaggtgtgcactctccaccccctgcccactccctatgagccaggctgctgcagcatggtgccatcttgagaccagagtcacctctggtgtgcaccctgctctgggagccactagccactgtgcctcacaagcactgggactccatcttcatcccaccaagcccataggtcattgaaccccacaacctcatctgtgcagagcctgggcccaagatcagctatgactcctgcactacagggaaaccaactcctgctgccttacctccagctgaaggaacagtctgattgtctcatccagggtgaacccccccttaagctggcgaaaacactacatgccatccttcaaacaggagaaactttcaagcttccgtgtagctgacatatccctgagtcagtggaatgactataggccatactcagaacctgagaaacaatgtagcagtgccactgccccaagcagacacaccccttgtctgcccaatggccctaatgatagggacaggagatagcgaaatactgggtagaagagggtggttccctggcaaaggccccaccctcaagcctggaaacccatggccctaaatgggaacaggcattcctatttttgcacccaaaagttcccttttggcccaccacactctgcatcctgaacccatataaaccccaaatcccaggctccacgagcagatgaacagaagagcagaagagcagcagagaaggagagaagagaaggagcatctgaacgttgagaggagttcagctgggaatgattggagatgagatcggcgctagatggccaaactccaggggaagatcatcttcccactccatcccctttccagctccccatccatcctgttgagagccacctccaccaatcaataaaaccctcgcattcaccatccttcaagtccgtgtgtgacctgatttttcctggatgctggacaagagctcaggatacagaaagcccttgcaaaaaggcagagtgttcactgagctgtttaacacttaagctgtccatggacagcaaagctaaaagagtgcgctgtaacacatgctcactgggacttcaggagtcgcagacacccacccctagattctattgtggggccggagcccaaaagtgctcacaccagcttctgcacctgcccatctgcatgctccccgtcatgtaaggggtttgagtgccagtaagccatcatccttttacttatttaacatttaatatgtatatggtgttggtgcatgataacatcatggaccagatataatgtttgtctccaaagagcttgtatagctatagggaaataagacttagacactgggcagagggaggtaaaactgacaatgagttgtgggatattacagataggaaagaacataggtgtggtgttttcatttttgtctgcaggttacaaagctatgcataaagaatagtaggaatagtcttctgctcattatattgacaaatgtgatttttaaaaagccaaggtaaattgatgtatttttagaaacatgaaaaatacttacaaaaatacttttaacatttaaaaaaatattgctagcataaagaaagtgggagagtggtccttctggccaaaaatgccatttgacttcttgtcatgcagccactggctacattttttataccttttctgaccctccagtttccacttctgtcactacatttttccatttctaatatcacactgcatgctgatttttgacttttggaactgatggcattttcaccctataaaagtgtcataaagacacattaatattcaaatgatcacttattttgtaaatagggaatttttgcatatattaaaccagtagctttcacttcacttcacataagtcatgtttctttgtggttgtccattttcaaatctgtgccacaagactatgtactgggaaggagaaaatgagaattaccacaaacaaaaaaaaaaagtgatagactctgaatcagagttcactttcttgacctctctagtgagataatagtcttgaaaggcaggcttcgtggaaagagaaatttcttttcattgttttattttttccaaatctattttttaaaacttttctatttagaaataattttagactcaaaggaaagttgcagaaatcagagttcctgcataccctttaacagcttcccccagtgttaacattttacattaccatagtaagagtatgaaaaccaggaaattaacagtgacataaaactgtcaccttatctatgaatctttatccagtttcaccagatttcctattaaagtgtttttcttgtcaaggatccaatccaggctcccacattgcatttggttgtattgtctccttggttttgtccaatattagacccaccttgagtctttcctttctttcttttcttttttttaaatttcatggctaacacacttaaagagaactggtcagttatttatagaatatcccttaatttggaatggtctttcttttaattattacattgaggttgtgccattttggcaagaatgccactgaagcgatgtgcccatcttagctcatcatatcagtgggcacatgatgtcgatatgccttattactggtgatgttagcctgtgtcactcaattaaggtgatgtctgccaggtttctcaattatgaagccactatttttcccttgacaatcactgaatatcttctggggagatacttgaagactatgcaaatatttcacttcttgccatatttttgcacactaatttgagcagccattgattgttcttgcctgcaacatttattactgtgctgttgcctaatggttattttttattttccctacttctaaatttattcattggtaatccattgtaagaagttgtcccttctccctcatttacttatttattcaattatttgtttacattagcatgaactcatgggtcatcatttgatactatcataacttactttgttgctcaaatttaactagctctggtctttgggagatccttcatgttgcttctctgtcttttcaacatgtccccagatttttttgagtacattctcacttggcaacatgagttttcctggattgtcttttatttcccttgccctagctctggaatcaccatttccctggagttaattctgtagccttgatttcttttattcaggaatggtatttacagctaagatctgggcagatatgctattgctataaggggttattgaaacaggaaatcttccctgaccccttcacaggacttgtgaagggggtaattcatttactgagcccacagctctcaatccctcatgggatggggagcatgcaggtgagtgggtacaggggctggcatgagtgcttctgggcactggcaggaacagaacttcgtgtggccctgtagcagcatctgcagggggtacctgtgacccatggagccttagaaggtgtgtgttacagttgtgctcttttagctttgccctctggtgatggcttaagtgtttaacagctcagtgtgacagccctctgtatcctgagctcttgtttggtgtccaggaagaagcaagttgcatgaacgaattgaggatgctaaatgcaggggattttgttgccgatgaaagtggctctcagtataatggagagctggaaaggggatggagtgggaaggtggttttccctggagtacagccatcctgggccaaactcttctctgagatcccaccatcaagccgtccctctgaaatcaagctgcttctcctcaacatcaagctgctttttctcttctttcctttgctgttgccagtggagcctggggtttttatgggtacacgatagggggtggaaaaggcaacattcaagagggaaaacaggaatgcatgttctcactttgggctgaggttccaggcttgagggtggggcttcaacagggaccccaccctcttctacccactattttccctgcctcctgtccatatcagtattgtctctagtcctgctcagtcaacagaagtaggatatatatacatccatccgtaagtatacatattaaaaattatacatttatacctctgattccaacccaacaccactggtttcattctagcctttctgttctttgtaacttcttttgctgatagtgaggaactagctcattatatttacttaagttttgatcctagtatatacacaaactagttttggaataatcaacctacattagcctagaatacagaatttgggttcaatttttttttgtcattagccttacagtattcatgcaaaatactcttttccaaagatatttagattagttctttcttcaccactctcttcactttgattatgttagttatttgtgatatagttaggttcatttgtcactgtttgtcttccatttgaggttcctatcacatcctggtttatttttaattatttatcgtgtgtgtgtgtgtgtgtgtgtgtgtgtgaaccattaccatggttctaagaatcagaactatgaaaaaaaaagtattctcagagaaacatttcttccgcattcggccttgtcctattgttctttccaccctgttctcactcaccccctctaggtaaccaatctcattaacttctggtttatctttcctgtgtttattttgcatttgtacaaatgagcagatatgtgtatattttctttctccttttatacacaaaggttagcactatagataatcttttttactttgcttttttgtaaaaaaataataacagtatatcctggaaatcacagacattttccatattcttttttactgctgcatagtgctccattgtatgaaggtaacttcatttatccaacaactgtcctctgtataataattttggttgcttccaatttttttgcaattacaaacaatgctgcaatgactaaccttggacatattcgtctgtgtgtgtgtatgattgggggtgtatctgcagggtagatttctagaagtgagattgcaggcccaaaaggtaagtgcatgtgtagttttgttaggttttgccaaaattccctccagaaagcttctaccagtttgcattgtgtgaaattatctatttccttatagcctcctgacagaatatatcctcacacttttttattttttctgatataagaagtacaacatggtatcacagtattgttttgattttatttctgtaattataagtgaatttgaacgttctaaccttttaaaaacatttctgttcatgtattttgccgtcttgctatgaggtttttgtcctttgtctcataacactttgatatattttctcccggtttgtccgttgtcatttgactctatttactcttggtatgtaatttaaaaaacatttttgtagtcaaaatttttttttattttattgcttctggattttgaattatagttagaaagcctttctcatatctaggttgaaaagcaatccccccgtgcttttttctaggatttttatggttccgtcccttgttttctatttagattcctaatcctcttggagcacatttttgtttatggtgtaagttacagatctaattttatcttttttccccagtggatgcccaattgtttgagcactatttattattataaagtccatctttgaggccaggcacagtggctcacacctgtaatctcagcattttgggaggccagggtttgaggattgcttgagtccaggagttcaagaccagcctgggcagcatggtgaaaccccgtctctactaaaaatacaaaaattaggtgggcatcatggtgcaggcctgtaatcccagctactcaggaggtggagccacaagaatcgcttgaacctgggaggcagaggttgcagtgagctgaggtggtgccactgcactccagcctgggcgacagagtgaaactctgtctcaaaataaaaaataaaataaaataaaataaataaaataaagtccatctttgtaccagtcatttgagatcccacctttatcacatattacatttccagattaacttgtgtctatttctaagctttctattctattccactggtctatttgtttattcttgtactagcaccacacttttaattatagagaatttatagtatgttttaattcctgatatatgacttatccccaaattgatttttcttttgagtgtgtcctggctactgttatgtgtttgtttttctatatgaactgtaatattagcttgtctaacttcatgaagaagcttgttggtattttctttgagactgtcctaaatatataaattgatttagggagagctgacatatttataatattgagttgcattattcaagaacagaagatgtctttccatttgttcaagtctacctgtctattcttgatacttcatgtctttcaaaaatgcttcttgtctattcttgactctttactcttccatatgcattagaattaacttgtcaagttctgttaaaaacttgttgattgaaattacattaaatttatagattaacttgatgataactgagatctttatgattttaaactttctaattcatgaataaatatatatcttcatttatttcacttttcttttagtcttaaatatatttttataatttttataataataaaaaatatatttttataattttccttcatagagtcttgtatatctattgctagattattcctaggtccttatttgcatttgctttttgttgttgttattgtaaatggaatctattttaaaattacattttcctaattgtggctgatgtataagaacgttatttatatatgcatgttgatattttaatccatcagcattgctgaactcacatcatctatgaataattacagtcctgtttctttcttcccaatcctttactccttttatgccttgtcttattgtgctgtttaatatcctttagaacaaaattaaatagaagtgattataatgggtattcttcctttgttcagaacttaaacaggagtatttctgaatttcatcatgcagtataatatttgctgtacagttttggttgataacctttattagtttaagaaagttcccttctttttttgttagctatcagtttaatcatgaaaaggttattgaagtctacaaaatatttgttctgcatgtattgaaatgtgtatatattttctctctttatataaaattgtgtttttaaataattatattatagttgtgagttattaataattttaaatatattaacatatgttaatgtaattaaatacaatgctggaatccatttgctaatattttatttaaagttttttgtctttgctttggaatgtgattggcctttcagttttgtctgtttattagaatcaaggtatatctgcctcatgaaaggtatgtgtttgtttgtttttcctttctattctctgaaagagttttggattatctattcctttagtgtatggtagaacactcctaaaaaacttttgggctggtgttttttaatgggtagattttaattactgattcagtttctttggttgttcaatagtttattcagattttctgtttcttttttgagttagttttggttctacatttgttttgaagaaattgcctgttttacttattttctaattaatttgtaatatagttgttcaaagcattattttatgattgttaaatatcaaccgtatttgtaactatgtcttcttttgttcacagcacctttttttttttttttgtctgagtcccactctgtcgcccatgctggagtgcagtggcgcgatctcggctcactgcaaactccacctcctgggttcaggtgattctctcacctcagcctcctgagtagctgttcacagaaccttttattcttactctttcattaaaaatcttgctaaaagtttgtcaattttcaatgaaacaaatttaggattgtgatacttgctattgtttcattgtctttagttcattgattttcagtcatatctttatcattttcttccctctattcaacttgcctatcgtggatacgtttttttttttttttttcccttctaatttcttgggttgtatgtttggctcattaattttcaactcctttatgtcaaaggcaggattttaagacaataaattttcctttaactgtaactatagctgcacctcacacatttttacaaatagtttcagttacaactcagtactagatattttttaatgtctgttatcatttatttcctgtttaattaatgatttacctaaaagcattttcaaaaacttattgccataaatgtattcagtctttttccttttctaatagcttgaaactagaagttgaataagatcttgcccagaaaaaaagcatgtttttaaatccccaaatttatagagttctttttgctttttaaaagattattgatttataacttaatagcattatggttgatgacttggtttatatgatatcagttctttgctatatgttgagatgtgttttgtggcctaaaatgtggtcaatttctgcaaacgtacaatgtgcacttaaacagaacatacattctttttttattaggtacggaaatccatatatgtcaatttatataagtggttccaatccttttaatgacatctcatatatagaaaattctaatatttgtacagcacagtagcataagttggagttgatttgaaaatgtcttgcagggcttactaaaatatttattgtaccttttaaaattttatataattacaaggaaaaatacaaagtattagataagacattgttaaatttttataagcctaaataaaacactttcagaattttacttgagaaacttgagtttgctttcatgaacataactattttaatcagattttatgtttgaaatagctatagatcattcctgattaagatgttttaataatgaccttttctaatctcctcaaattcatggtgttgaaaacccaatgaaaatatttgtccaaataaattaccaaaatcatgttacaacattttaaaaacaattcaaaccgttgatattatataggaagcatctaaagttcttccttaatttcactgaaaaaatgtaatttgaaatttcttgtgacagggcatggtagctttgtaacgtgtccacttggctagttgaactgtgtctcccagaagccctttccctatgtgttttcagtcaggatgggcttcaggaggcatttttgcatgagatttggagggcagaagtgaagcagaagccattctgctttgtatgctgggaaggttggagcaagggcgttttaaggctcacacgtgttgctttatctgtcggctcacctcatttgcttagggtagcatctgggctggaactgctgcaccttcccttaaatctaactttggcttctccagttcctgagccaggtgtgtgtttatgtgtttagctctgggaaaaagggcattagtgtctcctgcaggacactcacttcatcaaggctggagacagcaagaactgacactggttccaggccatccttgtaggttacatcttgaccttaatctctcctatttatatgcaccttgcctgctcttgggtttcaaatccagcattagacgcaaaaataatagcgtaatagaaactgttcaaccacagcaaagcacggtggctcacgcctgtaatctcagcactttgggaggccgaggtgggtgtctcttgaccgaggtggtcaagagttcgagaccagcctggctaacatggcgaaaccctgtctctttactaaaaatacaaaaaattagccaggcgtggtagtgggtgccaatcgtcttaactactcaggaggctgaggcaggataatcacttgaacctgggaggcagaggttgcaatgagcagagattgcaccattgcactctatttagcctgggcaacaagagcaaaactctgtctcgaaaaaaaaaaaaaaagattgtttaatcagctcccacagttgcataaggtgaaatccttgtctgtctatctatctatctatctatctatctatctatctatcatctattaatcatctgtctttttctctatctagctatttggatgtctggccatcttatccccataaagttccgcttctctgtctgaactctgacttatacacaggacaaataaatttcaaatccaaataaaatttcacataccaagtatttttaaattctagtgaagttttactgtgaaaatctactgttagaacagttacctctagcttgcaggccattcaagttcatattagtcacaaacagaaaaaagcatcaatggtggattaaagaaaactgcaaattctttgatatttttcccatttagaggcggggtctactttcccttttcttgaatctaggctgacctgtgactgcttcggccaactgaatagggaagagtgatgctgtgctgtttccaggcctgttctttaaaagtacttggaagcttctgccttggcctctttgtgcctgagttgctgtataagaatctgactaccttgctggagagaccttgtggagaagacttgaccttatatgcagaggtagaggggccctggttagtccagccatctagccatcctgtcaaaatagcaggtatgtgagaaaagctgtcttgattcctccagcccagcccagccaccaactgaataataccaagtatatgtacctcaaatggaggaaaagaactgctcagctaagtcctgcccaacgtcctgactcagaagataatgacagataatgaaatgattgttgttttaagccactgtgttttgaggtagtttattacacagcaatggatgacagaatagtatttatatatatatatatatataaatatatataaatatatatatttatataaatttatatatatttatatatatatatgtaaagacaggtatttgggaccaatgcctggattagcacttaccaggagtcccctttccccatctctccatcccatgctgcagtttgggttgtattccttgctcctcagtcacctggagcatccattcccctggagctccatgagccctttggactcaagagggcaggggtttgccctgcagtgcctgctgaagtacatctccaggtagtagagcaccttggccatgcacagtgcatctggcagagcagtgagggctccattttgctcattgcactcaacatctccagggactgtggggttccctgtcagaccttgctcttctccatcctccctccaaggagccttggataaggcttctaacagcctggaggctccaggcagccaggccctgccagactgccctgagggccaaggggattaatatctcacagcacatctgtaactgattcttggcattccagggagtctggcacaactgtgagcagctctgaattaaatcaagcttcttaatttgtgcagctcaatttttttttttatttatttttttgagagggagtcttgctctgtcgcccaggctggagtgcagtagcgcgatctcggctcattgcaagctccgcctcctgggttcacgccattcttctgcctcagcttcccgagtagctgggactacaggcgtccaccaccacgcccggctaattttttgtatttttagggagacggagtttcaccatggtctcgatctcctgaccctgtgatccgcccgccttggcctcccaaagtgctgggattacaggcgtgggccaccggcgcccggctggctcaaatttttaaaattcttactaattttttatttgctagatcaccccctttctatcttgtcctttattatccatttaatcctatcctttttttgaaaccctaacagtcattattgttgtgctaatcagctgcctttgctttcagatccatttcctgcccttcttttattctactctgtattacagccaaccacatttccaggctcccttgtcctctgctatctaggtgagttttgtcagtggaagacattggtggaaggttggatgcttcttcttctagcatctctggtggtggctgtgtttcctccctgactccagctcccactgggtgtcattcactttgtggttttggtgcttgcccaatggcctggcttctgagccctgcttctgcagcccagggagagtagcagcagtctgctgtttttagtgtctgggttgccactcttttcctgtttgacctctctgggcttccatgacccacataagtcattaaattccctctgtcaaaaagacttaggttcctgtttcatgactggatgctgactgatattgttattaccattgtaactattatcgttgttattgtttttattattttatactgccaatgcctgtttaaatttacccatgtgttttcaaattactttgatcaccttgcattttgcattccacttctatacttttggttaaagttttcttctttttgcaacatatccctagcatttatttctataaaggtctgtgttttagataacttacagattcaaaattttaaaatatggctttttgtcatttacttaagatctgtatgcaagaagaaatgaaaaagatgaacaggtagagtccaggactacctaccacagctcaggtcaacattaattttatgatttaattaattccataaattctcttttctgtatgaatataaggttcctccctccctgtactcacacatctacctcttctaggagttgccttgggatccacaaagaaattgaggtggtccagtactcataagccaacaaacttcaaaggagagtcaaatgtacattttcaaaataagagtactgaaaagcattgaaataaacacacaaaaagagattcaaatgtacatcttaaaaggaggaggagattctttgaagaagtaggggaatatgacgttgaaagtctctgaagaggttgtgatagttgtttaagggagtagaacattaaaacatttttgtctgttcaatcttaatttttaaaaatgatagcatagagtttggccaattatggaggggctgatttcatcactatcaatgagcagtaaactttcttggtcttttatttggggaatgtatttattttactttcacttttgaatgagacttagctgatgcaatggactgaattgtgttcctccagaatttgtatgttgaagctgtaagggcaaatgtgactgtatttggaggcagggcctttaaagaggtaattaaggttaactaaggtcataaagatggggcctaacccaatatcactgtccttataagaagagacacccgggatgcatttgcacagagaaaaggccccaggaagacactgcaagaagagggtgctcttcaagtcagggagaaaccaaacctactaacactttgatctttgacttctgggctccgtaactgtgaaaaataagcttctgttgtttaagccacctaatttgaggtattttgttatggcagccctagaaaactaaatacagctgggtatagaattctaggttgatgattttgcttttatagtatttttataatattttgagatgtgtgtctttgaagttctgcagttgcattatattgtggcttgctttggatttgttacatttaagctttatttatccttcctggaattcattacagtttttgaacttcaggattcaagtgttttaatcattgatgaaaacatttcaaccattatctcttcaagtattgcctgtcttattttcctctatttcgcattcttggaattaaatctgttggttctccttttccgtcttccatgtcccttaatcttccatattttccagatctttatatctctgtgcctattgagtaatgtctaaaatctgttttccagtttataaattatcttgctatatcaaatctgctatttaacctactcatttaagttttcaatttccttgacatatacctatgtgaatgggtgggtttttacttagactaccttttcatgtagaatatgtagactaccttttcatgtagaacctagcttctatgcaaggttctcaattccaatttcctgtccacttgggcccagtgcttacctcatgtttccacatgagcgtgaaatcacaagcccttgggtgaacagaatcagtaatcactggtcgggtgcagtggctcatgcctgtaatcccagcactttgggaggctgaggtaggcggatcatgaggtcaggagtttgagaccagcttggccaacatggtgaaatcctgtctctactaaaaatacaaaaaaaaaaaaaaagtaaataaataaaattagctgagcatggtggcatgcgcctgtaatcccagctacttgggaggctgaggcaagagaattgcttgaacccagcaggtggagattgcaatgagccgagatcaccccactgcactccagcctgggtgacagagcgagactccatctcaaaaaaattaataaataataataatagtcacccttccacctccatagcacagctacgtcatgaactgacaccttaaaactttgttctgttttcaattatctcttggtttctgatgcctgggtatttctttttctttcttgagagcttaagcatgaatataaaacatttcaaattttatattttatccagtatttctagctttttaatagtgagatttatcttactctcccattttattaaaacagaaagtcttgagtaacattttaatactgagaaaaaaagcctcattattagttttagaaaaagagagacaatctgtgttgttctggaaccaagacaaagttctagaagattctctcttgatccttaaacagcatagaaaaaccaggtaagttgactatgttcacgtttaggagtatgatggccaatggatccaaaacctatcctatatctacatgttggtggccacattaatctgacatctgacagcaagagcgatgattgggttcactggaaatctttgtgaagtacgagtgaagtccttgtgaagtcagagtaagtatcagaactttgagttctagtcttggctctagactgattcaaaaggtcagggcctaatcaatttactcattaacttataattgtaattaattagattttattaatacaagaataaaagaattgtccagcacctactaagccaaatcctagagatatggagaagcagataaaagttgctgctttcaaagaacacagttcactaataggagactggcttggaatcatctattctataagtgaaattttgatggattattgttgaggtgcaaaggatggagcagtcagttgaatcttgctgggggaattgtaatcagaaagctccgagaatagtaaacgagagttttggaggcctaagatcttggaatcacatgtgtagaaggatatttaaggtgtgcaggctcctccatgagtagccccaatgccttgagtggaatggatgcaaaggtacggacttcttgcatccttcccaggatatcaggaggcttagagcaatatctgcaaaatgttggcgattgctgaaacgcagcgctacagcatccatggggtcttgcccttcttcaaccattcagtaaatagcactcagtagagattctggctgaggatgcttgttttcaaaacaacagccctgagccaacctttttaagtagttccatatgtttttatggagagtttatggattgtggccttcggaattcttttgtttatcactgggaattcaagtcctgaaagctgctaactaaccatgaggtctgctggttatacaagctgttggacctcttaaggacgttgacataaggaccactttctgtgaaataagaattagtggtttaaaaagagtgcacttaacagtatcatgtaagtatcagtttctgtatgtcattactagccaggctttttttaaaaaactggactgtgctgccttgtgtgtacatttaaatgaggcccttaaagggaaatctgagcaatgtcttcaaacaaagacttataatcagaagggtctttttaaaaaaaaaaaaaaaaaagaataactatcttcagcagacctaaaaccaggatggaaaggtggatacttccccacctgggccccaaagcagggcccttcaaaatactgaaggtccagcattccctgggcaattcttcctccttctctgtcctccccacccccatcaatacccagcttgcagtgatattcttttaccctttactaatctaatgccaaacacatgtaggttctatcctgtttccaggaaagaggtttccatgaattgcctcatcagccttactaatagctacaatatatggagcactttgtgcccagcactcgattccttttatacttgatctcttttcatcctttcttcacaatagccccatgaggtgggtgctataattatttctaattttacagataaggaaaccaaagctcagagagtctgagcaatttgcttaaagttgcttaacagctgtattagcctactacttataattcgactacctgtgtccaaggctacataaattcaggtcgcctgactcaaagctcttattcaacgtgctagcctccttcccactagatctcataagatctagcttgatctctaaggctccattccagcttggaagaactatggttcttctccagtgtcagttgtgttgctgttcatgttgttttcatgtaaaacaatgtaagaaagaggctgataatctccctccatgaaacagttcttcacacatttaaaatcatccatggctgatcataaatgcttctccagagagtgaatggtcatggctggtgcagaagggtaacactctggaaaggcggatgtgagacctggcagctctgcctgggtacacatagcttagggctgacaagtgagtcagcagaagtgagcagacaatactgcattgggttttaacgtgatgagtcagccttgctatctggccagcttcagtgcagccccctgaagttttaacagaatattaattgccctttcacttcccattccacacagctgggtgggattgctaccagccacactgttgagaagttacacattttagcccagcctagaaaggtttcctgtggtgggtgaaatgacaacatgcacaaaggtcaaactccagatgtgggaatctgaccttttctcctcttggggaaaacattgcctcattataatctcaaaagatttttggtacaggtttaaggctagagtctactgaaagatccaaactcctctaacatagaggatgccagcctgtttcatgtaaatttatccaaggctttgagaccacctacaaaattcctgagccaagggaccagggaatgtaggcgaatgtttaggcatttctgaaggagggagctagacctagaagttgctgcttgctcctagaagttggaaggcatttcaagatgaggaatgagttgtttctggattgatgccttcactggctagaaatgccagcgggtggtgggaagagtacatggcaggatgatgaggagtttcgcattcattcattcatttattcatctgtgtattcattttacaaaaattcatatcagatttgcaaaattcactcacaatacactcagagataataaaaaatgtaacaactttttttattaactggtggaatatttctctcaaatttccaccactggaccccagagtgggaattcaattttagcccaatcttgtaaacttagttccaatgtaattatctaggttgagctaaaagtttcttttcatctttcaggtttcctcttcatgcctctactcctatgcagtttgacctctcagtgtgcagctggtgatagatggaaacccttgttcataagctttgtggcactgtcggcaggatgaggggacttctggatcctcactggtcactgtggcagagtggttggtgttgtctgctccctagacaggaacccactgaagaatctgacattttttgatatgctggcattcattgttacagcccatcatcccagccatcaatccaggacatggggtctgtgcccacggtgggaaggaggagggggaagctggctttgttctgacgttgggcttcttctgctccaccagtactttctgtgggggaaataggtaaagaaatggctgttcagatgagaagatgtgtcagtaaacttttgctacagtgatgctgcaaaacaaatcactggtgactttcagtggcacacagcaataaacatttatttagctcagggattgacaatctttttttttttttaaagggccaaatagtaaatattttaggtgtttcaggccatacagtctctgaactctgaacttgtagcacaacagtagccttagatgctatgcaaatggaggagcatgactgtgttccaataaaactttatttatggacact

SEQ ID NO: 95 - DNA, 18132 bp, Homo sapiens
ctttcttccatgtgcacacgctgatttctcaacctggaatcatttccctacacctttcctcaaaggactgttaatgagttttcagaggtaagccctattcctctcctctggagaaccttccctgagtgcccagtctgagttgaatgtcccccttcccactacccaatatctccccctgaactccaggcatctctgtcacagcatgtacctcacactgccaagttcccaaagggcagggtctgcatcttacatatttaggtatctgaatacctagtgggattcctagtatagcctctcagtgcatacttttttttgttttgttttctgagatggagtagcagtctgttgcccaggctggagtgcagtgttgcgatctcagctcactgcaacctctgccccccgggttcaagcgattctcctgcctcagcctcgcgagtagctgggactacaggtgtgtgccactttttaagtacatgcatgaatttcaagaggttggaaagaaattgtatcaccatattccattacaatgagaaatcaaagaaacaatgatcaacaagtatcttcaagtgccatgcaataaaacagcatcagtagggtgcagttcgagtcatcaggaggggattgagcagagagggtatggactgctgcaaggaacattacattgtctgacaatactaggatgaaacaagacaggagaactcactagatatatttgcaccataagtaccatgcgtgtgattgtgggtcacagggatgagagagacaaggaactgagaggccaccaacatctggctgtcccccatatattatctcatgccatgtgcacaatagactttggagatggaaatttacatccccattttactgaaaagccagccacagggttcacaatggagtttaggtggaaagtcccgataaatctgtggcaatcctatcccaggcatagtgagatcagctcgttatgtcaggcttgggcttcctcaaacaggaagtttattcaaagtcttacaaaggcaaagggcctcgccttttggttcttcttatgtcctataacgcctagcatgtgttacagcctttttagtactcagtatgtatttgttggttgaatgaactaatgagttaatgaatgaataactgtttaagtataaggctcaggcactctaaattcttaacatggattatattatctaaccctcacaatatctatgattatcccccatttcacagataattaaattgaggttaggaaagtttagaaagtttactcaaagtcacacagcttgcaaatgacagagcaaaaatttccccaggcctttctctctcagagtccgtactcgtaaccactctgctacacagcctctcagttaaaggattcctctgaattaatggatttctctggaaagctcagctttctcaaaagaagatagatggtccctgatgatccaatactatgagaaaaaaaaatcacaaaacacggggatttgagggttagttcaaaatgtggcaaatctaaaaatacactggcttcacttttagatatttgtccaagaggggtagaacaactttaattagtgtaacaggacaataggaattaaattggcttggtcacaagattttttacaggatgacactgatgttattactatccaacttcaaagatttgggaagatgttcctgctaacactggagaatagaaacctgtttttcatcaactaggctggcctgacaaattaagtctgtggagtcattagattaagataagagcttatctcctaggctgacatttattcagaggcttttatactgctcagctagtaattagtgctgttgaatttttgactctgctttgtccagtcattcaaaaattctagaggtatatttacatctcttatgtatgtttttggttattaaaaatagaagaggaatgcaagtgaattactgtagaaggtttaaataattcttccaaaagttattctgtggtgaaacatgcagcttaatgacttttttgcagaagaagggagcagttctcccaattgataaatgttgaataaaaagttgctttttactatgagatctataatttttttcgaggcagacatataggtttattatgttatagtagaatcattacaactatgatcacatgcagtaatggtttcctgctatttcacacccccaattcagcaaacatactatagattgagggtatagctcaaagttttgttctttgggtttttttttttaatagtttctttccgatggatgatttgactgtgaaaagtcttatttttccagttttcttgtagttataataacaacttgattgctatagaataaactaataccttaagcctgcacacgtgtcttgacagtctgtcaaacaaataatactcacattttttaagatgcttggtttgcaaattccaatttctatgctgaaatactaatcagtcatcagatgggtaagaacccctgttttaagaaagttcatcacatggttaaagttgcatcctgttaacattactatcacatcatctattctgtcctaagtgtgaacatctctcatcactcaacatactgcattcgccactttcagaaaaatgtggccaagagaattcaggagggacaagtaaaagatttgactctactagctcaccttaacatcacccaacaggaagcctcagaaaacaaacaaacaaacaaacaaacaaacaacacacacttaagatatccagtctggaagacaagttctttttcattaaaatgtgaccctcgtggttttgtagttaacaggcttaagttaaagtcacttgctaatcaatctccatgcgtgatgggtatagaacctcttgtcatgtgcacacactacccaaggggaacttgaaagtatttgaaattattcatgtttgttatgatacacaatcatcctttctctgtaccccaagtaaattcaactctgctcttggcatcctcattacgtagtctagcaaaaagtacaggccctagtttaccacttcaacaagtcattgaacttgttttcttaatggaaaaataagaagttagctcagtgtaatctttaaatataaccctcagggtcctgcatctcagatctgtgatctgatcttcaaggcagaagtataagaaacgtaaatggacagagaaaatcacaagggaagaatataccactacgagtttagattcatctgaggaatttgtagaattaattctgaaatagtagtacagaaactgagattatatttagtcatagaagagagatcagagtatatttgttggatgaatgcatgaatgaatggagaggcagcatggaatattgagatttggaatcagacacacctgggttcaattcccaatgctcccacatacttgttttgtcaccttggaaaatacttaagcctctctgaccctacttcttcattactgctagcataataactagcccatagggttgttggcaggataaacaaaaacctacatgagcacatggtaggtgctcagaaaaacatttgttttcatttctttctcctctacgttgtttttgttttctgtttttttgtttttgtttttgtttttttcattctctggttccacataaattaagttataaaaatatcaccatccagctttcaaattcatgtattaccaattactaccaacacatttggtatgtgttattattatgttttgatgtgtactgaaaaaggaagagaagaggaaaagcatagcacttccctccaactccccacgggtaatcaggccaggggaaggtaggtgtcattcaatgtgtttacaatgtactccatctcagtactcagcctttcttaactcatccaccacccccaactttctgaagagcaacatgtaattagagcactaacgaggtcatttagcagaaaccatgggcagggagtaatgaatgtgctatcaggctcagagaacagcttgggcaaaaatccaaacagtccatgttcaactctgatgagccaacctaaacttggaaaatagagcttggaaaaaggttaataataggacaccgaaaatgaaaggcccttctccagagaggcccaaagcaatgttttgagcacaactcttggagagctgggtggtgcaggcagtggttgggcatcatgagaagcttggtagcaccttccaccttcaaactaccagggatctgaagaatgcaaagcctggaaagcgttgagaggtcatctcattcaatttccccattttacagatgtgttcagagtgctccagagacctgaatcagcttaactggccaattagaaacaaatccagacttagtaccaagtcctacagataaccagggcagtgctggactcactagcctatgctgtctccttgcctctaaaggtgacatttaggagaccatttagacagtgtaccaagagactttaaatgaggccagctttacttgcaccacttctggagtaattaagtcccagaaaaataaacctatctatccaccagtttgcatttggaattagcactcttaattgagttacaactgctaagattatgaggccaacatcatcctgataccaaacctggcagagacacaacaaaaaaagaaaatttcaggtcaatatccctgatggacatctatgcgaagatcatcaataaaatattggcaaaccgaatccagcagcacattaacaagcttatccgccacgatcaagtcggcttcatccctgggatgcaaggctggttcaacatacacaaatcaataaatgtaatccatcacataaacagaaccaatgacaaaaaccacatgattatctcaatagatgcagaaaaggccttggataaaattaaacaccccatcatgctaaaaactctcaataaactaggtattgatggaacatatctcaaaataataagagccatttatgacaaacccatagccaatatcatactgaatgggcaaaagctggaagcattccctttgaaaactgacacaagacaaggatgccctctctcaccactcccattcaacatagtattggaagttctggccagggcaatcaggcaagaaaaagaaataaagggcattcaaataggaagagaggaagtcaaattgtccctgtttgcagatgacatgattgtatatttagaaaactcagcccaaaatctccttaagctggtaagcaacttcagcaaagtctgaggatacaaaatcaatgtgcaaaaatcacaagcatacctatacaccaataatagacaaacagagagccaaataatgagtgaattcccattcacaatggctacaaagagaataaaatacccaggaatacaatttacaaatgatgtgaaggacctcttcaaggagagctacaaaccactgctcaaggaaataagagaggacacaaacaaatggaaaaacattccatgctcatggataggaagaacgagtatcgtgaaaatggccatactgcccaaagtaatttatagaatcaatgctatccccatcatctaccattgactttcttcacagaattagaaaaaactactttaaatttcatatggaaccaaaaaagagtccatatagccaagacaatcctaagccaaaagaacaaagctggaggcatcacgctacctgacttcaaactatactacaaggctacagtaaccaaaacagcatggtactggtaccaaaagagatatatagaccaatggaacagaacagaggcctcagaaataacgccacacatctacaaccatctgatctttgacaaacctgacaaaaacaagcaacggggaaaggattccttatttaataaatggtgttgagaaaactggttagccatatgcagaaaactgaaactggaccccttccttaggccttataagaaaattaatttaagacgcattaaagacttaaatgtaagacctaaaaccataaaaaccctagaagaaaacctagccaataaaatgcaggacataggcatgggaaaggacttcatgactaaaacaccaaaagcaatggcaacaaaagccgaaattgacaaatgggatctaattaaactaaagagcttctgcacaacaaaagaaactatcagagtgaacaggcaacctacagaatgggagaaaatttttacaatctatccatctgacaaagggctaatatccagaatccacaaggaacttaaaaaaatttacaagaaaaaaacaaacaactcaaccccgtcaaaaagtgagcaaatgatattagcagacacttctcaaaagaagacatttatgtggccaataaacatatgaaaagaagctcatcatcactggtcattagagaaatgcaaatcaaaaccacaatgagataccgtctcatgccagttagaatggcaatcattaacaagtcaaaaaaacaaccgatgctggagaggatgtggagaaataggaacgcttttacactgttggtgggagtgtaaattagttcaaccattgtggaagacagtatggagattcctcaaggatctagaaccagaaataccatttgacccagcaatcccattactgggaatatacccaaaggattataaatcattctgctataaagacacatgcacacatatttttattgcggcactattcacaatagcaaagacttggaaccaacccaaatgtccatcagtgatagactggataaagaaaatgtggcacatacacacaatggagtactatgcagccattgcaaaggatgagttcatgtcctttgcagggacatggatgaagctggaaaccatcattctcggcaaactaacacaggaacagaaaaccaaacgcggaatgttctcactcagaagtgggagttgaacaatgagaacacatggacacagggaggggaacatcacatactggggcctgtcagggggtgcggggctaggggagagatagcattaggagagatacctaatgtagatgacaggttgatgggtgcagcaaaccaccatggcatgtgtatacctatgtaacaaacctgcacattctgcacaatattcctaagtaggaaagaaataacttagtcactattattacttaaagtactaacaaattaaaattcattggatggatttgttccagggtcgctttcatttcaacaagtagttattaagcacttaccacatacacaacactacaaggcagtttggggtgaacacaaggtatagagcattcaatttctgtcttgagaaaccgaccctcatttgggcagacctgacatacctacaaagatagtggagaacaatgaaaggaacaaattaaaaatcctaggagtctcttacctcttgcgaaatatatatttttctttcatttaaaatggcaagtgaagagtatggctttggaacaaggaggcatttatttgcgcttttgatgtgtggttcctctctaagagccctctgcttgggatggctcttccacacaactgggttccccagagagccacccctaggaaccagagttttcccaagagcccttttcctgttatagggcatcctatattcctcacacccagatcctatgcatatgccccttggttctcccataacctatatgaagccgggagaaaatctgcctcacagggtatggtaagcctcagtaagatggtacaatgccaaaaataatgcaaaagtgataatggtgcctcgaggatgggggcctgggtgggcagttcttgttcccctaacacagtcttcattgtttgtcttagaaaataatgtcacagtaagagaaagctcttcaaagcactaggttaccaacaaattcaggtctcggtataaaacaatgtagaacaagtattaatatttatggccagagttgctgcccagttgtttaaaactaaggcttaccaagacatttttctctcctccatccctcctaattatgggagtacccaatcagaatctgatgatgctctctggtagtgtgagagacaggctgctggattggaatccagactttggagatttgaacccagattcaaattctagcttaggaatttcagagctgtgtagtattaagcaagttgcttaacctctctgaatcgcagactcctcactggaaaaatagagatgctaatggtatgtacctcacaggatgattgtgaatattaaatgacacaagacacctgacacatagtaggtgctcgatgaatttttgttatgttttcagagcaaaattccagcactgtctccttcaaggagggaaaaacaaaacaagaaacattttcaggatgcaacagctggtgctaggaacggatgtaaccacatcaggggagagtgccacccatcctcagagtcaaatgtactttatggatacagcaatttgcatcctgtcaaatgttccctaacattttgcaaaaattccccaaatgtcaaattagtgagtaatctgtatagtactgcagatcttgttatcctctgactgattcataacatattttgggtgtcccagacaccaatccaagtaaatgttagtaaataaggaaaatcacatctccctcacaagctctgaaatcagtaccagcttacacttgcaaagaaagaacataaacctggaggcccagaggtatttggagttgattagagtgtcaccaatcaatacttgcctaacactgaccatgtgcccagtcctgagactgtactctgaagttggggtcagagtacagactggggttgcaaatctcaatcactgattctatgctagccatttggctttataccttttcttatttagtcttctcaaatgtcctttttatttatttagcaaatactggaaaagtacgtgctatgtgaatagtgcttccctaggggcccacttcttgggagaaccccttcatacaagtgggttataaatgctttaccatccccataacaacccaatgaggcaggcatcatgcttatgtccattctgcagatgaggaaacagaaggtcagagaggtgaagtggttgcataaggccacgtggtaagtggccgaggtaaggtaggaactgagacagtctggctcccagagtctatactcttaaccattaaatactcccttatgaggtaggtaccatagttatccccattttacagatgaggaaactgaggctaagaggggttaagtaacactacccaagatgtcatacagctattgggtggtagcagatttgggattttaaatgaggtctgttcctataaccctgccctagaagacaaggttatagcttatacaaaggcaaaaaaaaaaaaaaaaaaaaaaaaaaatcttgccttaagtagtttctagttttgccggccatgcagtgaaaaagatagagatcttaagaataccataagcaatgaacgtcaaagagctccactcttgtacgttcattactagtctctgaactccagaatcagagagacttttctcaaaacaagactgagggctggcctgagaaatgcttctctgttttgcttttgttttttgtttccctgacttgaagaaaattgagatgaactcaagttgctgaagctgcaagatatatatttatatgctttctttattatgtgtgcctaaaccttgtttttttcactctgttaacttttcaaaaactattaagaagaagagtgacaaaatgctgtgggggcacaggagagggaggacaggaaggaggtggcgggtagattatctgcaaaacagagtgcttttccgagattctctttttcccttttctttttcacgttactttttattttattttaaattccagagtacatgtgcaggatgtgcaggtttgttacacaggtaaacatgtgccatggtggcttgctgcacctatcaacccatcatctgggtattaagcttagcatgcattatctattatctcccccagccccacccaccccaacaggccccaggatgtgttgttcccctccctatgtccatgtgttctcattgttcagctcccacttacatgtgagaacatgcggtgtttggttttctgttcctgcattagtttgctgaggataatggcttccagcttcatccatattcctgcaaaggacatgatctcattcctttttatggctgcatagaattccacagtatacatgtaccacattttctttatccagtctaccattgacgggcatttgggttggttccatgtctttgcaattgtgaatagtgctgcaatgaacatatgtgtgaaggtatttttataacagaatgatttatattcctgtgggcatatacccagtaatgggattgctgggtcaaatggtatttcttttctaagagattttctatccagctcctggctcctctttgtctcttcagggcttgacagagagcaggtgctcagtgatgttggactggaagttttgaagacaacaaaagcaaaagtcttgcttttacacattgctgttagattagggctattaatgatgattattggaaaagaactggatttagtagctggaaaacattagcagctacatagacttaactaaattcttacactgcaaacacaaatactggaaaatcgtcttgctctatctccttcaggaaagggccactactttcttttctcatctctttcctcagtgtccagtaacactggcgacagcctgggagtatttacctgagacagagggaccaaaagagattgcttcacttgaggccccagaagccccctccacctctggtgttcaaagcatgagagtcagagaagtctgcacctcccaaaccccactctcctttgcttccccacatacagttactctccaagtcctattgctcataacgtcatccactctcagacccaactaaatttcctcattcgcactgctcccaccctgccccaagccaccaccatctcctccctgattcctgtcacaatcctagcttgtctttctgctcctagcttgcccgctttaatcatcatccacataacagctaaagcagaaatctgattgtgtcatcagaaacctattgcctttaggattaagtccaatctcctcagcttggttgacaaggctgtttttctgatctgacccttgtcttctctccagtctcatttctcccacccttgcccctgtgtttcattcagagtcagtgtttgcaggtccttacacattagccacgcttcctcatcatcctcctaattcctgagcattcttcttgcttagctgttgcctcctcgtccaggcccacactcctctctctgcagctcagcaacctgatctagtgccattagccagcacggccaagatatgctgaaaccccctctgggaaaccatcaaactgatggctggcatggactgcagagtgatattttaaaagcacaaatcaggctgggcacagtggctcatgcctgtaatcccagcactttgggaggccgaggcgggcggatcacgaggtcaggagatcgagaccatcctggctaacagagtgaaaacccgtctccactaaaaaaaaaaaaagaaattacaaaaaattagccgggcgtggtggcaggcacctgtagtcccagctactcgggaggctgaggcagaagaatggtgtgaacccggaaggcagaggttccagtgagccgagatcacatcactgcactccagcctgggtgacagagtgagactccgtcaaaaaaaaaaacaaaaacaaaacaaaacaaaacaaaaaaacccacaaatcagatcatatcattttgcttctacaaactctccaattcacacttagagtaaaattcaaagggcttttcccctagaaaaccttactaaatctggcccctgcccatccctccaacttcctcctatataatgctctgccttgttcattttgctccagtcacaatggccttctatctcttccccaaaactcaaccacactgttccagcctaagggcctttgcccaagttgtgccctctgcctggagctctgttgtgtcagctcttcatattgtccaagtttcagctcaaagtaacttcgtcagagaattcttccctgatcattaaccaaagtaacaccctcaaagaaattccagtgccttcacagaatgtattgctatctaaaattatttggttcttttctttactgagatgtttattgtacctcctcaactcacatgtaagctccataagaaaagaacgatttctatcttactcacagctgctctcctgtgctcagaacagttcttgatgctagcaagtgcctagcaaatatttattgaaggaatgcataagtaaaaagagataaagaggaaagttagaggattaaaagaacaggtgaaggactttgcaaatatattcccattattgcttcgtagcatgagtttcttgcagaaattatgagatccttttggcaataccactaagagaaaaggccactgtgactcccatgccaagatatctcaaacacagacgtggtgattcttaatagatagaagcagagaggtgagaaccgcaaaatctttaaaactggaagaagcctccaatatctttataacccaatccattcatgtggtgatagagtgaaagcctggaagagatcaagtgacttaccaaagactttgccactagccaggggcaggccaggagacaactgaggtatccagtctagttgatggttccatattttgctgccctttctcatattcatttagcagccatacatgaaagggctggaacaacgatatctgtttggctcctgggtctgctggaaactcttccctaagcagttattactttttctttccacgtctggttactactgctgcataacaaatcacccccaagatttagtggtttcaaacatcaacaacaggtgcagtgatggattcatgcctgtaatcccaacatttggggaaacagaggcaggaggaacacttgaggccaggagtttgagaccagcctgggcaaatatagcaagaccccatctctgcaaaaataaaaataattaaaaaaaaaaaaatttaaatttaaacattaaaaaatcaacaacattttattatctcttattgtttctgtgggccaggaatctgggaatgttttggctaggcttgggatctttcatgcaggtacagacagagagtggctggagctggccaggcatctctctctctcttttcatgtagtctcaagacctctccttgaggtttagtttgggcttcctcacaacatggaggcctcagggcagttggattgcttacatcaagactcaagagttcaagaggcagtatttcaaagtcaaaagttgcatcatcttttatagtctagcttcagaggtcaaacagtatcacttctgccacatcctattggttacaagtgagtcattagcccacccagattcacgaggagggtaattagactccatctcttgatggggagtagcagggttctggaaaggatgtgggctaggaaatactgctgcagccatctttggaaatacaatctgccacatcacagaatgcagaggttattttagacaatcagaaatgccgtctacagtacctaaaatgccatctacagtacctaaaatcaaattcatcgtctgatgcagatcatctaaaatgaaagagtggcacccaggaaactccaaagcacagcagcataaggcagcaatgagctccggttctgtgctcccataaaaatgacccaaatatttgtccctgtttattgcaagtttgagagcctctgtccctgcatgagcctacatgtatgtccattaagagtgcagctatgggtatagatgattatatagaaatatgcaaaatgtgactcccaggtcaggcctttatgggcccagattcaatgtgggatgcagttttacagcccagttgtaaacccctggaaacagaggtttataacagaagcactgacacaacttttatctatggcggcaagaacagtgctacggtaataggcctgttcctctgtggctaatgtcggcttgaagtatctttaaatctcaacgttccttccagcaggtacttcactgaaatgtaactaccacaatgcatcctttccatgtgactaacttcgctcatggaccagaatcactgtggctctgccctggagtggtgcaaagtaagctgccttcaattacaggatggagggggagtgaggggtggacgtgggcatcttacccttggtcaggatcaaacagtctttccagtttcacagaatgtcatcagataattttagtgttagaagggaccttggagagcccatagtctccctctttttaagatatagagaaacaggcccagagaggtgacatgatttgccctgagtcacacagctggttagaggaagatcaagttgactcctgagtcttggtgttacactttccccattataccaaatctttgatatgatactttctctctacacacataagagagtgtatacacacacacacacacacacacacacacactcacaccacgacctcagtggagagaactaaaactgattaatctgcagtccggtagcagtatgctttacaggtaatattatttgcaacctactttttaactatctgtgagaccaacttgtttaaacaggagaggaagcccatggcacaaagggatcttcatgttcctttggtatattaggagaggcacccagttaaagagtgttcattactattgtaaattcttgccccagggcttgtatccttgcgctagattacatgaggtctgtgttcatggacagcgtttggcgtctgattgaaggtccagcgcagctaattaatttcattaggaagtgaagtcatcttctagcaggaattaatatttggagcttcgtgttgctaattcatttccagatttaattagctcagagaagaaatgttgcttgggcaagaggactttttaattatcagcttggataaatttgaaaatgttgatgcctaggggttgagttaattaaaacctgcattattttaactttaattagctcccatctttgttttgcttcaccatatggccatgtcctgtagtcaaatttagttaattaagctaattaagctaatcattttaattactcaagacaatatgattggatagaggatgactacaagtttatggccaagtacttctttttcattaagttgaagggacagagttatttctgattgcggctggcaagcagtgctgcggagttcagggatgtgacagcctcagagatattaaggctgaagtctaattgcattacttgataaaaacaaaatgtcactaacacaactctttaaaagaggagaataatttagtgctacatctattagcattctggacaggctgacttggtcagggtgcgctggcttgctctttttacctaataagataatgaagcaaacttactgagctgtggaatttactaatggagatctaggtattagatggtgaaatctccatcttattatagtggtgcccagtagtgctgctatacttatgggcctgccatcgtttgtggcacaaacctgtatttttaggggttcataactctgctgtaaaacattagctccaggctgagagttggcctaagagggcccatgttaggaatgcttatttatagaatgtggaactttgcggggaggaaggcaagagtcaggctgtttttatggcactgcttggaagatggagttcgctgcatttgtcctgagcctttatctctgttgcagctccataaaggatttgaaaattcagcccaacaaaggaaatcttcttaatctggcttttctctgcttccccaccaccatctcagggccccccaatccaagtacctgatgacagtgacggccttttccagatagtcacacgccagatagcgacttttaaaaataaggttccatgagcacagaacaaaaaggcttttcccaaagccttcatgagactacttggttctccacgtacatgggaagtgattctctgtatggttcagaaggaaagatttaaaataacctctagagtagtcttttgagaaaataatacgaattgtaaaagtagttcaaatatatgttttgggaggctctgctgcctccagtatgtggtttctagaaagccggtttttgacctctaacatacgggcacattttctatgatgagcatatagctcccaggatggagagatgctaacattcttaggaataaaggatgatccacccagggatcactggggtaaaaatcattttaaggccatggctgtaatcaacagaagtcaaagatgtctaagagcagactgtaattccacaccttcacataaggcaggagtactgcagcactgcctagaaagagataacagcagctcagaattaagtcaacctagaatcctgcaggtaatatgtatttttattcatttgttcattcacttgttcagacattcgacaaagattcactgatgccaggcactcttctggagaacagggatatggaaataaatgagacatattcttgccttccaggagctcgcattctgtttggaaagcaaattatttaaatccagtagaggactctcaaatgtggttggaaaatctaagaagacttcccagaggcagcagcactagtgttagggaaagagctcacaaattccattgctgtagaatccatgtgttgaagaccgctacactggaatctagttttctatcctaaaatctacctcctgagtttgagtaagacttgaactagtttgcaaatatctgtgatcttcaccttgcctgcctgcaaagcccataagcaagttcagaagagacttctacttgtccaaagcaacatggagtaaagtgggtcaactagaattaaaatatgctccagccaaaggtttgtctcatagaaaatggaaaaaaataaatgctacagatatagtgaagttcctttgataaatgagagtgactcacaattggggccatttttagaaaatgtaaagaaaaattatgctaaccaacccagagctccactcgcattattttaaaagtagctaatgagatttgataaatctctagatggtgataggaaaaaaaaagtgctctaaagatctctaagattgaagacacaaatggcccaagttttagacacttcctcccagtttattctataaccaaacagaagttcgacagggttgagctacacactgcacaggtgacacagttctggttcgcacatgggcttccaagtggggcaaatctgtgtggcctcagcacattatgcaaacatgcagaacctccatttccttacctgttaagtggcagtgatgacaccttacttgaggggctatcacaaaagttaaatgaggtacagtacctgacacataacagcatagttcatactcacctagatttaagcatgagctctaccatgtactgaacatatggggcaaattacccaacttttctaaatctcagtttccatatgtgtaaaatggatccataaaactttataggtattatgagaattaaacgagtaattgcatacaaagtgctgagctcaatagttgttagctctcattgaattactagataaacaacaaatgataattccttcttctttcccaaatagctatgaaatgggaaataagtgtcattatccttttgaaggaaagtgtcatcaaaaagccgttacaactattaatattttcacatgtaaacaatgatagctggctcaatgtctccttcccaaggcaatcagatatttttaatattcactagtttgctatggttttaaatgtatagcatcaactctatgctctgatggggattgatatggcaaagctttaatcctaatatgcttttctttataggtgaccatggaaacctattgataaggctctggggtcagattcatctctgttcagacaactctagcggtgtgactctgagcaagtgttttttaacctaagttcctgcttcctcaactgcaaatgtaggaatggtaacatcttcctcaaagttgtatgctggggataacacatgaaggagatgcctgggccatataattatttaagaaatgttcatttctttcttgaactaccttctaccaactatttggtctgagtttatgaaactgtaaattttgtctaacatttgcctaacaaagcattattaccttgcttaaagaaacacacaatacattctaaaccaaaaa

SEQ ID NO: 96 - DNA, 5806 bp, Homo sapiens
acttcactgactttgtcctttacattgacaagctagataagatgatatcgttttaaataatcatttgcgtttaggtatttctctggcagttttgtattacagtttaaaaatagactagcctatgtctatggctcatgttggctatggtattttgaacttgatttctgaggctgctgacagcttttgaaagatttaacaactggcagcaagaaaaacttccatagaatctcttctctgaaattttttctgctggaaaaaagggcatcacttagcaggtaatatattgcaatgaaaatatggttatgaaataatggctcattaatatgataaaccataacataaccttttctattaaatgtaaaaagaaatttcttgaaatgaaggcattttccttcctgtggcatatttttccatagttgttgatttggaagaattttttaaaattattattcaaaacagtcattttgatttgcacaggagataacagttgttcatgacatttttatttctgcataaacagatttccattctggcgaaggttaatacagtaggaatttgtttttacttttggatataccgtgatacactagagcactttgttttgtatggaaccactaatttatcctttatgcctttacgatcttgtcagtgccgcatgtctcccttagtttttctaatctaaaataatcccagtgaaatcctttgattgtctgtttggacctgctccattcctaaagcaggaatgtaatgggctttatggcacttacttgggagtaatttatccagcagagtgactatagatacttgttttaataagaatatgctttatggtaagtgggtactgctatttaattagccaaagggaaagtagttcatgatacaatctgtcccaatcatcttggacattaaacaaaaagtcaggctaagttatttatgtgcatgcactttatttgtagttgctttgagcaaacctcttctttgaaactttatagcattttctgagtgagctgaattgtgggaggaggaataggggaagaaaaggacatgagagcattctataaaatttttgaaaaagaaacagaagctttacttattgctatcaaggttgtgaatacaggcataccaaatggaaaacaggcagggaactatgatttatcctctgctatttggtagtttgcatctttagtgcatagctgatggaagaatgttgcaggatgtcagtaagacattatgggattgtgtgttcctgtgtgtgtgttttccttggatttccattgctttcagcagcaacatgtttctgaagattcacaattatagtcctatatttttattataaataactaaatttaagaagttcaatgcatatccaattatttcaatacttaaagcaaagtgtaagcacgtggatacattttaagaaatcttcccttcctaataatactacaatgatgatataatgggggtaagtaatatgaatttctaattgtccaacagtttgggcatgtaagtaatattaatatatttatggatgaacggggaaaaaagaaaaagtgaaaaaaaaatgagacaatatccctagggtattacagccctggttatggtctgctcagtaattacatatttgttccctttcttaggcgtaaatgtctcagtcactgactataagtacaaagggcccagaagctggaatctgaagacaaacatggctccactacattttactctcattgccttgggaaacattacttaaaccagaagaatctattgccctctttacttcacagtgctacagagaggattacatgagccaatatttgtgagtgccctttgtaaagtgaatgtctagtgtaagtcagcacttgcttataaagctccttaagcataagattttggttatgaccatgtttgcacatgcttgcgcgggaccttctatatggttgaggcttcctaagtggagtctgggtgaaccagtcttctgtccgtgcccttcttgcatggtgcacaggcattttgctcctatttcttatacctctattattttgtctgtattacatatcttgcctttttcaaagttaccatgaaaactaaactcaaactaaagggctttaattcatgcagtttgtgtctgccatctaagtaacaaaagcactatcttttcacaattgacctatctctcagcagtggcacaaaaatgtggtgcatggactagagtcctaaggagtgcactgtggatgaaggactctgaatggccatccaggtggtcagtgttaagtgctaccctccctacactattgtgtaatctttgtataatttccatcttaccctcagctttactttgccatcagtatgctctctctccctctcccttctgttcacctgggaaatcttttaagctgctaaacaaaagccctaagaatggttgcatattaagttattttagacagcttggggaggttatgaaaagttttggagtcattagcatttcaacaattgactgccccactgtccccgtctttaggaaacacaggcagtgcagtcggcccatgaagtgaaagcctgggtgagcctgtgtttagtacttttaacgtaagaagacagaaaaggaaatactaaagaccgaactttccttcaactctgtggtctcacacatccctcagtgacttggaaacttttctgacatgagacagtgtgcagagcaagataaccactccccttcctcctcctgaagatgtgtaaacagctggtgcatgcaatccctctggctggagggaagtaaatgcagactgatgttaaacaaatataggccagtatcaggaactcagaaaatattacatatacaatgtgacaaggggccctgcagggttcatgatcattgcaggtattaagggtcaagagttggggtgtcagagccaataattttttttaaggctatgtatttgtttcttgtttggaattacgttggttcttttgctagagttttcttagcatgacatcacacaattgtgaagaatgttcatcactataaagctattataattcctcatttttttgttggctttaattctcaaattttatatacctacaagtcatgttactttaatcacatcttgagaaatcaatgagacgtcactttttccttcaacccatgacacttacgtgagctctggataggaataaaagtgagtggggataaaagcttctgttaactgtgcttttctcctagcaggcacatggtgttccaagttcttggctatttcataggaatcttgaatacacaattatgaactaattatcaatgcctgattcatcaagtaacactcatgacatgagtctgagtggcacacatctgacagcaagtggagtaaactaaacacactgtccctgtcctccagaactgtgtcagccttgctgatattaaagcttgataagccacaatcatctttgtcttgtgacatggtagctactcaatcaatcagttgacaaaactgaatgagaagtataaaataaaacagaaaatcaagcaaacataaagcataataggaacaaaatagaagggccaatttctcttttatcatcaactttgtaatgctggaagttctgcagtcctcagggtctaagaaaagtggagtaggcgtctatctcggtatcaggatttatacttatatttactattatggcattgaatggcttacttttgtctttctcaccagactccaagttcctgtgggcagatctcacgtcttatttcttcttttatccccacacattctacaacttctacaagatagatgctcaatcatggtttcacaatggatgaatattaaatgaatgaacgaacacagctcagtcaggagtagaactaatatgcagtaaatcctacttgtatttttcaccttagtgaggtcacttcacaccccagatggcaatctttcctatataaataagcttaaagaaaagaaaactgtgttataatcactctcagaagaaagttcagccaaaaattgccatattaagatgattagcttgtatgtaactgagtatcttaggaataattcatgtcctgtgccagttggtgagcttctattcttcttgcttgcagacccttattagagattttctaacattttttaaagggaaagggtgaactataaattatagagattgaaaatggtaatgattctatttgtattattattcataatcataacccaattcttaaggttctgtaccaaggattcacaatacatatgaatatatatgtacatatgcatatatacacacaatctaaactctgttctaaatgacttggtaaaacattttgctgtttctttttctgggagggcaagcaaaataagtcataagtctgtctgagaagctgttaggcacaatctttaaaagctttaattcttttcaaagcatacttgcatcaattacttccttcctctcatatcagcatggaaagtagacaggacaggtagggagcataacctccttttttctgagagaaaactaaggttcatgaacccattcacttggtcctcagcaaattcatatagggcactaactatgcataagctacaggagttgctggttttacaaagtaaacatggtttcccttcgagtaactgacagcctatttgagatagcattgcccttggaatcaggtaaccagggtctctgcactaggcactgagctttagaaggccctacctgccctctctgactgcaattctctccatggggcaaggaatccatggagccaaggagatatatatacccagactttgagcaatctatcttcccatctccccccacctctagaccacacactaggtacctgagactcagaattccccacccagtggggaagccctacttcctgggcttgtgaagcacctcttccccacttcaccctcccaaggacacacattcaccatgccaagggttgagagagaaggttggagagagctccaggcaaatgtagtaacaggcctgagaagaggagatagagaagtcagcaattacaatgctgcctgtggtgatatggaagtgaacagggaatgctagggaaaggcagaagggacacccagcccaaatgaggcatgaagaaggagaaagagatgggagcaaaggctgttgaaaaagaagctgagcctcggaggctgggtcagaactaccacatgaggttagaaaaagaaaggagggcattttagaagagtgaaagaaaggtgtacgcaaaggaatggtggaggattaatggaattgcaagttcttctatgtgcttgaagaaatgaaaaaagaggggtagaaaataagttgaaagggagagatggacaattaatgatatttgtcactattcattttactttcttatggcgctatgaacctgattttatttggaagtagtgacttctccccatttaataccattcggtggactaataatcaggtgccctgctttctccttgactagattcaagagaaatgacaaaaagactgagaatctctgaggtccttgggtttccagaggtattcctgcaaggaacagtcaagcagcatcaaaccttcagaccttctgaaacagcctggttcctcccagcactgggtctggttctgccgccctcctttccaacatgtcacgtcagtcatcctcccaacaaattcagtagttggttaagcaagccatatacagtgttagttgactgaaatcaaagctctatagctaataccagaggaaagcaaagttctgattttcataaggttttgaatgctgtgctatggattttggactttattttgaaggcaa

SEQ ID NO: 97 - DNA, 3087 bp, Homo sapiens
ggtgtttatcttctcatggagaaaggaaggctgtgtgcatacaagtgacatctgctgcttgtttcaagtcctagaattgtatgactaccttagcttcatgtgggcctagtgcctcattctgttggtcctgttctttgattatacaggctgttcacctcaggtacaggtacacatctattgctctattgcttcctccaaagcaaaatgcccttgatattaagttcacagagcctgaggcttttgtccagattttactgatttctccaatttctgcctagtagtaaagtctttgcccttagactaagccagctttgtccactagagatatgatatgagccatatgcgtcatttaaaattttctagtagctacatttaaaaataaattaacagagctaggtgaaactaataatacagtgtatttactccaacacatccaaaataatatgaaatgttattaagatattttgcattcatattttctaagtcttcaaaatttagaatgtactttatttacacttacagaatatctcagttaagcgttcattaaaagtgcttgatctgtgtttagattttataaaatttacagttgaaaaattagatgcacatacctaagttatttcaaatgtacaaaaacagtttccaaaagctgaattgagggtcaattttaaaatttaaatttaaagtaatttaagttaaattaaaaagttagtttctcagtctccctagccacattttaagtgcttggtagctacaagtgggctagcagctactgcactgggcagcacagactatcgtgaaatgcaggccctcatctcaaagcctcctttctgcttgcatgttacatcttgaattagaaagatgggactgcacctcacttcctgaaaataacactcatataccttaaactgacattcaaaactcttagtaacatcttgaaggcattgaaacagccaaggatctacaacttcctaattaaactagctaaaattaatttttccttattttgttatcccaaagaacttcttcttacctctgttttaggctttattccaataggctcatagtattttttactgtatccttggtgaatcgccatgtcataatcctaaagaacatgattcctaagtttagaaaaatctaggtttgatcccccgaatgcccatctattggcttgggcagttatgtcttctgagcctaacattccttatttacaaagtgggaataatacttacttaataatatgatgtagtgaggattataagtgatacagcctataaagtgctttactttgtgtcagagtttgtcaccaaaaaaattacaaaaataatgttagcaaatatttattgatctgtttctcactaaaatttaagtctttaaaggtgagggtcattgatctgcttgctaaagggacatcacctagcactgtgctgtgcatatggccgtatatacagctcagtcaatggttgagtttaaattcaaactgactgctaccactgactggattcagacttcaccctgcttcgcatgccctccttatctccatttgtatatctcttccagttgctttgcctctttgtcttcttggtctcaatagtcactaaagtttcaagcaacaggtgagaaaaataaaattaaaaagccctttttcataaggcaaaacagtcatggaatataaaggaaatttaattttagaactgcattagaataaagttggttaggtataaacccttaactcctagaaacgtattcagagcaacaggcatctccgccagctccctgggaccgggctacagtggagttgtgtcatagtgcaaaagtagtgaactgctgataaaaagcattaacctccatcagagtggctgccattaactgatgaaatcaattaagccagcagcactacctgctgaaaactgatctagcagaggaacggatggcagggtagaacagatgaaatgaaaaaatagtgggctgggttttcttcttgctctgtttttagaaatgttaagttccgtcagtgtgtttttttgcactgctttgaagaactctttccccggcgactccccccctgcttggcctcattccttaaactcactaagttattacagttaataccgtggttaatggtttctggaaagacgatatctatcagcatctgagtgtacacattttggcctaaatactgagaaatcgtaggtatgtaatacaaagcctgggtgtgcctgcctgtagaaagtagctcattaggattaatcttttatggagtgactaatgcaaagggaacgaggccttttcctccccaactcggcagaggttttgtccaaactttcaaacaggtttctttggaatacagctggtcactactgaagactttgctcaaacatatggaactttaaaaccttgattttttttttaacttttgtatactgtagcaattccctgaaaatcaaatggcagaacctaaacggaagactcactgccaaaacgcatgcccagttggggaaaagtgtgtggggaatcatccagcacacttcgagagcttcgagtacagcctggtagaactctgtattaccttctgttctgattcctgagctctgccagacttttgtttgaaaaagcatctttatgcagcagtacatttgttacgttgtatctgagaatactttccaccttggctcctgcttttaacgagtaaaatgacttcttctcttgctacaaagaccaaaaggacacaaggtacaaggcagagcttctcagcagagatatatgtttttttctgccaaaattagtataagacaataagttgtctgtaaaggtccggtagtcagataaaggagtcaagttccttttcagggtaatgtaattgttagtcctcataaaaaaaagtgttgtgtggtggggggagttgcggctttatcaataaaagcatacagagctgaatatctacataaagaaatgttcagtataatttatggcatttcatcatgtcgaactgcatttcaagtaattcaccctggcagttttattctcaaaatggaaatcttagtattttccttgccttcatcaaataaagagttcgtgttcaactgt

SEQ ID NO: 98 - DNA, 1141 bp, Homo sapiens
atcagttttgaccataacagtgcttcttcctcatctgaaaactcagataaacctctgaacctgacttttatcaagaaggaattttcaaattcaaataatctggacaacaaaagcactaacccagtgttcggcacgaacccttttagtgccaaacctttatacacagctcttccacctcaaagcgcatttccccctgctactttcatgccaccagtttagaccagtattcctgggctacgacaatacccaacactggatcagataagcttcctaccacatatagcctacacctacccagctggccacatacagcctacacctacccaactggagcaactacctttgctgatacgcagcgaaggagaaagtacctgcggaaacaaggatttcagggaattgctttatggagcacaagactacatgtcaggtctagatgttatgacagactccaactgctgtctgtctcgcaagaagatcaggaagacagagagtggtatgtatgcatgtgacttatgtgacaagaaattccagaaaagcagttcccttctgcgacataaatacgaacacacagaccacatcagtgtcagatttgtaagaaagcgtttaaacacgagcatcaccttaacgagcactcaaggcttcactcgggcaagaagccctatcagtgtgataaatgtggcaagcgcttctcacactccggctcgtactcgcagcacaggaatcacaggtattcctactgcaagcgggagacggaggagcgggaagccgcggagagcaaggcacgcgagaaagggcacttggaacccaccctgctgatgaaccgggcttacctgcagagcattatccctccagggtactctgactcggaggagaggaagagtacgccgagggatggcgagagctagaaacagcgcgagaaggcaggcgaggatggctacgggaagctgggcagacaagatggcgacgaggagttcgaggcggaagaggaagaaagtgaaaataaaagtatggatacggatcccgaaacgatacgagataaagaagaaactggagatcactccatggacgatagttcggaggatgggaaaatggaaaccaaatcagaccacgaggaagacaatatggaacgtggcatggacta

SEQ ID NO: 99 - DNA, 111759 bp, Homo sapiens
atgaggttcttgctatgttgcctaggctggtcttgaacttctggcctcaagaaatcctcctcctgatcctcctacctcagccttccaaagtgttgggattacaggtatgagccaccacacctggcatcatctgtatcatttgtaatatactttacaataaataggtaaacgtgtaagctatttctctgagttctgtgagtccctctaggaaatttgagatggatgctcgctctgtttcccaggctggagtgcaatggcacaatctcagctcactgcaaccttcgcctcccaggttcaatcaattctgctgcctcagcctcccgagtagctgggatcacaggcacccaccaccacacctggctaatttttgtatttttagcagagacgggggtttcaccatattggttaggctggtcttgaactcctgacctcagacaatccactcgcctcggcctcccaaagtgttggaattataggcgtgagccaccacacccagcctgatatttttagtacctagacaaatctgaggcaaaggtttcctgaggcaaggcagggcatgaacagaagtgggtatcagagagcagtgagcctctgtgcatcttatccctggatctgtttcaacatcaagcttcttgttttatggattaaaaaaatatgtatgtgacaaaggactttaggaccgatacaacaggtataaattactctaagttttgagggggagaaggtgtcacatttctagatttgtctaaatcacgtaaaccctggctccgggtctctgctcaccaaggtccctgagaagcccaatgacagccacatgactggcctgctttgcaatcccggggcttccacacactataataatatagggagagaggaggctgcgaggcatctgtccccactgatcacaccactctgctacaaatgcagaggtcaggtcctgttccttcaatgtcctttctggcatctctgcttccagtgacaccagagacatgcctcacaacacatctttccctcacttggatcagcactgtgtcccaaggcccctcccttggccccctgaagtcactgaatttagtgtccaggctctccgtagtcgcccccacacaacctctccaaggtcctgtggtcctggagtgatgtctgagagtagactgcagcctccatccctgctgcagcctaaagcctttgccctcgccttgcagcatgggatccagccccctggtaacaggtcagtccttctcctttgccctcagaggacaaatgcctccattctctttcccactaaacgcgctgtccgatagggtgaccatgagtgccatgcgactattcctggagcagctgacatgtatctagttcaaattgcaacatgctgcaagtgtgagatttacaccatattctggggacttggtacaaaggaaacgtaaaatatttcaataatagtttttatatcacaaacatgttgaaataatatttttaaactattgggttgaataaatatattatgaaaattaatttcacctatttcattttactctttcaagtgcttactagaaaatttaaagttcacacgtggttcacattatatttattttggacagcagcactctctgcccagtgcctttctccccacctcagaatgaaaagctaggggaacaggagggagcatgtgcagggaagccccctcccatcaggcctgaagtgcaagtaggcctgtccctgttcctgcctcactcttcctggaaagcctggatctctgcatctgagcaccttgctgccctggtctgttgcgagcatgtcaaggaggtaaacagggttactacattgtgagccaatgtcttggtcttatttattgttaatgttctctctggttttacagatgagggggccaaagcccagagaggacaagcgacttatttcttttttttaatttttttattttattttatttttttattttattattattatactttaagttttagggtaatgtgcacaatgtgcaggtttgttacatgtctatacctgtgccatgttggtgtgctgcacccattaactcgtcatttagcattaggtatatctcctaatgctatccctcccccctcccccctccccacaccccacaacagtccctggagtgtgatgttccccttcctgcgtccatgtgttctcattgttcaattcccacctgtgagtgagaacatgcggtgtttggttttttctccttgcgatagtttgctgagaatgatggtttccaatttcatccatgtccctacaaaggacatgaactcttcattttttatggctgcatagtattccatggtgtatatgtgccacatttgcttaatccagtctatcattgctggacatttgggttggttccaagtctttgctattgtgaatagtgccccaataaacatacgtgtgcatgtgtctttatagcagcatgatttataatcctttgggtatatacccagtaatgggatggctgggtcaaatggtatttctagttctagatccctgagtaatggccacactgacttccacaatggttgaactagtttacagtcccaccaacagtgtaaaagtgttcctatttgtccacatcctctccagcacctggtggtttcctgactttttaatgattgccattctaactgatgtgagatggtatctcattgtggtattgatgtgcatttctctgatggccagtgatgatgagcattttttcatgtgttttttggctgcataaatgtcttcttttgagaagtgtctgttcatatcctttgcccacttattgatggggttgtttgtttttttcttgtaaatttgtttgagttcattgtagattctggatattagccctttgtcagatgagtaggttgcgaaaattttctcccattctgtagcttgcgtgttaatgctgatggtagtttcttttgctgtgcagaagctctttagtttaattagatcccatttgtcaatattgtcttttgttgccactgcttttggtgttttagacatgaagtccttgcccatgcctatgtcctgaatggtattgcctaggttttcttctagggtttttatggttttaggtctaacatgtacgtctttaatccatcttgaattaatttttgtataaggtgtaaggaagggatccagtttcagctttctacatatggctagccagttttcctagcaccatttattaaatagggaatcctttccccattgcttgtttttctcaggtttgtcaaagatcaaatggttgtagatatgtggcattatttctgagggctctgttctgttccattgatctatatctctgttttggtactagtaccatgctgttttggttactgtagccttgcagtatagtttgaagtcaggtagcctgatgcctccagctttgttcttttggcttaggattgacttggcgatgcaggctcttttttggttccatatgaaatttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttctggttctccttgaagaggtccttcacatcccttataagttggattcctagatattttattctctttgtagcaattgtgaatgggagttcactcatgatttggctctctgtttgtctgttattggtgtataagaatgcttgtgatttttgtacattgattttgtatcctgagactttgctgaagttgcttatcagcttaaggagattttaggctgagacaatggggttttctagatatacaatcatgtcatctgcaaacagggacaatttgacttcctcttttcctaattgaatgccctttatttccttctcctgcctaattgccctggccagaacttccaatactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaagttattgagagtttttagcatgaagggttgttgaattttgtcaaaggccttttctgcatctattgagataatcatgtggtttttgtctttggttctgtttatatgctggactacatttattgatttgcgtatattgaaccagccttgcatcccagggatgaagcccacttgatcatggtggataagctttttgatgtgctgctggattcggtttgccagtattttattggggatttttgcatcaatgttcatcaaggatattggtctaaaattctcttttttggttttgtctctgccaggctttggtatcgggatgatgctggcctcataaaatgagttagggaggattccctctttttctattgattggactagtttcagaaggaatggtaccagctcctttttgtacctctggtagaattcggctgtgaatccatctggtcctggactttttttggctggtaagctattgattattgccataatttcagagcctgttataggtccattcagagattcaacttcttcctggtttagtcttgggagggtgtatgtgtccaggaatttatccatttcttctagattttctagtttatttgcgtagaggtgtttgtagtattctctgatggtagtttgtgtttctgtgggatcggtggtgatatccccattatcattttttattgcgtctatttgattcttctctcttttcttctttattagtcttgctagcagtctatcgattttcttgatcttttcaaaaaaccagctcctggattcattaattttttgaagggctttttgtgtctctatctccttcagttctgctctgattttagttatttcttgccttctgctagcttttgaatgtgtttgttcttgcttttctagttcttttaattgtgacgttagggtgtcaattttggatctttcctgcttcctcttgtgggcatttagtgctataaatttccctctacacactgctttgaatgtgtcccagagattctggtatgttgtgtctttgttctggttggtttcaaagaacatctttatttctgccttcatttcattatgtacccagtagtcactcaggagcaggttgttcagtttccatgttgttgagcggttttgagtgagtttcttagtcctgagttctagtttgattgcactgtggtctgagagacagtttgttataatttctgttcttttacatttgctcaggagtgctttacttccaactgtgtggtcaattttggaataggtgtggtgtggtgctgaaaaaaatgtatattctgttgatttggggtggagagttctgtagatgtctattaggtccgcttggtgcagaggtgagttcaattcccgggtatccttgttaactttctgtctcgttgatctgtctaatgttgacagtggggtgttaaaatctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacattcaaagttaatattgttatgtgtgtatttggtcctgtctttatgatgttagctggttattttgctcgttagttgatgcagtttcttcctagccttgatggtctttacattttggcatgtttttgcagtggctggtaccggttgttcctttccatgtttagtgctcccttcaggagctcttttagggcaggcctggtggtgacaaaatctctcagcgtttgcttgtctgtaaagtattttatttctccttcacttatgaagcttagtttggctggatatgaaattctgggttgaaaattcttttctttaagaatgttgaatattggccctcactctcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttgttgaggagtatctttgtggcgttctctgtatttcctgaatctgaatgttggcctgccttgctagattggggaagttctcctggataatatcctgcagagtgttttccagcttgtttccattctccccatcgttttcaggtacaccaatcagacgtagatttggtctttccacatagtcccatatttcttggaggctttgttcatttctttttattctttttttctctaaacttcccttctgacttcatttcattcattttgtcttccatcactgataccctttcttccagttgatcacatcagctcctgaggcttctgcattcttcacgtagttctcgagccttgacttttggctccatcagctcctttaaggacttctctgcgttagttattttagttatccattcgtctaattttttttcaaagtttaaaacttctttgccattggtttgaatttcctcctgtagctcggagtactttgattgtctgaagccttcttctctcagctcctcaaagtcattttccgtccagctttgttctgttgctggtgaggagctacgttcctttggaggaggagaggcgttctgctttttagagtttccagtttttctgctctgctttttccccatctttgtggttttatctacttttggtctttgatgatggtgacgtacagaagggtttttggtgtggatgtcctttctctttgttagttttccttctaacagacaggacccttagctgcaggtctgttggagtttgctagaggtccactccagaccctgtttgcctgggtatcagcagcggtgtctgtagaacagtggatcttggtgaaccacaaatgctgctgcctgatcgttcctctggaagttttgtctcagaggagtacccagccgtgcgaggtgtcagtctgcccctactgggggatgcctcccagttaggctgcttaggtgtcaaggatccacttgaggaggcagtctgcccattctcagatctccagctgcgtgctgggagaaccactgctctcttcaaggctgtgagacagggacatttaagtctgcagaggttactgctgtctttttgtttgtctgtgccctgcccctagaggtggagcctacagaggcaggcaggcctccttgagctgtggtgggctccactcagttcgagcttcccagctgctttgtttacctaatcaagcctgggcaatggcaggcgcccctcctccagcctcgctgccaccttgcagtgtgatctcagactgctgtgctagcaatcagcgagattccgcgagcataggaccctccgagccaggtgcgggatataatctcctggcatgctgtttttttaagcccgttggaaaagcacagtattagggtgggagtgacccgattttccaggtgccatctgtcacccctttctttgactaggaaagggaactccctgacgccttgtgcttcccgagtgaggcaatgcctcgccctgcttcggctcgcgcacgttgcgctgcacccactgtcctgcacccactgtctggcactccctagtgagataaacccggtacctcagatggaaatgcagaaatcacctgtcttctgtgactctcacgctgggagctgtagaccagagctgttcctattcggccatcttggctccaccgcgacttacttcaagtcacacagattgagttacaagagggtggcacatccatggctcttgccatcacaccacagtatccactgcagtcccaatggcaagagaaagtggcaggcagagtcagacaggaaagaagtgccgacgacaaggggcgaccacacaaccctgatttttgagaatgctactgggatgactgtaggtatctgtggcccgtgacgtgagtacaccccagctccatcctaatcttgaattctttgtccttcacttacatttttcagaccctcagtatttaagtcttatttctatgaaagatattttggtgatggtagcatgggttttttttgtttattaaatttattatatatatatatgtgtgtgtgagtgtatatatgtatatacatatatttcaagtatatatatatacacatatatatatatcaagtgtctgatcctcatgcacttgcaaatgctttttgtgagctgttttgctgtcattttaactatatatatatatagttgaaaactgcttcaaatcccttgtgagacaaggcagagtaaaaccaaaccagtgcacacaaatttcaataatttctgtgctgtcccctttggtgttgtctcatgaggtgccccagaaagaaggctgaggaaggagtgcagtctctcacacagcacacagcagcacacagccagcgaatggttcttccccagggggttggatacctgtcttttaataaaatgcagaccagcctcagggggcaaggtggtgagagactttggtgggcctgcagagatgtggaaagacacaggatcagttcaaatctctgcaagctcctgttaccacttaagtttcttcccacactttcttcctccttgggggataacattgcttttctgcatcagaaactctaggagaagaggattgtatttcttggtggaatttcacaaagacttgggtctacctttaccctctttcttatctgcatccaacaatagagattttgcaaacagccaaggatgtcttttaagactgtaatggagatccatggaagctcccgcttgcttccttccttcgtcactaccaccacagcacaggacatgcaggaggccatagaccccagacccctctcgtgttcactggagtagagaaccccatcatggaacagtccatgatgtttgattagagagagctggtttttgctgtatttgcccttcattaagaattttccaggacaatgggttgaatggatgttcatggaaggcagataaatgatctaatgaaaacttagttatctcatcttttaaaaggccacagagtcatgctcatgatggccatttttttgagcatctactttgtgccaggaattgggctaagccattgtcttgcatggcagctttctttgttggagtgtgtctttcatgtgtggcttgcctcgctcttctgagaccagatgtcagccagccagggtagacacctcacttgacaggaatgagcatcatgttttgtggaacagctgccctccagggaagccaggtctgcgtcttacataatgggtttgtgtgtgtgaaatttgccaggtgttgattttggaagtcagggatgaaagtcagggatggagagggcaggactgccactcacaagagtgaaagaataattcaaaaatctaaatgtgggaaggaagagggtgagaagggagaaaaaaatagagaagtcaacaagagccttggcagggggtgaagtccgcagtgaaaatcccatggtgccaaaatggccaaaggatgctttaaagacaaaaatgttctaatgtttaatttcaaatggtttgtttttccatgatgcaaacccattcttcatctccctcagtctcccctccaaatattcaatcaagtgtctgatcctcatgtacttgcaaaggctttttgtgagctgttttgctgtcattatcatcatgtgggaattgaagaagggtttgaattccacatctggatctagatgaggcagaaccctgtttcagcagaagcagcaccttagaagtagatttggctgcaatgatgtaattgtcccccagttttgaaaataataatggtggaaagctctggatctttatagatagtgaaatacaggttccaatcttaccaagatttcaagagtctggaagattccagcagacatttctgtctacatgttattaatttaggctttctttttctctctttctctttctctctccctttcccccccccctctcatcttaagcttgtatacaggaatccacatgtaaagctacaggtaggttgagaaagattttataaaaactctctccagggaattttgcccaccaagaggccagggaatgggtggcgtaagacaggagtaggtggcgaacacactgtctgttcctttaataagacaaagggcgaggctggacacggtggctcatgcctgtaatcccagcactttgggaggccaaggtgggcagatcacctgaggtcaggagttcgagaccaggctggccaacatggcgaaaccttgtctctacaaaaatacaaaaattagccgggcgcagtggcgcatgtctgtagtcccagctactccagaggctgaggcaggagaatcacttgaacccaggagggagaggttgcagtgagccgagatcgcaccactgcattccagtctgggcgacagagcaacactccatctcaaaaaaactaaaacaaaacaaatagaacaaacaagacaaacagtgagttttctattacatactcaatttctggtaggaagcccctacaggagatgtagcaacaaataagttagtatgtatgcacaatgtgtatacatactttatctcaaattcacacaaaaaaaattgtattcaaacttaagtagaccataccagcaaagtagttgatattagacttcagctcaggattagtcatgtaagtctttcaacaattccatctattacatctcatgccaagggttattcagtgtcttttactactcatataaattgtctttaccaatatgttcctttgcattcagccctgttaacccctgggttcccatcgcattttactgtgtcccagccttagaaatgcaccgttatctttatgcctgtgttagcatctaatctggccatatatatttcaggctttcctggctatacttgagtgattggtgtgtctaccagaagcttcctgataaaatactgctttctctgctatagcagacttatagtttacttttaaaataactcacttgaaatttaacaggcagttttaaagctacatctgatttaagccccataagttctagcttttaagaacacgcttgacttgccaacctggggttttctgagctgttgagtggaaacacaggcttgccattgtattgtgcattgtggctgtgttcactgtggatataaaaacaaaactaaaaaagcaaacctgggctggcctgttaataaacttggtgacgttggataaacaaccagagaatgcctgaaactagggatgaaatctttcagtttatagatgaggtgtttaagtggtgctctcagtaaagaaggggaagaaaatgcaaatcctttaagatataagcttattatagccagtgatttttttttttttttttgagacggagtcttgccctgttgcctaggcttgtgtgcaatggtgcagtctcggctcactgcaacctctgcctcccaagttcaagcaattctcctgcctcagtctcctgagtagctgggattacaggcatgcgccaccacgcccagctaattttttgtatctttagcagagatggggtttcaccacgttggctaggctggtcttaaagtcctgaccccgtgttcttcccgtctcggcctcctaaagtgctgggattacagatgtaagccaccatgcctgacctatagtcagtgatttttaaaaatcaaagaaataggctggtgcggtggctcatgcctgtgatcccagtactttgggaggccgaggtgggcaggtcacaaggtcaagagatcaagaccatcctggccaacacggtgaaaccccgtctctactaaagatacaaaaaattagctgggcgtggtggcgggtgcctgtagtcccagctacttgggagaccgaggcaggagaattacttgaacctgggaggcggaggttgcagtgagccgcgattgcaccatggcattccagcctggcgacacggtgagactctgtctcaaaaaaaaaaaaaaatcgaagaaatcactggatcaataatatttattgtcttggcaaatcatagcatcctcatggagggaaagaaaaggggctagacaatcttcagcctcacaagcaaagccctgagcaagaaaccttcacgaattctttcccgtgtttcataacaagtctgtgccgaaggcatcaagatctccattttacagatgaggaaactgggacttaggaggcacaggtggagtacgttgcaatccacctaaatccctggatcccaagcccatcctcctgctgtgtggccactcccccacacttgcctggtacttacggtttagtctttgtagactcccgtggacaccccttgcaaactcaggaaacccccaagcagtgcacacacattcctaaaagtgtctcataatttagccttttatcctcatcaggacttgtcaaactcctggtcttaagaaacaaagcaaaactggctttctgctaggtcatttttgcagagcagcatttgttttctatatatcattggttttctagcacttcctggctgctcacagcattctttctgtcattcctctttaagattccactttgatttctcccatggagaaaaatgttgcttttaaaagtcacagaaaaaaaaaccctattctgatatggccttgatttaaaattgaggaataatttgcaaagctcctgttggaaagaggtggatgctctcatgctctccttgtggttctgttccctgatacaactattttgcagaggaatcgtgaaaaacctttaaactttgtcattaattatactttcagaaatctttcttaaaaatgatagtttcaaaggtagaaagaatttcatgagtgaagagactcactactgtgttgtttttggtggaggtgaaaaaaggggaagaatttaactgtctaaaagctagatataatgtatctactaatgaatattatggaactattaaaaatgatttttatggaagttcaactttcatgtgaaaaaccgaatatatatatttacatgtttcttctccaaatctcactaaaatgatagtaaagggatttaaacaagcataagaccatgcattccaagagaataaaggaagagactaaaggagatgagagacggcagcacagcttagaaagctggacagcaagttgactgttggtaatgagttatgtggctgagaaagctgagccctaagtgcccactgggatgaagataagaaggaaacagatccaattcagagagccctggaagacctcagggactcaaggcatcaggcagcatcgaggggaaagaatgtgtggaactgaaaggaaggagtgcgggtgagttttcatggaagcagtaagcctggatattttccccaaataggcaattctcccgaatcacctctgcagaagatcagaggtttactctcagcaaaaattaaaccagacaaattccagatttagggacctgagacataaaataggaacagagaggagcctcgtcagaaagaaaaaaacagagactgagtgggagttaactaacatactgtactgtgaaaatctcagcctcctcttcccaactgtgcgaagaatgctagcaggccagctcatagcgcctgacagtacgctgaagaattctctaggtagcaactaggaagtccctctcttcccccaaatctgcagattttgatgggggaatcgtacataatgaccaggtccaagtcctgtcactgtatggtgaagttcactacttggtaagcctgacccatacgcagaaggcccaaatggttttttaatggcccattctcaaataagaacagatgggtaaggatcacctgacatttgcagaaagcatataatatgaaagttaggcgccaaaacacgctgtcaacaaaaagaaatagaaaacaaacaatgcggcaaatgaagaaataaaaaacgcccccaaattaataatagttacttaggaaggtaaaacaagatattatacttatgaaaaaatttaaaggaatatttataaaattttacaaagaacttctcaaagtcaaaaatatgagagtagaaatattaaaaattcaacaaaagtgttggaaagtaaaattgaagtaatctcccagaaagtagaacaaagagagaaagatgtatgagaaacacaggcaggttccaaaaagaggggacagaaaaaaaaggagggatctatggaaatagggtaagaaaatttcccaggttttaaagggcacactatgaaggttttttaaaatgacctttatcaagtcatatttgaatgaaatttcaaaacactggagataaaggatactgaaatctcccaaagacgaaagcgtgctcaggcagaggattagggatcagaatgacatcagacttctcaatagcaacacttgaagctaggtgacaaaagagtaacttcaaattcagagtggaaatgaatttcattccagaattccgtatctagaaaatacttattaaaacgtggtgctggaataaagacattttcaggtgtgcaagttctcaataatcttacttctcctactccctttctgagaagaaagtgattcacaacaaaaaaggaatacgacaagaagttgggggatgtgaaattctggaaagggtcagttacccagaggagcgatgatatagtttggatatttgtccctgcccaaatttcatgttgaatgtcaaccctgataggggcctggtgggaggtgactggctcatggtggtggatttctcatgaatggtttagcaccatcctctcagtgctgtcctctggatagtgagctcttgtgagatctggccatctaaaagtacgtggcacctgtccccctctctcttgctcctgctctggccgtgtgacatgcctgctcccccttcaccttctgccatggttgtaagctttctgagtcctccctagaagccgagtagatgccagcaccgtgcttcctgtaaagcctgcagaaccataagccaattaaatctcttttatttgcatattatccactctcagatatctcagatatctctttatagcaatgcaagaatggcctaatacaagcagggagaggattcacagggtgatggagaagagacattcagggaggacagttttgcagccaccttggccagctcccagtctagactgagacaaaaggtcagagagctgcagaggagggtcaccaacataaatacaattgacagctgtgtggtattcagagggtttgaaataacatttgtgttgggtgcatagggaattaagcaaattaaatacaaggtaactattaacttgaaggagaataaaaagttacagaaaggagaactaaggagttacaaataacatttatacagaatcagtcagataaacactaatacatagtacaacaagtatctctctgtatctacattggagagatggagggaggggagggtgtgtgtgtgtgtgtgtgtgtgtgtttgtgtgtgtaaagagaatgagagctaaatttctagaaggaaggtaaggtctaaacctgcgaaattaagaagtggcagataagcgttatgagaggctgctgtttgtcctccaatatcagtttccctctgaagatttctcaaatgtgcatctgcaaaggcctggagctccaaactggtgcagaaactgcagaatcttacctattgtggcctcagatgatgaacatatcacaaaagattgaaagaaattttgtgaatgtctgcatagctgaagatctcctgtggattgagggagaaggtgtcccattgatgactacagtgttgagaaatcaacactatgtacagggaattccaagatatatttttatttgatatggcaaaatgagataatgtgatatttcatgaatttcagtattatgatggaaatcagactcactaaaaaaagtaatcacagcactccaactgagagctgtaatagaataaaacaaggagcattgcagaggcaaagaggaagagcccagcccatccttggagtccagtgatttatacacagtactttaagccccagcttggaaaatgctaatcttcacattccagggaatgccattgttatgctgtaaggtaatggggtgaaaataaatagcctcaagagaagttcagataaatgaatgggtggtcatgctagagatgggcattttgagaggatattgaagatgtttagaacaccttttgttgggataggttcacagaagttaaattcctaggtatgttctcctgtcttttaagttaggcagtcaaatggaaaccggtgcttccaaccttccgacaaattagcccttgttgctactatgagttgaaaatacagaatgtcacccactgtgtgccccagaattgtagacttagggttacaagaggccttaggtgttccttccagactggccaggctccaatgagttggtagcttcactttggactaatctaatcatattattatgtgtgtgtgtgtattagtttattctcatgctgctatgaaaaaataaatgagactgggtaatttataaaggaaagaggtttaattgactcacatttccacagggctggggaggccacaggaaacttacaatcagggtgaaaggggaagcaaacacttccttcctcacatggtcgcaggaaggagaaatgcagagcgaggtggggaaaaccccttataaaacaatcagatctcataagaactcactcactatcatgagaacagcatgggagaactgcccccataacctagtcgtctcccacgaggttcatcccaccatatgtgggtattatgggaactacaattcaagatgagatttgggtgtggtacagccaaaccatatcagtgtgtatgtatgtatatataatacatgatattacactacctgtgttatactaaaatatggcattacatatttacactagaagtctctcctgctggaaccccttgtgggcaggaactttcttatcatctggtttattagttccagattgtcaagcagaaacatgaactgtacaaatgggtctttggtaacctcactctgacatactctgctgtctctcctagcccagacatgaggagtctacgtgtttagaaatgcccctctggagaatagatgtattgaaaggaaaagcttcagtaatgaaaataaagctgaagatgagtaaactatatcctgtaaaatggattatctagatccatattactttttgtgtggatatccctttgccataccctggccagtggtgatgtctccttaaggtttctgtttagtatcagctgtgctagggtcatcaagaaaactactgaatgactctgatgaaacctctaacattgccagtaagaaaagtaaggcatagaaggattaagtgtttttcgtggtcacccagaattgacaggaacaaagtctttttcctgcctgttcaatcttcaaattatgaagtttcttatagtttgagataagtagatattttaccatgaagctctagtgcctctgaagctatagtctgagaacattctccatcatagccaattcattcagtcagtggttgccatggttaatactgtagcctatttgattgtcataatttacataaaatatcaaatcaaccaaaaaaacccagatcatttatgttgtggtctagtcacatgcatgaacataaaactcaatctcgtgaccatgaatatgaataaagacaattttccttttggagtggtatcctagcatcagaggatgtccatttgcctggaacacctccaaaagcacctgctgttaaagtaggggttagcaaactatggcccatggaccaaattcatcccactgcctggttttgtaaataaagttttattggaacacaaccactcccacccattcttttacgtatagttcctttcacaaatgacagagttgagtagttacggcagggactaaaatatttattacctggcctttaaagaaggtgtttgtcaaactctgtattagagcatgttttcttgttaggaagcctgggtgcccctctaatgttgactgattttaaattggctacagtctcttttcaatgttacctctctgactacagaaacatcaaggggaaaaaaaccatcatgaacagaagttttcaagtatgactgagcagaattacctggggaacatttacaatagaaatttttggacccattcccagagatcatgattcagtaggtctggagtagggcctgggaaacttactttgatacaaatgattctggtgcacagccaggagcaagaaacttgaggaaagcacatggaagctggaaatgaaacaagcaggaagtgaattctgattcagtcttgctgtgtaaacttgggtgaattgcttcactgagccttagttacctcatctgtaaagtggaaataacaagttttccttcacagggctgttctgaggaccaaagaagacaatagttataaaatgtccagcactgtgtttgcacagagtagacacttggttaatggtcccttctttcctccactggagaatccagtgccttggaaagcacaccagtttgattttcttcattttgtcttgtgtattatgtttccacttctgtttatgttaattttgctcttgtcaaactattccccaatccacaagtccttctccatgtatattaaagctagaggtgtttgattttttttttttttttttttacaaatttgtttctctgggaagcacccagagagctgaatgaccctaaatggcttgttagccatatgactgccaatggtcttgattaattctttaaaacataattaaggccaagtttttaagtacctttagtgattttcttaaaaaccttgatataagatgatagactttatacattcagaagacaatccattggacaaattgagatgaagttttgtgagaatctctttctttagaaatggaaagacttgctattagtttttctttcaatgtctggtagaattaagcagtgaatccatcaagttctgggcttttctttgatgagagactgtttattacacttcagtctcattgctcattattagtttgttgaagttttctgtttcttcatgttcgatcttggagtttgtatgtgtccaggaatttatccatttcttctaggttttccaacttgttggtatatagttgttcctaatagtttctaaggattctttgtgtttcagtagtctcagttgttagtctccttatttatttctaatttcatttaggtctgcgctctgtttttcttaatctacctaatggtttgtcaattttatttatcttttcaaaaaaccaacttttaattttgctgatcttctgtattttttgtctcaatttcatttatttccgctctgatcctttttattttcctttactaattttgagtcagtttgttcttgcttttctagttccttgaggtgcaagattattcagttgaagtctttctacttttttggtatgagtgtttattgctataaattgccctcttagtgctgcttttgctgtatcccacagattttaggatgttacatttagttgtttcagaaatttaaaatttttcttttttaatttctttactgacccattgatcattcaggaacatgttgtttgatttccatgtgtttgtatgttttctggtgttcctcttgttattgatttctagttttattccactgtggtcagaaaagaaattgatatgattttgggatttgttgaggctcgctttgtggcttaagatatggtctgttctggagaatgttccatgtgtggatacaaataatgtgtactgttcagcagttgggtgatttgttctgtaaatgtcagttgggcctatttagtctagtgtatagtttaactcctatgtttctttgttgattttctgtcttggtctctttgtcttaacatcctgactgattgagagtaagccatctataagtaacagacactgtcgacgttttgctcacctgtcctcctgccccctctgaattaactggcagtcctagtagacttctcagcatgctaacatcctcccacttcaagcagcagatcgttcatctgcttcacctgagacctttctcagctccttaggagctttctctccaggagccaaacacaacctggcagtatggggtagtggataataaccccaagtcacctgtctgcagtgggacaatgctgtggggtgttctacttgatgcctcagagggtcaccacaggggttgagtctcagttgcccaacatgtttatctgctctttgacgtactctttactggcttttctttcttccctgtctcagatttctcacttcctcacaggacgtgtgggatcatctcccagatgaactaccagttcctaagtatttgtctgaaggtacgctcttttgaaaatcaaaactaagaccagtttggacccaggacataacagagaccatggtctggctttaaacgggccgctttaaatgattgtatatctagaaaaccccattgtttcagcccaaaatctccttaagctgataagcaacttcagcaaagtctcaggtacaaaatcaatgtacaaaaatcacaagcattcttaatacaccaataacagacaaacagagagccaaatcatgagtgaattcccattcacaattgcttcaaagagaataaaatacctaggaatccaccttacaagggacgtgaaggaactcttcaaggagaactacaaaccactgctcaatgaaataaaagaggatacaaacaaatggaagaacattccatgctcatgtgtaggaagaatcaatatcgtgaaaatggccatactgcccaaggtaatttatagattcaatgccatccctatcaagctaccaatgactttcttcacagaattggaaaaaactactttaaagttcatatggaaccaaaaaagagcccgcatcaccaagtcaatcctaagccaaaagaacaaagctggaggcatcaggctacctgacttcaaactatactgcaaggctacagtaaccaaaacagcatggtactggtaccaaaacagagatatagatcaatggaacagaacagagccctcagaaataatgccacatatctacaaccatctgatctttgacaaacctgagaaaacaagcaatggggaaaggatttcctatttaataaatggtgctgggaaaactggctagccatatgtagaaagctgaaactggatcccttccttacaccttatacaaaaatcaattcaacatggattaaagactttaatgttagacctaaaaccataaaaaccctagaagaaaacctaggcattaccattcaggacataggcatgggcaaggacttcatgtttaaaacaccaaaagcaatggcaacaaaagccaaaattgacaagtgggatctaattaaactaaagagcttctgcacagcaaaggaaaccaccatcagagtgaacaggcaacccacaaaatgggagaaaattttcgcaagctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcaattcctcagggatctagaactagaaacaccatttggcccagccatcccattactgggtatatacccaaaggactataaatcatgctgctataaagacacatgcacacgtatgtttattggggcactattcacaatagcaaagacttggaaccaacccagatgtccaacaatgatagactggattaagaaaatgtggcacatatacaccatggaatactatgcagccatcaaaaatgatgagttcatgtcctttgtagggacatggatgaaattggaaatcatcattctcagtaaactatcacaagaacaaaaaaaccaaacaccgcatattctcactcataggtgggaattgaacaatgagaacacatggacacaggaaggggaacatcacactccagggactgttgtggggtggtgggaggggggagggatagcattgggagatatacctaatgctagatgatgagttagtgggtgcagcgcaccagcatgtcacatgtatacatatgtaactaacctgcacattgtgcacatgtaccctaaaacttaaagtataataataaaaataaaaataaaaataaataaataaatttgcttgtgcatttctagctttagcttcttttttgcaaggggagcttaattattaggatcacagctgaggcccaagatataggaaaaatagcctctgagctccaagttatgtctattctgaatctcttgcactttgttcacaggtgagcatctttaggcctctcttaggacctgctaatctttttctttgcattgatgtaacaaacttgtctaaataattcccaaatttataaatgttaaaagcagcaaattatagaaaattcagaggttgctattagtactgctgcaaatatggttgttactagcctgctggtaaacaagaagacataaattgctcacagtaaaaagcacagtagtttatgaccattaagtgaaggggtgtgtaatcctacatacatacagactccaagggtttttttctattttagcctagtacaataactgattgtcatggttaattttatgtgtcaacctgtctgggtcatggtgcccagatacttggtcaaacattattctagatgtttctctgatgtgtttttgaattacatttaaatcagtagatttcaagtaaagcagatttccctctatgatgtgagtgggcctcatccaatcaattgaagtcctgagtagaaaaaaaaaactgatttcctctgagcaagagagaattctgcagcacatggcctttggtcttgagctatattggctttttttctgggtcttcagcctgctgccctctctgcagattttggacttgctagcctctgtaattgtgtgagcaaattctttaaaataagtatctttctctacatatacgtacacattctattgattctgtttccctggagaaccctaatacactgatatttataataatttacctctttgttcaacacttatttattgagcacttattatgtgccaagtaccattctaggaacttggaatggattattaaacaatacagggtcttacagattaagacccgaccctggtgtgcttttattctagtgggggaagataagtggtaaaaagtaaacatgaagcattaaattatgttctaacatgctagaagtgataagtgctatagaaaacaaaagtaaaaggaagacagtgtgaggagacattgggtcattagagaaggttaaaatacaatcaatatattgggaaagtaggtaactatgaaagactcacaaatgtgcaaattgctttaaattaagcttttaattttgaggtaattataataaatgtgcagttgtaagaaataatataaaaagatcctatgtaccctttatccagttccctactgtggtaacatcttgcaaatctatactaaagatcacaactggctattaacacaaatgcagtcaagatacacaacaggtgcatcactacaggtatttctcctcctgcctttttatgaccacagagcccttcatttctttcttaaccattactataattttgtcattttgaggatgttttataaaagggccttatggtgtgtaagctttcagaattggcttttttcatttggcatagatccttgacaattcattcatgtcattgtgtatatcaataattcattcctttttattgctgagtagtattcatggtattgatataccacagtttgtctcaccattcacccattgaagggcatctgagttgtttcctgtttgggactattatgaatcaatttgctataattttccatgtacacatttttatgtgaacatatgtttttattacttcataatgaatgcctagcgggtgcagttccagggtcctatggtagttacatgtttagttttgtaagaaactgtcaaactcttccagagtagctgtgccatttaaaattcccatcagcaatgtatgagtgattcagttttactgcttcctcgccagcatttggtattataactatttttaatttcaatcattctgataagtgtgtaatgatatctcattgtggttttcatctgtacttgactaatggctaatgatcttccacatcttttcaggtgcttgtttgccacctgtatatcttctgtagtgaaatgtttattcatgtcctttgcccattttctaattagattgtttaggttttttttttttaacttcagagtttggagaaatatctacatatatatatgtgtatatatatatatatatatatatatatatatatatatatatatatatatatatatatattagttctttactagctatgtggtttacaaatattctctcccagtctgtagcttgttttttcatcctttcaacaggatcttttgcagaacaaaagcttttacttttgatggaattcagtttaccaatttttccttttatggttcatgcttttgctgtcaagtgtaagatctccttgcctaaccctaaatcctgaagattcttatcctctgttttttcttataagttttgtagctttatgttttacatttaagtttataattttgaattaatatttgtattaggtgtgaagcttaggtcaagtttcattgtttttcctatggattcaattgcttcaacaccatttgtgaaaagtctccatttcttttgttgaattgcttttgtataactttgtcgaagatcagatggggatatatttgtggaccgatttctggatttttattctcttctattgatctatgtgtctatccctccaccgagaccacacagtcttaactactgtagctatataatatgtcttaaaatcaggaggactgattccttccactttattattttgcaaaatggttttagctattctagttcctttgcttttccatttaaattttagaatgaacctatctatgcctacaaaaaatcttgctggagtttttatgggaatcgcattaaatgtgcatatcaatttgaagagaattgatgtatttattgtgttgcttttttcaaatcatgaactcagcatgtctctccatttattttgatctgtaatttatttcatcagtgttttgtaatttttagcatacaagccctgtgtatgttttgttagatttaaaactaagcatttttatttttcaattgcaagtggtatttattgccttttaattttcagtgtctgttgggacagttttaatttctttatttccattttcacttgcatgtcttttatttccattgttgttgtttgttttcaccttacagcactggctagaacttccatccctgtggtgaataagagtgatgaaagtggacaccatcgtattattgaattgaaggggtgagtgccgccttattactgtcaggtgtgggaagaagttccacttccccactcggcctccattgacatccaatgctgggagggtcctcattactggtgagtaaggtgagagctccagatcttttctgagcttccactgatacctccttggctggaagaggtaggaataccttcttacttctccccacataacccccaccaacatcgtggtggagaggtggagggccagccccactaccactgggttgtattgaaaatcctaactttccactaagcctcctcggacaccaacttagtgtggagtgggaggtgcacccagttacttccatgtggggtgctactactgcccagcaaagatgaaggtcctatttttatattcagcctcctttgatatcctctttctcccagtggggaactggggagcctcattacatctcagttgggatagaaatctaggctttttactggacttttgcagacatgagtggagcacagaattttctgctgggtttggctggagatgagctgctattttctggaagttttctgacttgaaagatggaagcttggttcgcttgttgggttgccctgttcctggttctttggtggaggaagcaggcttctgttgggctttattttgtctgtgcttgctcacatctacgggctgctggcttccttaggaacagtttgggatatatgagggaaggagcttgggccctgagttccctagctggcctatcttcttctctctacttttcatagccttctcatatttattttacctataacatccaaggttttaagtgtgcttaacagaaggaataggaaaaagcacattcactccatcttctccaaagttgaagtccttcataagttttttaaattttctatagctaaaatgactaaatttttagttatctagaaaactttcctatccaaagtgactcatcaaggacaactgtaaaattttgttttaccacctatgttattaaactagagatttcccccagagagtaacatttactttgcttggtattcggttataactatcagatatttaaggctgagtcacctatttctaataaccatggtgattgcaccaaataattacatatacaacatatgaaaggcagtcctccagccgagggatctatggaaccacaggtctgtagaactagagagaaggagaaaatcattaaatccttctgcaccgaggggtggatatctgagttggcagagcaggagttgaaggtgcaggttttgacattttggcatggagttggctgagctcaaatttctaccctgtgtttataagctgggtgactttaggcaacttatttcatcttatttttcctcagtttctattattttaaaatggagattataatcatacatacttcaggggactgaggtatgcattcaataagtgagtgtatatgaaacacttataacaattattggcacatatgaccattcaatgaatattacctaccataattactcatatagtatgatttagagagattaggaagactgctttccacctattttcctgcctatttttcatcagtagctgggtttcaaccactgagtaattacttaggtgaaggtatgggccctattaaatgcaaatttcacaaggcctagtgtattattctgaaggcatctataccttgtattagagagatctaactattgcctcagctgttgatggcagaggcccaaaatgacagtggcttaaagaaagatggaagcttggtttgatctcatctaaaagttcaggtggtctggaagttctggtctgcaaaattgccagggcccaggcagcttctgtctcgttgctctgccatctctaacacgttgtccttgtctacatggtgctagatggctcatcctgtatccatccaccaagcatcaggatggagcagagactaagcaggaaaggatccgccttccttttaagcacatgtctccaaagaagccagcatcactcccactcacatcccattggccagatacacgtcacctggccacatgtagctgcaagtcaggctgggcatggatttcttcaatgcagttgactatgagactatctaaaaatgcagttaatatggaaagagagtttgccccacactgcagggtggattagtgtatcttctactgcctaccttaaaacccgtgaagaatcttcctgattcaagccctgtatcctcactctgtcttcttatttgccttgcatataaacagtacctccttctgctctcatcaaaagccagcattaccagggcaacagggagaaaagtcagttgtctctgttttagggcaaaagatcaccttctctgtcattcttggctaacaatactcacgtaggttttgaaaacctaggttatgctggctttgtgatgttggaataatagctaatctctctaaaccagtggttttcaacgggggtaattttgctccccaggggacatttggcaatgtctataggcgttttcagttgtcccagttgagggagagggctgttttaatgggtagaggccaggaatgtggctaaatatcctacaatgcacagaacagcaccaacttataaaacgttatgtggtctgaaaatattaatagtgtagtggcagataagttctgctttaagctttagtttctttcctgaaaactgggacgaaatagcacctgcttcataggttatacgtgaggagcctctgaaccagcacttgtaaaggatttagccgagtgcctggcccatggtgggttccagacaacctctgtcctcagggactcttaatcttctccttgttttatctgacttctctgcactcatcttcttgcaatgtttattattattatttttaattttagattcagagggtacatgtgcaagtttgccacctgggtatattgcataatgctggtgtttgggcttctgatgatcttgtcgcccaggtagtgaacacagtactcccaattggcagtttttcaatccttttccactccctgcctccctctctttggaatctctagtgcttattttcctatctttgtgtctgtgtgtatccagagtttagctcccacttgtaagtgagaacacatggtatttggttttgtttctgcattacttggcttagtataaatggcctcccctgcatacatgttgctgcaaaggacatgatttcattctttttatggctgcatagtattccatgttgtgtatgtaccacattttctttatccagttgccacttactagcacctagattattccatgtctttgctattgtgatagtgctgggatgaacatgtgagtgcatgtgtctttttggaagaacaatttattttactttgagtaaatacccagtagtggagttgctgggtcaaatggtagttgtatttttagttatttgaaaaatgtccagactgctttccatggtggccgaactaatttgcattttaaccagcagtgtgtaacgtctacttgcaatctttaattaatagtatgtatgtctcttgagaaggggaaatgagggaaattacattttactgtggaactggtggataccagaattttaacataaattactttatgtaaacatctccaaaccatgtgaagttggcattactctccccaacttggaaatgggccagtgaggctcagggagatctcctaacaccctgcgaaaacagagttaatcagtggctgagcagggattcgacgtcatgtatgtttgaccccaatatgtgtgttttggttgcaaattggcttttcccagtcctgtaacttggaaattctacaagggtaaagagggccgggtgtggtggctcatgcctataatcccagcactttgggaggctgaggcaggtggatcacctgaggtcggtggatcaactgaggtcaggagttcgagaccagcctgaccaacatggtgaaaccccatctctactaaaaatacaaaaattagctaggtgggtggtgggtgcctgtaatctcagctactcaggaggctgagtcaggagaatcgcttgaaccctggaggtggaggttgcagtgagccgaggtcatgccgttgcactccagcctgggcgacaagagcaaaactcagtctcaaaaaataataaaataaaacaaaataaaatggcaaagagaatctgaagcaccagaatgctctggaggaagtcagaagagactgttgcagggaacaaggatgcagtcacactttttcctcaggttgggcttgtaaaagcagcacgtacttcaacctgtttaggagccttggccatgttatcttgttcccacaaaatggtaggcagtgttatcttcttttttccttgttgaatcctaggaattgggtttatattagtatcctaaggatgttgtaagaaattaccacaaactgagtgaactaatgcaatagaaatttactctcttacagttctggatgccaaaattctgaaatcaaggtgtcggtggggccatgttccctctagccgctctagagaagaatccttctttgcctcttccagcaattgatgattgctggcaattcttggcatcccttggcttgtggctgcatcactcccatctctgcctttgtcttcactggctttcttccctgtgcatctgcatctctgcatctctgtatctctacgtggacttctcataaggacagcagtcattggatttttgctgattgtaatccagcatgacttcctcttaatttgattacatctgcaaagactatttgcaaatgaaggcacattcactggattcactggtgctgggggttaggacttaataatagctcttggagggacacaattcaacccatgatgggtctaaacaatgttttataattgatataaaagctaaaccatgttttcttaaaacaactagaaacttctaacccagtggcaactttgggtgtgcaagagagctcaaagcaaactctcagtttcctggcaagagaggaggcctccactctgtcaccccatggagactcctccttgatactgacattattgcaatacatgcaaaacacacaaaaaaatcaccttagagtttgggaaggatgaggatatttaatggcagcaatataagtaattttttttgcctctgcatatactcttttttaattaaaaaaataaaaacggaaaaacagattggggttaaaggtctttagtttttagaggtgatatgaaaggagaaaacctgtatggcttctggtctttatacagtgcattggaacagaaagtcttaattataccaatcaaggtgacatccttttccactgaactatgtattatattttcccttcaagacaaagatgaacatttatgcaattaaaataggctgattgaaaaaaatccgtgtcaggcataagctcggatttatacttttgggctcaattgactggggaacattaaaaaaactgcacaactgagcaaaaatggtctcttttcagcacatattttgaacaggaaagaggagtttgctttcccctgcattcagcaacccagctcccctcctcattagtccagtgcagagttggggctgctccctcaggtcctcatcagcttactcaaacatgctgtaaaattgatctgacagcccatgaaagggagtttagaggcagggagggaaggacatgagagagctaagattttggtgacatggaactctgtattttcaaggctatcatcatatttgcctagtattaagggctgtgacattagcaaggccctctgatctttgggctacaaaattgttgtgacaagggccctatgtgtgtctgtgtgtatatgtgtgtgtgttgaggggtatcttttgagtcctgagtttgaaaatacttatttgtaataatgggaaagaaagttctctgtgattgaaggctgaatccttttgacatgaagagcaaagacaattagcatttgttgatcatttgttaaatttcagatgctttcattttttttcttttaatcaccatgataatccttgaggtttgtattattattaccccattatacagattagggcacagagaccaagaaagatatttgacatatttagcaattggaaaaacacaggcagagacgatttggaggtactctggccataggtcctggagttccccaggagcaagttaggatggctggggccatgggaaggtacaccaaggaatcttggggcaacaactatttataatcacaaaaatatttcaactgccaccagagcaaaccaggtaaattggctctgtttggaagaaaagtttgctttccctaagacaagcagttagtcacatggtctgacttggggtttgaactcagctcgttttactgcaaatataatactctttccaatatgccacactctcgtctcctcactctatccttcctgtgaggtcagagcctgcaaatgtgtctggaggaggaacagtggcagatattatcgggggtgaatgaggtcagaggctttcctgtgaatatctttgtcaaggtgatggaaaaagtttccaggaacctttagaatgtgtgtcgtgtatcatgaggattggagactacaaaagaggaaaaggtgttcaaattcagagttggataattaaaaacaaatattgtcaacatcaataattttccccagagttgctcctccttttatggtatggaaagtttcaagacctgtgacctagatggtgttctggggagacggtagatatacatggagaaaatgccaacatattttatggttatgctaagcatattttgaaaacttccgttaagattttggttcagcctggtgcagtggctcatgcctgtaatcccagcactttgggaggctgaggcgggtggatcatctgaggtcaggagtttgagaccagcttggccaacatggtgaaatcctgtctctaataaaaatacaaaaaattagccaggcatggtggcgggcgcctgtaatcccagctactcgggaggctgaagcaggagaatcacttgaacctgggaggtggaggttgcagtgagccaagatggcgccattgcactccagcctgggcaacaagagcaaaactccatctcaaaaaaacaaaaacaaaaacaaaaaacaaaagattttggttcccccacacacaaaaaatagagtttgaaatttagtgaattaattgtattccatggctttttctttacagatagattcaggtctcataaaaaactatgccatctgtacacattctgatatgtacagcaaaatgctgtcattttctttcaactggcaaccccaagctacaaacaaaaacatgctggtggaaattaaaggaaatgccctctctatccaattgaaacagagagatgtgtaaaatcctttcttttcttttcaagtaagggcacaaaacaacattcccttctctaaacacaaatagaaatttactcactggcttggaaaaaacaggccaagaatggacactttttcctctccagagatcagtgcagctcttatctctatttaaaaacctttgaatctgtgcttcctgctgttatcttacattttttaatttcatctatttcactgtgctgttttcctcagtgaactagtaccacctctcccttccttcttgcagattcaaacctcttctgtgataatcatagaactgtagcatcagaaggcaattccctaagtgtggtctgcccacatccctggtggtaagccaaatgatcgtaagtggtagagcggcaattacttttaaaaaatttgacagtcatatatctatttcaatgtatagcaaatatagaattggaacatcaaactatgattttatagatattattgcctaggaccatgctaagtttcagaagtgaatctatttagatcaataaaaatatattaagaaagtagtggcataggtggtgtgtcactctaacagagcataaaccagttgggagacaatcctaccgaggtctgaagtggcattctcacacatggactatgttctcagcagctgggcagctagcttctgctcatgaggagcagaggtaactggagtagcatagtctgcatgaggattgagcagacccaaacacaagttgagagaggctgggcattagaagaacaaatatctccttttaagattgttcaacctgacagtctgttctcaatgtgaactcaagaggctgcttcctctacgtgcccatgcaaagcacaaatctgagatcttactattccaatttgaggaagagccacctgcaccttggaaaaacggaagcgcgtgcaaaagcctgagaaccagctggttgcaggcctgtgccaggcctttgtgcactaggtgtgcctgggtcgggggagaagtccatggggctgagctcaggcaggccagttctccgtgtatgtggtaacaagaaggtaaaggaacaagaaaagctgttgaaccagccataaattggctgtcttccgtggtattcagtgtcctgtttatgactgtaaattgggtatatctttatcacaactgtgcttttggggaaaacaggaagtatttctcctaaggaatgggtttacacagaatatttggtgtattcgttctcacagtgctataaagaactacctgagtctggggaatttatgaagaaaagaggtttaattgactcatagctctgcaggcttaacaggaagcatggctggggaggcctcaggaaacttacaatcatggtggaaggctaaggggaagcaagcatgtcttaccctgacagaataggagaaggggttggggaagtgccacacacttttaaactatcagatctcatgagaactcactcactctcacgagaacagcatggaagaaatccacccccatgatctagtcacctcccaccaggtccctttcccaaaattgggaattacaattcaacatgagatttgggtggggacacagagccaaaccatatcacttggtatgttagtgagggctctcaagataaacagaactaacaggatatatctatatatttatctaacgtaggagattataaggtattggctcactcaattatgaagactgagaaatgtcacaatctgcttgtctgcaagctggagatccagaaaagctggtggtgtagtttaatggactgagagccagtgccatagattcaagtccaagcccgaaggcctgagaaccaggagctccaaggataggaaaagatttacttactagctcatgcagtcagacaacgaacaaactcaaccttcttccaccttttagttctatttaagccttcaacagattggatgatgccccctcacattgtggagggcatctgctttactcagtctaccaattcaaatcctaatctcttctggaaataacctcacagaaatatccagaactaatgtgtaatcagatatctggccatcctgtggcccagtcaaactgacacataaaattaaccatcacacttggtatcctcaacattgtgctaatgaagactgagttatttagactttggaaaagatacagtggactattgtgctcatttgaggatgtccatcaagtcagcctttagtactaaacaaaaaacagatagatatgaagaatggattgtttaggcagattctggcacagaacatggctgatgttagaacctcccctcccccagggtcatgaccttgggaagaagagatggataagtaaacccttagacccatctcaatattacctcctcagtaagttctttcctataataattgtaccttacccttccttgttcttccatcttctatatcactttatctggacaactgttagggtaagcacactgctaattatatttttgtttaatccactttgataacatgttaagtgcccagagtgtacagatctcttcatgattatctctgcactctactcagaatccagttcagtgctttgtggagaataataactcagaacaataaagatggaactgaaggagggggtataagtggggagatgtagccacgctcagcaagacagggccatgtggtcacagaactacccaggagactttgtgcctggccagcgcctagatgacatttgctggacacttggcactgattgctgctagctgagtgaggaagggaaaaaaaaaaaaaaaaaaatcccaaaacatattcagctgttctagatttaaggtttgcctggctgcttcacggtcacaattgaacatgctggttactctgggtaaattaaattagctctaaagatatgcccaattgcaccctaagttccaggtgttgacaagtccttgcctcgaaacaggatcatcggtgacaataaatttcacatatttggcttttgtaaaatctaaaaggtttgttcatatggttataaatggctaaagaaaacaggcaaagcagcaggtgctaagatatgtgttgttcggtggcttagacaggcagataagacccttaaatgttgtagcctttgaacctgggatggggcagagtgatatctgatgccatggtaagcagagtaacaggctggggaagcattgtcgttgcatcaacaggtaggggtttgagttctacctctgctgcttagtgcctgtgtcaccttggacaaggttatgtaatttctctgaggttcggtgtttttctttggaaaacggattttaaaacacttggctcagtgctcaataaatagtaacttttttattattttaatgtaggacctcatttaatccttacaataacttcatgagtgctctatcaatatccccattttatagatgaggaaaccaaggcaatggagacttggagaatgtattactcagggttctgtagagggacagaactaataggatagacatatatataaaggggagtttattaaggagtattgactcacacaattacaaggtaaggttccacaataggccatctgcaagctgaggggcaagaaagccagtccaagtcccaaaacctcaaaagtagggaagcctacagtgcagacttcagtctgtggtcgaaggtccaagagtcccaaagctgaagaacttggagtccaatgttcgagggcaggaagtatccagcatgggagaaagatgtaggccagaatactaaaccagtctagtcttttgatgttcttctgcctgcttttattctggccttgatggctgctgattagatggtgcccacccagattgaggatgggtctgtctttcccagtccactgactcaaatgttaatctcctttggtaacaccctcacaaacacacccaggaacaatactttgtatccttcaatccaatcaaactgacactcagtattaaccatcacagagagcataagcaaattgcccatggcattagaagtagagatgaattttgaatgtgttaccagaccaacagatttgtatgcccactgtgcagtaacataccaatacatcgagacagcaaggtttgcatcagagaaagagttcaattatcacaggatggctgaatgagatgagagggatacttaaattcagctccttgagaagttctgggctggagtttttaaggggattgtggagagtgaggggctgggaaattgaggtcattggctacttgtattaagggggatgaaatcattagaatgtaggaacagcattcttcagtgagtcagcctcttcttagtagtttcactggtatgcaggatctgaaagaacatctccaaatagaaaatttaagcttcacaatgcctaagttgttatctatagagccgttaaggggaattttaatcttgtgacagggtctgcaagattctggggcaacaggtaccaacaactatgaggaagcaggtcagagagccagctcccctcatagttaatgctgaatgtgctgcaagctggatttatttttgtttcttcccctcctttcttcttgacttaaattcagttttcttctcctttacttttataaagtttataggtatggttacaaatccgtgtctccaggccagcgactgatcccactaacccacactggtaacttatagctattagtaatttatattccacaaccagcataaacatgctggatggattcacttgaagttgtcaactctccttttcttccaagatgactcagagacttgcaaactgaatacttgtataagatgcatctctgtcctctttggcaccttggcatactgggtcacaatgtaataattactttcatggtcatccaggaacagacaaatcccttctttcctcatgccttcattgtcttgcctgagaagcaagagggctggagtttgagagatgatctcccagctctcatatgcgtgggaacgtgaaaggcaggcatggtccattggaaaagaaaaaaaaaaacctgtttggatcaataaaaagggacaggcacaggaaaacagtcagagcttgatagatgagggaacatgtcgttatgtaggtggggaataagaggaagacaagggtgtatagaggaaatgggagagatctgtggttcttggggactttatttagaaaattcttcacaattctcagaaagcttaaatagtttttgaagaaataggagtgaaattctttggctagaaagtggacaggagaccactgggtctgtgtgcctgtgtttgtgagagtgtgaaagtagatggataaaatttgcaagcaggaatgagtcagacagccagcttctggtacccttgctataactatccagaagcatgagtccattctggttttaggagtcaggaatataaatggaatttgtattgcaatccaagggtgggtgtgagaactggtgagaatataatagattacttgtgtttatgaggtctgatatgagtagttcaagctgtaaaagcaagatatgagtgagtctcattttctttggttcttccagttgcccctagagagaaaaagtggtgactgggtatactcaatccaataaataaataaacacatacacattttgcaatgattgctttctgccgatgttaaatatacctcccaagttgggaaaatggcttatatgttctactgtccctcctgctttctgtcttcccagcccctctcttccttcaaggctgaaggcttccatagtcagttgagactctgcttcacacattataatgaaggcgcttgctctctaaatgactctctagtcctgattgtgctaaatagggtttctgtggtttcagatgaggaccattttttgtttaaatgctgatggcctcccagacattgtagaatcagtggggtgctgaggagtgagggagaggaagcttctttgccagtctacaaagaattggggtaggaagcagtgaaaagaaccccctgagtttctaaaacctctcaactggagtggaagaggaggggtgtcctttgtaaattatccaaacacatttccataaaagttgagcatttgtactaaaatgggatcttggcttcattttccctgcaaatggccagggagaaggaagcactctctcattgggtgcagagaaggaaaaatatggcaccctgcctagaatggagattttatgttttacagaaatgacttagggaggacatcctgcaagaagctgttgatcagtgaaatgtgtatttgctcaaaacacactttcccagctgagccccaccccttcgttccaagtcttcctggctgggtcctgcacatttggctcccccataaccttgtttaggactgtttctgttgaggatcacactgtgcagagtttcaaagtcattctgctaatgtgagtgcttctcctattttatgcatcagaaggcattcaaaatctgtccacagttgagagcatcagaaaaacaaaacaaaacaaaaaacaggtgtttataaaagctaacttactatatgccagaccaattctaagtgctttacaaatattaactcatttaatactcacaacaaacagttgttgcacttattattgcccatttaaagaagacttaggcataaacatgttagtttgcccaaggtcacaaagctcacgagtgatggagcccgtatttcattccgagctgtctcacagcacagctcacactttaaagcacaatactgtaataaaaataatacctgcttcatggggttgttctgaagatcaaatgagattatcaataaagaaaagctgtaattatccaatgtgggagaagcagaaatatttgggctgtgtttctgttagatgcttctgatagaaaaatcacaattgccaggatccatccttccttcgttccttcgttccttccttccttccttcgttccttccttccttccttccttccttccttcccttccttccatttccattttccattggctgccacaggtgactggatacttgatctaactgagaagaattttgaaatgtggaagggaggaaggaaggaacaaagaaggaaggaagtgagggagggaaggaaatggctcttttctttcctgtttcacttcccattccctcacttctgtgtcctgaactcacacttccaaatcacttcccgtccatgaaccactgtcaccatctgctttcagaaggacccagcctgagattctctctctcttcctcctgcccttcctttctttcttttttcccttagcctttccttttttttgaagtgatattaacttttttcttagattagcggatattttgatcttatttgaatcatctgactggaagacctagttcaaatacagcagatttgggtaggtaaaatgtcagcacttcttaccactctatcccagtgtccaacccagttctggaacatggctagtgttcagtaaatgtctatccaaagattttggaaagtgtgggttaaccattattgcccaatctaccaaaaacacaagtgtaaaatgtatttttacattagcaaagttggaaagttatattttctttttccttgtctttcccagaaaaatcattaacttaggtctgctgttttctgtatttcacttcacatgtggaatttcaatcgttcaagaagacaggaaggggtggagaaacactaaatatatatgtacttacacacacacatatatatatacacatgtatatgtgagagtgtgaaagtagatgggtaatagcactgaaaaaaggaaaaggctcaggaaggaaggaagggtaggaggaaaagagagagaatcttaacctgggtccttctgaaaggagactgtgacaatggttcatggatgggaagtttatttggaagtgtgagttcaggacacagaagtgagggaaggggaagtgaaacaggaaagaaaatacacacacacacgcacacacatatgtatgtgtatatatgtatacatatatacatatgggtgggtcagtcagctattgctgtgtaaaaaaccttaaaaatatcagtggcatatagcatacaaatttatttttcatttatgagtcttaagtgattgtcacactaatgtgtatgtatatatatatatacacatatatgtgtgtatatatgtatacatacatatacttatatacatacatatatgtacatatatacacacacacgtgtgtgtgtgtgtgtgtttctccaccctttcctgtctccttgaactattgagatgataggaaaaagctttaggcatgccaaaatggagatatatttgtgcctttcaagtgacagttttgaggatcactggcccactgatgcttctatctctttaaattcttgattcagaccaactacctagaatgaaccttttccaggagagactgttacccagtggacgaggagatggtaaggcataagtaggtgcagctggcatggtctgacaagcgtgtaccgtaaaatgaaatcatcgcaccagaagattcgaggtgataaagtaaaatatggaaatttgaacaaaaaagcaaagcaactcattggagaattaaaggcaagactaaaagtctggaataaaggggtaatcgtgcttcattttatggcagtggtttgtggttttattgattggttgactgatttgtcatttgttgaatgcctatgtgacagattccctaacaagggcatctgtgtgtgttatcttgatgaactgtaattgagaactgtagtcttgattccttaagtgtatagacttgtcttgtttacttttaatttttttcacctccaacataaccaagtagtgattataaggcatccctgtaaaccttttaagctgcttttctatgtttaaggacattcctatcttatgagtttgcttctttccaaggtgaaagccagaaactcaccttccaactttccttgctctgggtcagacacaatggtgtgagatgtccatgtggaaactagtgtaatggatatccaggtgctaggcagtgacaggcacgtggtccattgctgtgcagaagtagcagtgttggcagaggttctagtggtgcccccagcatcagaggaacaatccatgttatctctgcccagaagtggcagtggttgtgccacttctgaagcagtcctttgttgtaatttgaaagttattcctgaatttgtagtcttcagtcttacttcagtctttccttaaattcctagagcttttgtgatcaaaccagttgaaataatctcataactgattcaatgtcatactcacgtttcaaatttcaaaatgatagcctgagaactatttgaaatatcttccttccacatcaaacacctgagaatgatagaatttttttaaaaaaataataaaatatttattttagaaacaataaataaataagaaaaagtagcttttaaaaattagagaaaatgggctgggcgcagtggctcacacctgtaatctcagcactttgggaggctggggtgggtggatcacctgaggtcaggagttcaagaccagcctggccaacatggcgaaaccccgtctctactaaaaatacaaaaattagccagtcatggtggcaagtgcctgtaatcccaactacttgggaggctgaggcaggagaatcgcttgaacctaggaggcagaggttgcagtgagccaagattgagctattgctctccagcctgggtgacagagtgaaactccgtctcaaaaaaagagagagagagaaaacatttcctggaccataagctgcaaacaattcctaaaagaagggaaggctgtgggtcagtcagctattgctgtgtaacaaaccttaaaaatatcagtggcatatagcatgcaaatttatttttcattcatgagtcttaagtgatatgtgtcacactaatgttgagttttatcagtgaattaatggtcatctcagtagtgacacctgctggtcaggaagtaaactccattagtggctttccattacactctggattaagacccaaatctgtaacattgtctacagggctctgtgtgcactccctcatctctcactacttccggcctggcttattccatggcaattacgctgccttcatttagcccctcaaatcaactggaatatttctagacttgaaaactttgcacaagctgttccttctattcagagcactaacatcactctacttctccaatttgcttggcaaattcctttctcttcagaaatcagtttaacctcatcttacctataccttccctgtctttccaagctagaatagttttccttattatctgctcttatgatggcacctgttgctttctgtttgtgtcacttagtcacaatatagttttctattatatgccatactttgtttaatgtctgtttctccagtgtggctagaagatatttgagggttggaatcatgatgtttttgttcagtgttgtattatgaattattgatccagtgttgggtttttggtaggttttcaagaaatatgaatgaatgcctgtttaaataaactgatacgtcagggtatgcacaactaaattatgaatatataccagtgaattttgtgaatgtaacttttgtggttgactgagtaaaacatgcacctctgtgaaagaaagaactgtagggaatttgctagtgtttggtttcacaaaaatactgaaagttagtttgtctattattctaagattggctcttaggtaatcaacatgtgtcacattaagttgagctttaccaatgaactaatggtcactcagtagtaacacctgctcttcaggaaggacactcttccttctccccattagctataatatttttattgtcctcctcttcacagcttctatcaaaacttgaagtagacaaggacctgatatgcaatggactgaatgtttgtgttaccccaaaattcattcgttaaaatcctaacctctaaagtgatggtattaggaagtgaagactttgggaggagagtagttcctgaagggagagccctcataaatggaattagtgctcatagaaaagaggctccttctaccatgtgaggttataatgagaagacagctggctgtgaggaagagagccctcaccagacactgaatctgctggagccttgatcttggacttcccagtctccagaagtatgagaaataaattcctgttgtttataagccacctagtctatagtattctgttacagcaatcctaatggaccaagatgtttttacaacttgtacatattgttttacaatcttgtacattgtacaacaatgtacaagaagtttttagttgcctacctaaccatcctatgctctttcttgttaattagaaccaattttgttcagacctatcaacttcaagtccaaggattttataagagatgagtccagccctagtcctaggtatgagtcttgattagtttcaaccaactatgatgattatgaatagattttcattaaagaaaattgagaactccaaaaaagtagaaaacatactgatatttcactatgcaaatgcaaccactttccatattttcttgaaattccttccagtcttttttctatgcaccagtgaattgttttagcatatagtattcataacctcatatgctatcataccctacctatttacatataatacattgtgctcctttttctaagtctaattcattctaatttatttttattggctgcatatttctttaagaaattatttctcaactaacataaagatgttactgtttgtattagtttcctagagctgtggtaaccaattaccacaaactgagtggcttaaaacaacagaaatttattctctcacatttctggaggctaaaagtccaaagtcaagatgctagctggccatactgtctgtgaaggctctaggggagaagcttatccaggcctctctcatggcttctggtgttgcaggcagtcccttgccatgtagatgcgttgcttcaatctgtgtctccatcctcatatggcctatccttgtgtgactctgtatgtcttctctttttcttataagaacactagtcatattggattagggtggatcttaacttgaacacatctgcaaagacccaatttccaaataaggtactattcaaaggtgctgggaattaggacttcaacatacctttttggaggatataattcaattcgttataccattcgtctgaagttgaagaattattacaattttttctattatatgtaccacagcatttaacatcttcattcagtgttttctacatctagaattatttacttagaatagatttcccagagaggaattcctgggtaaaagtatgaaaatgagcattttaaagttcttctacaaattgctaggctcctttccaaaattaccaattgctaattgccattagcaatacacaagggtgtctctttcacctcattcttgtgagtatttggattttttagtttaaaaaatacacacacataaaatgatcaggaaaaaatagtatctcgtaatgtgcattgagatcaaacactttcccatatttgatttgctaattgcatttccctttttggtgaattttctgtttctttcctttgttgacttacctataggagtcttcatgcttttcttttctttttttttgaagcctagttcatataatgacctacttttttgattgtcccagcctaaagaacttgccttttctgcacttttttttatgtttaatttttttaaattgtactttaagttctagggtacgtgtgcacaatgtgcaggtttgctacatatgtttacatgtgccatgttggtgtgctgcacccattaactcgtcatttacattaggtgtatctcctaatgctttccctcccacctcccctcaccccatgacaggccccggtgtgtgatattcccctttctgtgtccaagtgttctcattgttcaattcccacctatgagtgagaacatgcagtgcttggttttttgtttttgcgatagtttgctgaagatgatggtttccagcttccatggatgaagctggaaaccgtcttcatggttttcttatctgtttttcaaatgtgttgcattatttttcctagtctgctggttctcattttttttttgttgttttcgtcctgcaaaaattctaattggtatgttcttgcctgcaagagtgattttgaaaatgtaaacaagtatagtgcaaacacaaatccgtcaaaatgggtgctgtctgtgcactgtactaggatctgtctgcccatctttccttttatgaattattttattattcttaaaaacagaaagtctttctcccttcaaaaaagagaattaaattgaatattcttttaatttttgtttatatacattatatttttaattaatcaggatatcttttagtatgtggaataaggtaattatttaaatatattgtgttccaaattgttagctgattgatccaacctcatttattaaataactcgagcttttctgggaattgacttgtgatgaattccttatcatatattagaatatgatagataataggatcattttctgggctgttgtccctggtgctatttttgcacatatgtcacattatttaaatctttatagctttataaaatgcagtgtacttcccctttaacattttcttcaatattcggtttctttttataggtgaatcttagaatcattttgtcaaagtcaggttgggatttttgttaagattgtagcaagccacacattaatttaagaagaatttatactttagcaatatccagcctcaccatatggtatctctctctccttctatgcaagacttcttttatatcttttcgtaaagtctttcagctttctatgtaggtcacgcagttttcattagaattgtctcatgatatattatcatttttgttgttgctggaaataggaatttttaaattattttatacattatttttggtactctttatttgtttatcttgcattcaaattgctaagttacattaaattttgatactttataccacatgcctttggagcttttagactgataagtacatgatctataaggaataatattttctatttaaaatattttttggtcagaatttctcaaacagtgtaaaatatgatgataaaaagaatttgcttttttggctcttgattttgatatgaagtgactgccaactatcagtgtgaaatacattttctttttctggtaagtagctcctcttatattcctacttgaattttaaaaacagactggtcataaattttataaagtgcctttgcaccattttgatataatttttgttggctttgacctattgccgtgatatgtgataataatagctttttatttgcaaaccattattaaaatcctacattatatcctgtatgaccctggtcctggcagacttaaaaaatatatagttgaattacacttaatatttcactttattaattattaacaatgggttttaaaatcattaattgctaataaaacagcaacgataatttgtttttgtcacatagaccttacctcataaaaagaaaagaattttacaacctagagacttggtctagtaccagaacctggggctactccaagataaagatattgttcatttacttattcatccatatgggcattgtttgtctttccactgtaaattctcaaacattttctgagcagcccctgtgctgggaagaggtagaatttccaaggtcagtccctgcggtcaagaagacttaagtttatatcctgactcttgttatttatttactggctatgtgaacttgggcaagttttctaactctgaagtctcaaatttcctcactggcaaaataggcatagtatatagcacctgcttgatagtttatatacaaatagtgtctatcaagctcttaacggcgtctgcatgccgatactcaatccatgttatgatgttattactacgtcccgggatataaagatggataggtctgtgccctgtgctggacagcaggggttatatagtaactgcatatcatctggtccttctcaagcgtccactaaaggtttgagggttttcccgacttgtatattattcagggtccctgggattctagcccatttcccttcatcgttctgaaatccacacatacactcctcatcatccaatcttcatttctacccctatataagggataagaactgctggataagaactagaacagttcaacaattacaggagaaacataagccacataaccaagtcacctgtgccataataactgatgaattcttggtggggtaagacgagttgaatatagtaacggcgggtttctgttaaagctagcatcagtccataaccttgagaactcggacttccaagggtggcctctctttgctttgtcagcatgaatcagtagcctcagctgcagaaaagattcagaacatgcagatggcttcactaccccagtgctgtcctgatctctcctgacacaagctaagtgtcagaggtcttggccttgattgccttttaacaactggcctctggattgaacatgcttcatctgtatcatcaaggttggccgcctgttactttcctggtgattgtgatgatttattttattttgcaaaaatgatttattttcttggtctcccctcctttgaagaaacttagctaacttgtcttgtctctttgccctctgccccggactctacagtaagtctcatttcagaacactgcccctccttcccatgggtaatggggtttctgcaaaggaagcctctttgaaccttttgggctgctgaatcgtgtcagcctggagacaagaagtttgttatgctcattgtgtcagctgcagacataattcatgaaaccatcccagacacaggatgtcaccaagtgatgcttcaattttacagtctcccagagctcctgttggcaaacagtgttggatgaaagctgggaggttttcaaaggccatgggccttcttttcctgccccttggttcccctttactttgcctcctccatctttgcctttctgtatgggtcatgctgtgtgcccctaagatttttaaagccaattagcaggttagagactgtcgaggcatattgacctgtgagatcacagtatttactgtcaccgtaatttctcataatattgaagcttatactggccctctccatggctttgttcaaagcctggtggggagaaggctgtttagatactgtaatcagaattcttgagctgaaccgttttttaattacagctttgatagggagctgtgcagtttgggaaaggagtccagctgggagttagcatctctttgatcacaaggctgaacgattcactttgatcacggagacaacagttcataaaagagcctggtctctttctgaaatttgcaggtaaacagagggatcacttgaatgatccctctgtggaatgagcaattcagatccaagacaatggtcttctttgaactggatttagaggcctattgattagcatagcaaaggggattgatgggtgaaaaaaggtggctttagtccctagacaggtgcatcaagaggtcactggctaggtactctgtggttgggctcccaggtttgggatgaatccctctttcgggactgcatgttgttcaggtaaatctgtatacaaataaacattgcaggtaacctcagagggaaaaccttgatctaaagaaggtggttctaacaataggaagctagcaggctttggagtcagggaaccccgagataagatccttacctctccatttgtttttttaatatgcaggaagaggatctagatgcctaagcccttctgtgcctaaagtcttttatctgtacaaattggacatatttaggttggtgcaaaagtcgttgggcttcaagggttattttaaaggtttaatgatgtgcattttgagaaagaaggcctgctaggtgccagacatgttgggaaagaaaaaaataccaaggtgtcctaaaactactgaaaaattgtcctgcctaggctactgaaaggaagctatactggattttcctgagcaaattgttttaaagtgctatttgatttatattctaatgggatttgtttgaacattttgtatataagaagttccatttggctaaattatagtgcttgagttttggggggttatgggggtactgccacatgccacatgggggaaccatataaccacagttgctgagttttaggaatattagttgggcagggattatttagaatttagttgtgaatgtgacgtgtgtgatttggttggttcctcttgtattaccccatatcactgatcacttgccatctggttgggacatacagataaatcaccaagatctgacagtcactgcaaaaagacattggccctgaataaataagccagtcgctttgaacagaaaacaaaaggcccagggttgtcgatgcctaagacttggctcctaggaaggaaacacaccatctacagaatggctccatcagactttctttcccattcctctcctgtagctgcctacagctctgctattggctacttgcatttctgtgtcatggccagcactcttttatggggagcaagtggggttggagaagggagggaacggtggctttgtgtggagggtccacctaagaattcctgctatgtcttttttttttttttttttttttgagacggagtctcgctcagttgcccaggctggagtgcggtggtgtgttcttggctcactgcaagctccgcctcccagattcacgccattctcctgcctcagcctcccaagtagctgggactacaggcgcccgccaccacgcccggctaattttttttgtatttttagtagagacggggtttcaccatgttagccaggatggtctcgatctcctgacctcgtgatccacctgcctcggcctcccaaagtgctgggattacaggcgtgagccaccgtgcccggccaattcctgctatgtcttaatcaagggatgccgggaaagtgaggtatgggacctcctagtcattaaaaagaccaggtcggcaacactacttcatgccattttaatgagccattgttgaacacctactgtgttgttttgctttggcttccatgacaaagtgccttaaacaggcttaaacaacagggtggcttaaacaacagaaatgtatttgctcacagttctggaggctagaaattcaaaattttaggtgtcaacaggcttggtttcttcttcttcttttttttttttttttgagatggagtctcactctgtcacccaggctgagtgcagtggcacgatctcagcccactgaaacctccatctcctgggttcaagcgattctcctacctcaacctcccaactacatgggattacaggtgtgtgccactacacctggctaatttttccagttttaatagggtttcgccacgttggccaggctggtctcaaattcctgacctcaagtgatcctcccacctctgactctcaaagtgctggggttacaggtgtgagccactgttttcttctaaggcctttctccttgatttgatgatggcccctttcctgctgtgtcttcatctggttcttcctttgtgtgtccacaggtctgtgtacaaatttcgcttcttataaggacaccagtgatactgaatttgggtccatcctaatgacctcattgtactgtaattatctttttgaagattctgtctccaaatacagacacattctgaggcaccagaggttacgacttccaacatacgaactttggatgaaaacgattcagcccgaagcacctggtctccatccccatccctaggaatccttttctctgtttcctagtaactctgtgcctcagtgtcttcatctgtgaaatggcatcgatagaaatattttaaggaatacatgagttgagctcacgaagcagtacctgacacagagtaaacgttcagtaggtattagctattatggtggcaatcatttcaactttctgacaagtgcccttgaaatttccttttcgtctccctacaccaggattgttttcttttttctgtctttttcttttgagacagagtcttactctgttactcaggctggagtgcagtaccacctttgcctcccaggttcaagcgattctcccgcctcagcctcccgagtagctgggattacaggcacccgcccccatgcccagctaatttttgtagttttagtagagacagggttttgccatgttggccaggctggtctcgaactcctgacctcaggtgatctagctgacttggcctcccaaagtgctggaattacagttgtgagcctctgtgcccggtccctacaccaggattgttaaagtgtgatcaggtgaccaccagcatgaaaattctcaatggtgggatgaatctgagatggcctcaggtctaagaagcccagccctggggtgggtgcggcagtttcttaagacaacaacctcctgagaacagggactatgtctgagacatccgtgaatcctggacctctcccacttggggcttggagcccgtgttcatccagtgcttactgcaccagctgacagctggacgttttagatgggagaggagggagacatcatccagggtacggtatgatgaaacaaaatacaaggtacaaatgacgttttggacatttcctaaatgaagaagctgaggaggagagtgctgtcagcttgaccaatttatagttttgaatttgtgcccagaagctgttttcagagaggatatttttagaaatatgaaaataaatacaattaaattagagagatatgtcaagtattttttttcttgttttaagactgtcctctgaccattacagcttaggtagtgacaactctttgaataacagtgccgtattttctaattaaacaatcaaggctctccagtcattacattaacgaagataagggtcaaaaggctagaacctagcaggaaaggaattttaaatggacagaaatggcaataaaaatggaaaaattttttctgacttttttctgtattttattaacactttgtggcctgaatatatttaaatagctccttgccacttaatgtaaaagtcagcctttggagatgagaatacacacacacacacacacacacacacacacacacacacacacacacactttagaatcaggcagacctagggttgcaccctggcttactagctgtatggcctcaagaaggttccttaacctctcagaatctcagtttgctctactgcagaatggggagatttaataccaacaccatagtttggctgtgggaattaaattaaataatacatataaaatgaatatgcatttgacccatcatagtcaagaggtagggaatgttgcttaaattattttttttcctgtgtccatgtgttctcattgttcagttcccacctatgagtgagaacatgcagtgtttggttttttgtccttgtgatagtttgctgagaatgatggtttccagcttcatccatgtccgtacaaaggacgtgaactcatcattttttatggctgcatagtattccatggtgtatatgtgccacattttcttaatccagtctatcattgttggacatgggtgcagcacaccaacgtggcacatgtatacttatgtaacaaacctgcacgttgtgcacatgtaccctaaaacttaaagtataataataattttaaaaaattatttttttctcaaccaaatcaaatgtggctcaactggcagatactagagttggctaaaaaaaacaaaaaaaaattctaacttcttagtgactccttcttagggttgttacaagagttggaagatatttataaggggtttccaaggctgaggacaccattctgaggttttgccttgcctaggaccacatggtgcagagacctgctggtagcatctgcttccctcttttgggtacacttagccacactgctatttgcctcagctcccaaagatctggaaataacagcaaaatctcaggcaactatgcaggtcaggtcaatctgagatttagatactattaatgacaacatctggaatttgcaggcatactttatagatattgcacgttcagtttgtctcaaactacaataacatgaatatcataataaagtaagtcatacaaatgttttatttcccagtgcatataaaagtcatgtttccactatactgtagtctactgagtgtgagacagcagtatgttaacagaaacaatgtacataccttaattttaaaatacttaatagctaaaaaaaaatgctgtcttcttcagtgagtcataatctttttgctgatagaggatcttgcctcagtgttggtgactgctgactgatcttagtggtgattgttaaaggctggggtagctgtgacaatttcttaagacaacaatgatgtttgccacatcgattgactcttcctttcacaaaagatttctatgtagcatatgagactgtttgatagcattttacccacaatataacttctttcacaattggagacaatcctttcaaatcttgctgctgctttctcaagtaagttcatctcatattgtaaatcatttgttgtcattttaacaatgttcacagcgccttcaccagtagtacattccattgtagggaaccactgtctttgctcatccataagaagcaactcctcatctgtgaaagttttatcacaagatcacagaaattcagcacaccttcaggctccgcttctcattctagttctcgtgctattttcaccacatctgtagtgatttcctccaagaagtcttgaactcctcaaagtcatccatgaggattggaataaacttcttccaaattcctgttaatgttgttattttgactcttcccatgaatcaaaaatgttcttaatgatgtttaaaatgatgaatcctttccagaaggttttcaattgaccttgccaagatccagcaaagggatcacaatctatggcagctacagccttaccaaaagtatttcctaagtaataagacttgaaagttaagattactcattgatccatgagctgcagaatggatgctgtgttagcaggcatgaaaacaacattaatttccttgtacatctccatcagggctcttgggtaatgaggcacattgtcaatgagtagtaatattttgaaaggaacctatttttctgagcagtaggtctcagtagtgggcttaaaatattcaattaaccatgatgtaaatggatgtgctgtcatccagggtttgttgttccatttctggagcataggcagagtagatttagcatcattcttaaggttgctaggattttcagaatggtaaatgagcattggcttcaacttaaagtcaccagctgtatcagcccctaacaagagcgtcaacctgtcctttgaaactttgaagccagacattgacttctttcttactgtgaaagacctatatggcatcttcttccaatagaaggctgtttcacctagattgaaaatatgttgcttagtgtagctgactttatcaatgatcttagctaggataacttgctacaacctctccatcagcacttgctgcttcaccttgcacttttatgttatgaagacggcttattttcttaaacctcatgatcctccttctgcaggcttccaacttttcttcagcttcctcacttctctcagtcttcatggaattgaagagaattaggggttctggattacactttaacttcaggaaatgttgtagctggtttgatcttctatccagacccttaatactttttccatatcaatattaagactcttttgctttattagtcatgggttcactggagtaacacttttaatttccttcaagaacttttgctttgcattcacaacttggctaatggtttggcacaggaggtctcgcttttggtctttcttagcttttgacatgccttcctcactgagctaaatcatttccaggttttgctttaaagggagacatgtacgattcttccttttacttgaacacttaagaaccactgagatattattaattggcctaacatcaatattgttgtgtattagagaatagggaggccccaggagaaggagagagacaagggaatggccagtccatggattagtcaaaaaacacaaaatatttatcaattaaatttgctgtcttatatgagcacagtttctggtgacctcaaacaattacaatagtaatattaaaggtcactgattacagatcaccataccagagataataatgaagtttgaaatattgtgaaaattagcaaaatgtgatatagagacactaactgagcacatgctgttggaaaaatgatgtcaacagatttgttcaatgcagggttgtcccaaaccttcaattagtaaaaaaaaatacactaaagctgcaaagcacaataaaggtatgcctgtattaaacatacttcagtacaaaagagtgatggtgtgtttgtgtgtgtgtagttcagctatcatccacatgctacacacattctaatgaggagagcacaattccaatgtgcttcattaacaccaaacaggaagcccacattctgaaggacacaggacaaaggtgaagcagacattcatatttgctatccatattggatcaataactcaggctttcttgaataacctagtgaatgtctgaaatagtttttcagtgatgaaattggcctgttaactaggatgatgccaattagaaatggaccctctgtggatagtgacattaaaggtatatggctgactagaatattttggagtcactttccacaatggcatgattcctgcaaggcctcaggcctgtgctcccagccatgatgccctaggctagcatttgcttactctctgaccttgtttgtgtcaccttctttgcacctctcttccctccctccgtccctccctccctccctccttccttcctctctccctccctcccctccccttctctcccttcccctctcctctccttccctcccctcccccttcttcccttctttgtcttgctctgtcatccaggctggagagcagtggcaccatctttgctcactgcagcctccacctcccaggttcaagtgattctcctgcttagcctcctgagtatctgggactacaggtgtgtgccaccacacctgcctaacttttttttttttttaatggagatggggtttcaccatgtcagccaagctggtctcaaactcctgacctcatgtgatcccccaaccttggcttcccaaagtgtcgggattataggtatgagccactgcacccagcaaacacctctttttcttaagagctagctcagatcttcctcagggaacaatcatgcttctgactatttcattgttctgcctttgcatgcacagctcatgggtatggaatgtgttagacatgagcatgtcaagcatacaactattattcttgaaacgggagagttccctgaaccgctctcaggacttgtgacaggagtgtggctcatttactcagccactgtgcactcaaatcccttacgggaaggggagcatgcagacaggcaggtgcaggagccaaggcaagtgcttttgggctctggccccatggtagcatctaggagtgtgttacaattaatgcccttttagcagttgccatctgtggagggctgaatgttaaaccagctcagtggaaggtcagggtgacagctttttacactctgccctcttggtacctgggtccttgtccagcatccaggaagaaccaggtcacatggacttgaaggatggtgaatttggggattttattgagtgatgaaggtgactctcagtgggatggggagctggagaggagatggagtgggaagatgatcttcccctggagttcagccatcctgcagctgatctctccaattgcccccaactaaactcctctccatgttcagattcttctgttctctccttctttgccatgttgctctgccattctgccactctgctgctcttctgctcttctgttcctctgctcatctattcttgagcctgggatttatatgggtacaggatagtggggtgtggcagcccaaaaggaaacacttgggcacaaaaacaggaaggcctgttccatttagggcttcaggtctctaggcttgagggtggtgcctttgccagggaaccaccctcttctatccagtgtttccctgcctcctgtccctatcactctcacctcctttgcctcctgttgctggactaacaggtggagcgactactgggtctctctgtgttctttctccatgggtctccttagctgctgagtagtgtggagagtttgctgttcatcccaaccgtaagttatggcaggactgcctcctgttggcccaggccatggggtatgggctctggttcaacctttgatgtgcccctgtactctgtgagttcagggctcatttttgactcagaatctagctggtccataacactcccttcttcctcaggatgagatcttttttctttgctcatcctactcattctctcacctcctcacacagtctgtaggcaggggttaggaaggatttttcatatgagttgagttcctggaaaaatacccttggaggctctacttgtttctattctctttctattatcatctatccgtctaccatccacctgtccatagtcatggcaaacatttactggacatcaattggataccccgtttttgctagtgaaagggaagaataatactttttaaattcagcactcatagtttctcagattgaatggacccctgcaacaaaagacagatgaacaagagaaaaacaggcacaaattaacatggatatttcatgtgtacatgagagacacccagggaatgagtaattctccaagaggtagctttgaattccaagtcgtatagcatcttcaattaaaagaacagtacatttttagagaaatgagaagacaaaggaaaggactgtgagtctctcagggcagcaacttgtaggaaggcaaatacatagcagagaaaggtgagttagtagagcttgttcatatagatttctttggtgccatctccagatgacagggtctaaatttatcttcagtggcactctctgatagaaggagggaaagataccttttgactttgtaaatctgggtcctgcttttaggtaaatagagggaaggtggagagctttcctgcatttgcttcttcttaattgcctttacctaaacaatgcttcatctttggggatggcatattctgatcccccatactagtaagacaggattcctgcccttgacgagcacttttagtggcttgggttggagggagatatctgtggctgaataaatagttaaaatattttgtttaagaaataaaaacaattaaaacacaaaagtttaaaatattcatacacatgtataaatgtggtaagtgtaattggtggaagagatatgcacaagatattatgggctctcagaggagagtccctaacctacctgtaagtgacctgaccttactgtcttgggtactgcattaaaattcctggaccccaatgtagtcagaatcctgcctgaacttgctattccttttgggcacccttctgaggagactcaccccctaccccagcctgcctgtggagctcagggacagctggggtcagcagtggggcttctggaggcagatggtctgactttgaaacccaactccactagctccctagctgtagcacatccaaaaaccatgtaacctactttattcctttttcagttctttatctgtggaagggtggtaataatggcccctatcttacagacattgcctttaaggcacctttcactgggtttatcaccttagaaactttttatcacatttagtttttgttgattatttgtatcacatcaatgcatcacctcctagcccagcctcccaacccctcaggccatattccagttcctgggattccatcgaattctagacctcttgcccacacacttacttcatgtcccagtcactaaatttctctgttggcagatcagaaaggggaggattttttacccatttgaaactactttactaaaaaaaagtaagtttattcccaaagtgctcaattaatagagttaaaatagattttaatttataaatatttaactcacaagcaattctttgtcccattcattctttgaacaaattttttttaatgaacacttactatgtagtaggttctgggaagatagtggtgactcagatacatggttccagacctcaaaaagctgaggatattgcagggtatgcaggtaagtaaaccaacagcaccgcttaccaacagcaccacttaatttcttatgtgccccaaagggaagtggaaggcatatgggaatatgaggaggggctccggagtcaaataggggcacctataaattgtaccactaaaaagctccttcatagttatttactcaaataggattgagtcctccagaggttctgtaaacttaagttaggtttaaatgttctgtttcattaacttcaggacaaggtgtagttctaggtgatgtacactgtaggtgttaaacaattcattgttctcaaaatgtggccacgtaagtttcatcctatggataagtataacacagtattatttttaaccctaaagttgaaattagcaggaaagagtttgaaatgggactgcctaaaaataataaaaaaaccattattaagacatcctgacaactgcaattaagggttcaaggaagagtctcctttctattgccctggtttggagaatctgcagaagccgctaaagcttcagagaggggatgactcagagggacaagtgcccacaggcatatgcctgctgcattggaacagaaggaggaaatccaagtgttctagctgtggtaatggttttcctggatttgaaagcagatatcaagatatctcaggagagtgagtgtgttttctttgaagatagattaatcaatgtatctagtcccttgatttcttgaggaaggctgtttatgctccaaagcccctttctctgtgttggtgactcaaatctatgagagatttacactgatttttctccatgtacaaaagagttcgatttcctcgagtgcctatgggatcttccatgtttcaatttggaaagtgcaatgagcagagcttcagaagagagtgtttgctttctgtgaagctctctctcattcacttggcttagacactgcagggagggctccatgatcacagacaaatcttatgtggctggaaatgccagtctttctaattaatgagtatcaccaatttcaccccctagttggagtgggtctgcaaatgacagacactggactggtgggaagcatatgaactgcagagacctgtgcacagtgctgcccctgcctccagccatctgtgtggttcttgtcaagttccttaacctctctgactttctgtttctttatctgtgaaatacagatcatgttcgctttctatggtttatagtaggaatgaaatgttaagaaatggaaggcaggccgggtgcagtggctcacgcctattatcccagcactttgggaggtcgaggcaggcagattacctgaggtcaggagatcgagaccagcctgaccaacatggagaaaccccgtctttactaaaaataaaaaattagccgggcgtggtggtaggcacctgtaatcccagctacttgggaggctaaggcaggagaatctcttggacccgggaggcggaggttgtggtgagccaagatcgcaccattacactccagcctgggcaacaagagcaaaactctgtctaaaaaaaaaaaaaaaaaagaaaaaaaaaggaaaagaaatggaaggcaaatggtacatgtcaagtactggaaaactgctaatttctttccctccctcccttccccactgaaagtatcaatgaaagcagacaagagctatatttgcatgtgtataatcaagttcactaaattggagaaaaatatatagactgaaattagtgaaatggttgagatagttttgtgaattaacatgataccaatatagaaactgggcagaattttccactttccagacactagttagcctacttggcgaacataaatcttaaatgaaggattaggtcaataaacccttcagcagacagacaatgctattgctctcagccctgcctctcaccctacagactggagaacaataccttatctttgtcagatccctacaaatttccacacattatttcatgcagccagcaaaaagggtttctgaattagatcggggaggaattattgtctccattttgcagatgatgaaaccgagacacagacatttgggtacaagaagagaggcagcagaaagtagaattcaggtctcagtttgctggcttcttgactctgctgttatcaggcacttttgcttgactatataatgtccacactctctgctttgtccctctcgacattctacaaattttgttcactcactcatcttcctatacttatccatgagtctgacaaggtgggtcccactcccccacatgtaaagccagttttgggaaacattgaaggaaaggggatgctaagtaaatctgtctaagtagtggctcttggaggcattcaggtgtagtgcttcaggcttcctgtggctgtgtcagcagtggccctgaccaagaacctaggggggcacatagaagacttgtgtcttggtctagggcaagggttcttaaatttgaatgggcatcagaatcacctggagggtttactaaaacatggatttctgggccccacacccagaattcctgatttcataggcctggtgcgggcctgagaatttgcatttctaacaagtttctaggtgatgctgatgctggtggtctagaaaacacacattgagaaccgttggtcctaaggaggagtgggtcttaactttgaggattaactgaggagttttaaaaattccaaagcatagccgagtgtggtgtgcacctctgtagtcccagctactcaggaggctgaggcaggaggattgcttgattgagcccaggaggttgaggctgcagtaagccatgccagtgtcactgaactccagcctggatgacagagtaagactctgttcccccgctcaaaaagcaaaaaaaattccaaagccaaggctgcactccagatcaatttcatctgaatctcagaaggggacccaggcctagtagtttctaaagcttcctaggtgatcatggtgtatacagaaataactctagggagtttagaaggcctgagtttaaggcccgcctgtgactgaggggtggtggttggtgcagtagatcagtgattctgaaatatgtaaggggaaatgctgtcacattgtacaactctttgtgagcagatatcaaacttgcactcagtatagtcctactattttatccattgtgaaatttcaaaaactcaataagcatgtgggatatttacatttgttccaagaaagcatgaacggtggcatgcaggaaagagtgtacatagcaggcttgatgtggctggttcgatgggcttgctttgcagtagaccattggctggcctctgggaacctggctttggagtattccctatgttattaactgataagactgttttgtgtgcctagggcactgtaccagcttgctagactttgtattctgctttctttagtgatcagatgcctgggtgaccagcccccccgtgaaaaccttggacactgggtcttaagtgtgctttgttaggcagaaacacttcacatacattgctgcatttcattgctggaggaaggagcacattctatatgattgtccccttgagagagagaacacataaagcacactaaagcaaggatgcaggtacaactgcctccaagtcccatgagtccttgcagccaagtcaccaaatgggtgggtgtttgtgaaatgtccaaaatagatgggtgaagtttttgtgtaaaattagagataactttttgtatggaatgtagacaaaaataagatttcaggggcctctaaatttattatgctaaggaagaattaagccctggagattgagtcacagagcagttttgcaattctgtgtcttagatgatagattaactcacttcttcattgttcttattctgtaactgactaggggagaccagagaccaggccctccccattccggtcagtgatctttgttatagattaactgcctcctttattgtcccattcctaactccgactagacactgcaaaagaccccatgactgctacaccttcagtgtgaaatgttacatatacatttcctgaaagaaaaaagactacttaaactaattagatcattgtaactatacattaagccttatataggaagatgttaaactttgtctacataaacaatctcaaacttctaccctttgaaacaccgacttccattttttggaatttgcctttcctgggtggctatccttaaacaattgcgcttgaataaactctctttaaactagattctgacccttttgattattttaagttgatataaacatatactgaggagactttatatgtagccatgcatgtttaaagatcttctgtatgtgaaatagaatccagttaacagaattagaaagaggatattaagcaaatttgacagtcctaaaatcacaagaagaatgaagatagaacctgaaaacgtttgcgcagacagtggagaataacatcatctgcggggagactcagtgatggatagatggctttactgaacctgggaactcgtacctcctgctggcgtggccatgaacacagtggatcaactaaaagctcctgaattcttattgctatcctatgctgtttctcaccattcctgcatctatatgtgatcgcagagcctgctttataactcatcagctaccatagcagctgactttttctgccacactctcaagagtcaacaaagagaggccaagcattctcccccactccccactgagagagtaggattgaaggagagagtgtgaacaaagggtctcagaaggttgagaaccactgaactaacattctctaaggatcatgatgaccctgagattctatgattctgagtccaagcattctgagtcttggttccacatctgtaagatggacacacccctgttgactcacagcattgttgggaagattggcagaaagttctaaagaataatggtggccgggcacggtggctcacgcctgtaatccctgcactttgggaggctgaggagggcagatcacgaggtcaggagatcgagaccatcctggctgacacggtgaaacaccgtctctactaaaaatacaaaaaattacctgtgcgtggtggcgggcacctgtagtcccagctactctgaaggctgaggcaggagaatggtgtgaacctgggaggcagagcttgcagtgagctgagattgcaccactgcactccagcctaggcaacagagcaagactccgtctcaaaaaaaaaaaaaaaaaaaaaaaaaaaaaagaataacttgtcagaacaaggaaggaggcatgggctccaaatcatccattttacagaggaggaaaaggaaacacaagccataacttggctcttttgttcagttaaagtcagagtcaggactagaatgcaagtctccggacccctctgtttggccatttgcatgcatgttaaagttctttattaactttttgctgctaggcaaatacagtcaagtgtgctatgttatattgagtgcctactgtgtgctagatgctttatgtatatcatctcttttactccttacagaaattaaagatgggaacactcagagacatacaggactacttaaggtctatatcagtcctgagtttaaaactcagatctaagttctcaatcattttctctcatgtaatctttgctgcagtaataataaaataaatagcatttcctgagtgttgactatattccaggcaccatagcaagctcttcatgaattatcttatttaatccctgcaagaatgttagcatgaatcgtgatctcatcagctgatttcatccattcctaaggcagcagagtctctgttaaatcagtgctgagtgtgtggtaaattattaaatctcagtgccagtcctaggattctgagaccaagccaaatgctagtgattaagattataactctgatttaggacagtgttgaggctaaagccatttgtaactggacagtcaagtctacactgatcaaaatcagcctctgccccaagtactcttggaaatgatggttttcatttcattctcaaactgctaagttgtaagagtttggtagtaacattgatttgagtttgaatcctagcattgattctaccaggattcatgcaagttatttaatctttctgagccagcttcctcatttacgtaatggggatatatacaacagaaactgccttcttaaatattcaaagtatttaataactagcccagcaaagacaccaagctattagtgtgaaaaccccatggaagttccctgctgagctgaataaccagagcagggcagttcagggggtctctggggaaggttcagggtagtgctgctggtctagcctttcctctccgtttgtcatgttctccacagatggatgtggcagtgaacttggagtgggtggggaggattttggagactgagacaagaaaaaaagaaagctaggaagttggtgagaggatctgatatggtttggctctgtcccaacccaaatctcatcttgaattgtagctcccataattcccatgtgttgtgggagggacctggtgggaggtaattgaatcctgggggtggttgtttcccatgccattcttgtaatagtaaacaaatttcatgaaatctgatggttttataaagaggagttttcctgcacaagctctcttgcctgatgctatgtaagacatgactttgctcctcctttgtcttccaccacgattgtgaggtctcctcagccatgtggaactgtgagtcaattaaacctctttcctttataaattacccagtctcaggtatgtctttattagcagtgtgagaacagactaatacaggagcccacgaggcccacaaatgtggaagttcttgcctcaaatcaccaagaggaggttgcagctgaaactaagaaactagaggtagtggaggacagtgactctgttgagttaccactatgtactaagcatgttttagagggtagttctaaaagagagagtggtttctagaggtagatgtcctaagtgtaatgtttgttccatcacttacttgctgtgtggcgtagaaaagtttcctagcctctatgtgactcactttttccatctgtaaaatgggaataataatagtacacgtcacatttagaagtgagaattaaatgctgagtaaaatgctaagaacagtatctggcaaaaacagggcacttatatgtgctgactattaatattataattaatattatatctgaacattttatttctttgattatatcacagattttatattatggtctccatttcatagatgaaaaactcgaggttcagaaagataaggcaagataaggcctgattcggggttagaatccaaatctttctgattccaaattcaaactctctccccaagtcttaggaaaaagtggtaaatcatgctacataatatgagatattaatgaaagtgttctgatgatgtatatgacaaccagttcatagtatctgaccacgtgctattaagtaaaaacacagaacaaaaacaaaggctcagtgcagcttactaattcttgtgtaaagggggcatgggaagacaggtagacgtgttctggaggaagtttgtaccagcttgtaaggactgattgttaaattttcaggatttgttccggctagttggcatacacatggtattttgaaattgacatggtaaggaatatttacgctacggaaacaggcaaacactatgttggaaagataaaaactactacagaatggtaaactacgaaagagggcagatggggtagaataaggggtagaaacaagatttttctgggtagaactttctatatagtgcaaatgtattaccattaataaaatctaaaaataaaaatacctcaagtcaaataccaaagtcagataccaaactgtcatcagagtgaacagacaatctatagaatgggagaaaatttttgcaatctatccatctgacaaaggtctaatattcagagtctaccaggaacttaaacaaatttacaagaaaaaaaataaacaaccttattaaacaatgggcaaaggacatgaacagacacttctcaaaagaagacatttattcagtcaacaaacatgaaaaaaagctcaacatcactgatcattagagaaatacaaatcaaaaccacaatgagattacatctcatgtcagtaagaatggtgattattaaaaagtccagaaataacagatgctgatgaggttgtggagaaaaaggaacacttttacattgttggtgggagtgtaaactagttcaaccattgtgaaagacaatgtggtgattcctgaaagatctaaaggcagaaataccatttgacccagcaatcctgttactgggtatatgcccagaggaatataaatcatcctattgcaaagatacatgcacacatacgttcactgcagcactattcacaatagcaaagagatggaatcaatccaaatgcccatcaaggatagactggatagagataatgtggtacatatacaccatggaatactatgcaaccataaaaaggaatgagatcatgtcctttgcagacacatggatggagctggaggctattattagcaaactaatgcaggaacagaaaactaaatatcacatattcttactcataagtgggagctgaatgatgagaacacgtggaatcattgtgggtggggaggaaaaatacacactggagcctgtcagaggattggggatgggaggagggagagcatcaggaagaacagacaatggatgctaggcttaatacctgggtgatgggatggtctgtgcagcaaaccaccattgcacacatttacctatgtaacaaactggcacattctgcacatgtacccctgaacttaaaataaaagttggatattttaaaaaagaatacatgattagagagagagagagagacagagagttcatacacacattcacacatgcatccacacatgtacatgcattgtttattgtagctcttaccatggaaatagtagcaatgagcacctctagaatccatattatgatcactaattcaattccacagtgaaaggaactagagattcctagaaaaatggcaaatttcaggtctgaggcaatcacccccctccccccaaaaaaatgataatacaagatgaactaaaggcctttcattgtgctaaaaagcaaagaaactttcaaagtttactactgtaacataaaaaagacccaggagccaacttacaaagtgtcatgaaatgttatgagaatttgaacataaaaacagtaataattgtaatagatttaaacattcagtcaataaaaatccacaagtctatagtaatatttagaaaatgaaaagaaaacccctatttcttatcattttaggcagtttaaaacaattgattacagtctgcccttcatattcatgggttctgcatctgcgggttcaaccaactgcagattgaaactacttggaaaaaaaattcacaaagttttaaaaagcaacacattgtttgctacatgatgagtattacattgaattcacgtaaattaagtgatgtggcagcattatatcagatattataatattctagagatgatttgaagtatatgggaggatgtgtgtaggttacatgcaaatactatgtcgttttaacggacttgaacatccagtgattttgttctatcaggggtcttggaaccagtcccccacagagaatgagagagaactgtactttgaaaattggtaattacatggatagtgttaagcaagtatctttcttttccagtagaatctatgctttggtgttactaaatagccctagttaagatataaatctccagtgtataaaagaacatcagattaagatataaatatccaatgtataggtaaataggaaaggagtgattgaatttttaaaaactttaatttataaaccctcttgacaatattgtttggagcgaaaagtttccatagatgttaaagtcattagatgaacatttgatggacaactggatgtttgaataatgtcaataaacaccacataggttgctttctggatgcaggtgaaaaatgacaactaaaattgagttcagtagtattcaatcttagcttccatagtggtgtttattagtttgcttgggctgcctaacaaactacaaactaccacaaaatggttggcttaaacaacagaaatttattttctcacagttctggaggttagaaatctgagatcaaggtgtcggcagttgtttcctcctggggcctctttccttggcttccagatgtccaccttctcatgtcctcacatggtctttactctatgtgtccaggtaactgtgttcgtatttcctcttcttttaaagacatcagctacattgaattagggcctaatgacctcattttaactcaattatttctgtaaagaccttatctccaaatattccaagtattctgaagtactaagggttaggactttaacacacgaattgtaggggttcacacttcagcccataatggtaggttaaacaaagaatatgtatttttgaatatgatgtgatgcaacatgtagtatactacaatatccatcatgtgttctagtcaaaattatctaaattaattacatcaagtttacaggaaatacaaagaataaaggaacaagctaaataatacccctaggagacaaccaaacaaattcaccagctgggacaatctgcaggacgacgtgtccagtctttttaacaagtaagatttttttaagtaataggaaatgcttacaaataaaagagacttaaaggaataaacagcatgaactgtgctgtattggattggatattgttttaaatgatttagatgtaaagattgggggttaattgaggatatttgaatattgcctggatagtggagaaaaaggaactttaccaaatggaaaggtaataattatggacccaaaacattaagtaccgtataattttacattgattttaaaaagggctctttgcttctgaccaagacaggaaaaaagagatcaaatttaccctgtagcctgaaacaaccaaaaaaacgtaacaaaatatatgaaacaatgatttttggaacactggacattagaaaaatagtgacagtgatcttcaagagacagtaaacacaataaagtgagcccagcttctccagcttattgaattgagggggtttccaggctgtaacatagtgggagagaacccaggtagagcctggcaaacttcatgagttgaggagatgaataaatgaggtaatgaagcttagagtctaagaagatcaaagcaggtagagttcacaagatagcataccagagaggagacagctgcacacagagagaaaaccagagaactgcagagggactcccacttaagtattcaacagaattctgatcaatgcatatttgtgaggaaagtacctgaggcctctaggggggcgggggggaacaaacactggaaaggtttaaggcagggatgtccaatcttttggcttccctaggccatattggaagaagaattgtcttgggccacacataaaatatgctaaaacaaatgaaagctgatgggctaaaaaaaagttgcaaaaaaaactcataatgttttaagaaagtttacaaatttatattgggctgcattaaaagccatcctgggctgcatgtggcccatgggctgtgggttgaacaagcttggtttagggaaatcagtgcctggagctcagagaggatcagaatactgtatgttcccacaagtcaaactggaaaaacctcatgattcataggccactgggtggagtacattgaaggattttgccttagtaatcgctaataaataagcctagactgagcattgttcttgtcatatattagtaaacattaaaagcaatactggggaaaaaaagcaatactggaaaggatcaaactattttaagtaaattaactgtgtcctgcaacaaagttcacatatatttatataaatacaaaaacatccaccaccacacagggtaaaattaacaatgtctggcatctaatcaaaacttatgagacatgcaaagaaacagaaaaatgtgatccatagtaaggaggaaagacaatcaataaaaaccaatagaactgacagagatgtcaaattagtagaaaagaacatcaaaacagttgtaacagcattctatgggttcaaaaaaaattaactacagacataaaatatataaaaaagacccaacataatattctagaaataaaaactacaatgtctgagataaaaaatacacttgacagaattaatggcaaattagatgttgcagaattaaagattaatgaacttgaagacacagtgatagaaactatttaaaaataaaacatggagtaaagggtgaatgatagtaataaaaaagatgaacagagcatcattaaaccatgctacaactcccctggcctaatatatgtgtaattagtcctgaagaaaagaagagaaagataaatagatcaaatagttaaagaaataatggctggaaaatgtacaaatttgagtgaaatctgtaaatccacagatccaagaacctcaatgaacccaaagcacaaaaattatgaagaaaacagcataaagatgtaccattgtcaaattgctcaaagccacaggtaaagggaaaatcttaaaaatatccatacaaaaaagataatttatatttagaggaacaaagtgaagagtgacagaattctgaagaaagaatgcaagtaagaagacagtgaagcaacaatttgtcaatactaacccctcaaaaaaaactgttaacctagaattttacattcagaaaaaattgtagaaaacaaaggcaaagtaaagactttttcagatattcaaatgctaaaagaagttacaaccagcatacctatactatgggaaatacttaaaggaagtcccttaggcagtggaaaaatgataacaatttacgaatgggaaacttgttttaagaaaggatgagacaatgttgaagataaagtccacagcagacaagacaatgttgaagatgaactctacagtggcagatcacccacatcaatttgcaagaaaaaaattcatcttttttgtgttctaactgaagaggaccagaaatcaatagcagaaacaagagccaacatcatagacatctcaattggttcagcttacactattctgactgaaaaattaaagttgagtgatctttccacccaatgggtaccaaaaccactgtgtccaagtaagctgtagacaacagcagagctttcaatggaaattttgggaattgtaaacaagtgggattaagattctgaaacctttctttgaagaattgtaagaagagatgaaacaaaattgtaacaagagatgaaacttggctttaccagtacaatcctgaagacaaagcacaatcaaagcaatggctaccaagaggcagaagtagcccagtcaatgcaaacgctaactgggcaagagcaaaggccatgacaatagttttttggaatgttcaatgtgctttgcttgtaggctttctgaaagcccaaagaatgataatatttgcttattatgagagtgttttgagagttagtcaaagctttagcagaagcagggaaccttcaccaaagagttcttctccaccacgacaatgttcctgctcattcctttcatcaaactagggcaattttgtgagagtttcaatggaaaatcattaggcactcaccttacaggtgaatgatttgggttattcttttattttttcatttcttaatcttaaaaaatttttaaaggacacccatttttcagctaatcatttaaacaaagatggcattgacatggttaaattcccaggatgctcagttctttagggctatactaaatggctgatatcactgcttacaaaagtgtattgaacttgatggatcttatattgagaaataaagtttatattttttattttatcttttattcaagttttccgtgaattttttgagatcctctcatatacatgtctatattacagtggtgatattatactatagttttgcaaaatattaccactggggggaactgggtaaaagtatatggaatctctgtattatttcttgcaatctactatgatctaaaaataaaaacttcaagaaaacaaaatttattgttcaaacaaacatagtaacaagtcagtgtataatttctgacactgtgtaaaagtaaaatgtaaaaaatccacagcataaaggttgtcggaaagatagaggtatactagtgtaagtttctcatgttataaatgaacttttataatattatttaaagtagactgtggtaatttaaagatgcatactgtaaaccctaaggcaatcactatactaacacaacaaagagctatagctaatgagcgaagaaggagatacaatggaatcataaaaatgtttaatctaaaagcaggcaacaagaaagaaaaatgaggcaaaggaaagataggaccaatagacaaggagtaggaggtagatttaaacgtagtcaggtcaagaatcattttagcagagattgtcagtttatactgaaaaggtaaggtccatctatattctgagtacagtaaactcactttagataaactcactttaaagacacatataggttaaaagcaaaagcatggaaaaatataaaaggctaacactaatttcaaaaaagctgagtgtctacattaacatcagacaaagtagattttagagcaaagaatcttaccagagatgaagaaggacattttatactagcaaacaggtaaattcatcaagacaaaacaatttgggacttttatgccactaatagtggagtgtcaaaatatataaagaagcacctgacagaatggctaaagataaaaacaatccataaatatagttgaagattttaatacccctctttctatagttgatagaacaggtaggaagaaaaaccgataaggatatagaagattttaagaacacatagaggtggcagaggcaggactcaaacctaggtcgtgtagctccagaacccttgctcttaacctataggcatgctgatctgtatgttgtagccatcaggatattttgctgtgtcagtgattacccatttacaatggatgaattcactaagttctaagtattagccttccctgattttcaaagatcctttttatctttattaggtagaagacttgaaggagatgccatttatgtgggagcttgaagggatcctgcaacaggcactgaagttgatttggtttcagattttttcagtgtctggatgaattattttcttgaatgaaacactctaacctcaaaagagcaactcacagtagttcacaaagcatatagagcctaggtagtagatcgtctatgccctacctgtaggccaacacgctcagaggggacccctttgcatctgatcccaccttttactttatctgtttgtgcttacaagaattttcatccttcagtttctaagtgcagatgtctttcagttgcattgatatgtctgggctcagaaccacatggtctaatacaatgaacactgcactagaagttccaatctcaaatctgcttttcactagccctagtcatttaatgactatgatcctcagcttcatcccctttcaatagggtccataatggtcattgtgaaaattgagattatgtttcctactcaatactactcagtgtggacactcacttggcccttaccattgttagctttcttccttcctaatgaacaaaaaatagcaaggagcaaactcaaaaccagggcacacagaagagaagaagggcctggcagtccatgggaaagagtcagttttcttcatgtaaatgccttttggggagaaacagccttgcacagaagtctatcaatacaaattatccagattgtaaacttgtttgtatctcactttccgttttctgctgacatctaccctacatcaataaaatcagctgaaataattttaaaagatgcaacagaaaactttctctaaattataatcttccagcatatttcagaattcactccacctgtattctgcgtatttgatcttggaacagaagattagcaaagtggaattgataatacttcctatctttgaaaggtgctgaagagttaattcactaagcaacaatttaaaaataacacctgagttatctcagagccattttcctaaagaggctggtggaactactgaaacaatgttcttaaaagcttttttagtccttcagtcccccagagatcattcaaggagaatataattttatgtgatgaaatgagaactggaggagaatataataagtgttaagtgattgaatcaaattgagtgtttgctaaatgtttcctaaatgggttgacaaaaaaaaaggccatgagattccatgtagcccttcaggactggtggtcttgactaggtcagatgtctgagaagttgtggggaccacatttttttattcaagcagtgctaaagaaataatatctcttagaagaactattgatcagcatttcatgatttgatcattattcattcttaacctctctatgctgcagtgtcttgatctgtacagtgggaacaaaaatagcatctacctcaaaggtttgtggtgaagattgaataaaaaattaattaagatatattttagaatggcatctggtgtacagtaagtgcttgaataagttagtgattttcaatcatattaattactttcttccagcaaacctatagcacctactctgtactgggcattgtggtaagacctagtgtatcagtcaggctcatagttgcaaacagcagaatctattgtagctaatttaggcagaaaatgaatttttcaagagatattgctagctgatagaatctctggtgggacagctactggccaatagtggtagccacagtgccagtttctactgcaggattgctctaatgaaccttctgcggcaaccactgataagaagctccctagcctgcggccattgctgaaagtcagacatccatcttgttggaaatggattcagcatggttccctgctttgggacacaatatctgaacataaggctcccacgagttcatctgactgggggagaccaggtcacatgcctagctattctagctgcaagggaacctggtaaagtgagttttaggattttaacttgggataagactctttgaaagccatgacaaatgtccactagacctagcctctgccatggaagagcacagtctagtgatgagacaggggtataaataattataacattgggagtagggaggtttgtattattatccagcacatacctactctcacaccccacaaagagggagcctgcttaactttagacttggtgatgtgacctgctttcatttatgcaattgtgggtgaaaaagatggtttggtagctccaagcaaaggttttaagaggtatttcaaattttctctcagatttctgccctctaccatgagaacttcacatttatgattgcaggtggaaagtagactctccttcagccttgacacttaaattgagaaaagttgtgggtcagaccccaaactcaaccacagtctggcagggctatagcatcaaatccacaggtataacatgagtgagaaatagttatttgtatttgtacgcctttaagctctggagattgtatgtgataaagcattattatagacaatgctgacttatacaaggagataaaggcagatacaggtatatataccaaatgctggaggaaacttagaggaggtgataattaactggagacttttaggaatgcatcacaaacgaagtgacctttaggaagagttttgcaggcatttaggatttgtccaggaagaaaagcccagggaaggaaatttcaggatgacatatgcatatgcaaaggcacagagaattaaagtggtcagacatgttttcagaaatacaatgggttaatcccagcatatcccaaattgtagtgatttaagtatcttgtgttatcttttcaaaccagcagtacaattttacttattatcttattgaaatcaatttaccttcttgctctgctcccaaccttaatatcgttctagacaaaaatatttgtaaaatctcaagcctgatatcttaatcattttttgaatacatactaaaatacatgcttaactattataagtataaaaaatagttttctatgtgtcaccaatgttatgtgccctgtgttgtctctgactctgctagtagactatgaaatatgtcttcttccctgctttatagtaatagaaatacattttgtttgaggaagcactgtgcccagtttaaaaatgctcacctctccaaactcctttgcagacatcccttgagttgcctgtgtgaccaaattctggccaataaaatctaagtttactggatggtactggataaaatttagttggcaggtgccttttgcattttcatcatcctatccctttctcccttttcttcttttctggagcctggattcagtccctggaagtgtggtagccacctctgtgaggatgaaaggaatatgctgagtggcagagcagaaagctagacgaagcctggtccctgttgccttcattttgcaggtactgtagccctgcctgcagttgagccattatagacgagtgttcgttacatgcagcgtaatataatcttacctgacacatacgttctggcaaaccctgggctagagtatagcgttcaagtctgcgaggccaggaggtaattctgggaaggctggcaagggccacatcccaaagatgcttgcagagcagacaaacaagttttatctttgtttgtttgtcttttggcagacaatggagtgaaacaatttggaaaccagggtgtcatagatttagggccccgtccaatcacccggactatttttagttcttttcccattatcgtgaaactcatatgggagccagaaaatcttattatttctggacctaattacattaactacaagctgggaaaatcacagaaggtctagacttcactttgttcaactgaaaaatgccatagatccctatattagtttcctagagctctcataacagagtaccaccacctgggtgtcttaaatagaagaagtgtattgtcccacagttccagaggccagaagtccaaaatcaagatattggttccaaagcaggattggatccttctgagggctctgaggcgggatctgttccaggcctctccgagcttctggtagctgcaggcattccttggctctgtcttcacatcatttttcttctgtgtgtgcctggctctgtgcccaaactccttttcctaaggatgcagtcttattgtgaatgctctattttaaaataaggtcacattcacaggtaatggggattagaagtggaacagctttatggaggacaccattgaacccatagcaatgcccatctctcagagttgtgaatatcacatggcatgcattggcatgggttggaaaacaaggcactgtgggagggtggagaattgcgcatcatgtgtgctggtgcattgatggaacagaacacaacagcctgaagaagtggaatgtgaaagagggacactgggtcctgattctgtcatggacattgtcaccagctggtgactgggagccactttctcgctttcgtctcaatcactgtgaaacgataataacctcaactggcctctctctgcctagtttctgatactgttggatattctgggccagccattcgaactttcacagaaactttccttccccaaggttttctgactttaggccttaccttagccgagtgggctgttgctgaggtctgagtatcaaaatgtacaatggtggtaatgaaagtaacaagcttataacaataaagccaattggaccacttttagaaaggtctaagatattatttgtctagctgatgagaggattagcttgagcagagaaggtttctgtggagcaaagaagttgattaacttggatgctagagaattctctgtagtgtgaactctgtttgttgtgggaaaaaccttgagtaaacaagtagtgaaaatgtaggacaagcaattttatcttttattcctagagaaggggtcctagttcttgttcagtttctttaattgctttatgaggaagattgtttcttgagagtgaaatgttttaaatattgcctggatttaaaattgggtaaggaggtcagcactgcctgacccagcttaaatttccaaagggccaatcacaagtatattgcacatagactcagctggctgcaaggcagagattttattttcaagatgacagtttcatttcagttcatttcacccacacttggaaggggagagagcttcctatgaaattaactgagcaccatttcttatttcatttttgcttttctaattaaggattcaggtttgtggctgcctttccagccaggttcatgttgaactggcagactcagctgtttagaaatagaacttgagctttgaagttcaatatttcttggttcatttccaggttctgctgcttacaagtgctgtggctttgggtacttaatctctggattcaactgtaagataggaaaaataattacataaaatagcaagttctaattgacctgtggagtaaggtgcccagtaaatttgtaatttctgtttttcccattacggaaccttcctcccaggattctgttcttccagatgaaacttgaacctgctaggtttagccatttagctatgtatctatccatgtatttatgtatctatctatctatctatctatctatctatctatctatctatctatctatctgtctatctatatcatctatgtatgtatgtatgtatgtatctgtctgtctgtctatctatctatctatctatctatctatctatctatctatctatctatctctattcttccatgcatccattcatattttgatcattccttcttcctttttcctatcacccaaacttattcttcctgtattgtgtcccattagaggctctttgtatatctgaaacttacctaataaactaattcatgggaatgtttaaaggcttagagaataaaacattttaaagctagaaagagctttagaattttagtccaaatatcttaatttacttatgaagactgtggagtaatttgggcaatggttcatggtttagtgggaatatcatactaatttgcgtaggtttcccagacctcaaatgcagtgaaactaaacagatgaaacattttcccatacttgtattttaccatgaggaaagatgatggtgattatgatgatggtggtgattatgttgataacaacaacacacattctttttagcctttctcctgtacctaatattacactcatgtagtacctcattttatcctccaaaaatcttctttgatgcatatattgtgattttatagatgaggaaactgatatttagagaggttaagtaatttgcctaaggtaatacagctgggaagtggaggagccaagatttgaacattactttgaatttaaaattcaaatttaagctcttaatctctatcctcttctgctggcataatcaggccagaaagtggtggtggtgatgatgatgatgatgacaatgatatcactgaatgtttatcgagaatttactgtatactaagcacacagtaaattaacacatatgatcatgcattaacacacttaatcatcacacaacccaataaggtcaatgcctttattgtcccattttttgaatatggatatggaggcagagagaggaagttaaggatcttgccccacagctagagatggtagatttgaattacagcccagctattgtgttctcagagtccttactccaaaccactgctcagggcagtttgttttgcaaaggcagggagtgtggcagactggggtatgaagtgggcagcaaggttgtctacatttcaggttgcacacgggaatgcaccatgaatatatccagctaatgaaattatgtacacaaaggtattttgtaaagtctaaatcacaatcatggttaccattacctattctcagccttgcctaggacatggccaacaacagctctgttttaccagtgaggtctgagtcacaaggacttagtgtttgtccctgggatgagaatcccatcctctgagagctcataaccagaacagtttggaaccagggcaatctctgtggcctgagtgtccatagagagccagggagacaatgtgattgggtgaagattaaactatgggaataatcttgacttcttgcaaaaacaatatggcccacttacattatttctgatacacaatcagttcttttttaactttttcaatgtttcaaagtaaggatagtgggataatcactttcttcataattctaccagaagccaaggggcaaataacaacccatttgctctctagcctcagaactggggagttgtgggatctggcattaaagggtgagctctggacacatcagaggagccaattattattcaacaattattagtacaaactgtattgatcaggatctattgggaaaactgatacatcaatcatttcaaagtggagaattattacaaggaataattaaacaagttaacggacggaaaggcttaaggatcacactaagataacactcagctggtaactgcaggatgctgctacactgctagtggctggagcaacaagaaagagagaatgtggttcttagagcctagtgctgccaattccaatacagaggccaccagccccacgtggccgttgagaacctgaaaagcagccagcctgaatagggaagtgctgctataagtgcgaaatgcacactggatttcaaagtcctagtgtataaaaaagcaatgtaaaatatttcattaaaagttttaaatattaattacatgttggaataataatattttgggtgagttgaattaagtagcatttatggttgaaattaatttcctctgtttctttgtgtcttttgaaaagtggctactagaaaatttaaaattacataggtgattttaatttgtagctctcattatacttctgttggacagcactaacttaaaagcttggagcagaggccccatgtttcagaaacccagacctccaaggaggtgagtgggatgatggctggtgcttgaatctcagtgaaggggagtgaccacgctaatttgggggcatgttgaaaaaccacaaatgggaatcactactctatcagggtcaagaacttttgcttgggtgacaatgatgaagaggaaagacacaggaaggtatgtgtcctttctttctcctctacatttcagactgtctccgcaatgcttcttattagcagaacccaacagggaatcagatggcaaaagagaaatgtttgcagagttccagcatctgcctcacgaccggtgtaagaaagggtgggcttggcattaagagtcagtggtttaataaccagcatgactggcattgcaaaaactacttatttctcaagaaagcaggaattctagattgctttttaatgcgaaattttcctagttctaactgataactaaatattttcttaaaaattatacagtctaaagaaagtacatctgtaggttccgtttcttgttggtaatgatctggggaccatggtctggatgtctcaagatcccatgcagctctgacttctatgtttctatgagcatttgatatgtgggtaataaaaaaattgaagttccctggggagagaccactgtgggctgtagtctaggaagacttcctggaggaggagaggcctggagtgagttcttggatattcttaccagtaagcatgcccttatacaatacccttagtccatcactggcagctttttcctttgcttgcccccatgtgtctgcaaatactggtcggagagtgccagcattgtttataatcaagggtggggtttgcctgggccaaaagctgagtttgtttagacccaaataaggcatcccattgacagcctctccagagtaacttggaggcaagtcatgactttcagatgcgggtggtgttggggggatcttgaaactgctcaggaaaaatggctctttgttgagttatttcttgttgttcatatgaaacgggggtgaatctcaaaagtatacgtttccatttctaaatgttgatgtttgtttagtgataaggaaagaataagatcatgtaataaatctttcagaaattaaaatgctaatgccagtctttaaagtttgataaggaagaacctttaagtatgcttgtgaaaatctaatatggaattattactggcattttaaaactctttaaaaaatttcagcctggattgcaatgtattccaggccaagcccttctctagggaaaaaacaatgggtatgcaactgtttacaggagaaagttggtgcagatacactgatgaattcccatctgactttagttcttgagtcttgcaggagcccttctcttggctgttcactccatccagccatctccactggagcccacttaaggaacttttccaacttcagaacttacggtttacaaaatcactgcagcccctaatgtcctgggactttcaaacttctgtttgtgttttagtttgtgccctgtggctacatagcttgttggaggctacttctaggaagagctcacaatggagtctttacaggcttgacgttcactagaccttgcagtgttagacactttgctttggaatcaggtgctaagactagtgatatggagatgcagtcaggcctattgcctgagctccagctgtggacagtgcatcagcataggagccaaaggtgactgaccctgaagagtggctgtgggatggccagccacctgctgggtggcctggagtgaactctagctaacagaggtgctccatgctgagtggtggcaatgtcaaccatccaattcctatcttagcagaaatataaatttatgataaatgaagagaaggtatctcattccagatttctttctgtagcaatgatgagttatttctttgatttttctgttgacctactgtgtactccagtgtcaaaagagctgaaactcaatggtatagttggtttgttctttcattcaagtgtttattaagatgcctaatatggggcaatcactttactggagtctagggatacagctatccacaaaacagtctttgctatcatggaacatactcactaacattgggaaaggaaggtagtaaaaacacaactacaaggtagtatgtaagttctgtgatggagataagtacatggtaggtagtatgtaagttctgtgatggagataagtacatggtaatatggaagcacagagaaggggtcactagcttggtgtaagggtgttagggaagcttccagaggaagtgtggggcaaaacaagaattgagcgatgtatagaagttagccacagaaagggggggctttctatgctacctagacatctttgcaagaagcctccaattccaaaggtcatctatgcatgactttggatccctgagcagttttactctaattgaccagctcagagtttgtagcttagtggccttaggagatcagtccttggtgtaaggaaactgatccaggcttctcaccgtatctccagcccacacgttagatgtgactgaaacatgtaatgaagcatccaggggcagtcaccatacagaagtcagaaaaaaatgatggataacttgggcccctcactgacccctgtgaatggaagttctgagcagaattagatagtccaatacagaaaataatgtggcatgctctctgaaatgtaacagctctatttctatactaaccctccccttaactagccaacaattttgctctaagggacgagataaaccacaaacttaattctattcaattcctcatcttatatcaagagttagtgtaaaactcatctcttctccagccagaagaactatctctttctctctgtgtttccatagcacatgttctgtgttctttaatatcatagcctttaatctgtgttctgcttgggaagtggggaggtgacttatggatggctttgaaactctcagtagattgagtgcttctggaaggcaagacctattttttgtcttaaggtcttgcacttagtaggagttctaaaaataatttttgaaatgaattgctgagagacttgaagtatagtcaccatcttctggacagataacttgacttaggagcacttttcatgcttacttgtttttggttgggaatgtatctgcaggtgaagagaatactggaaagaatagaaacttttaaagggttcaacacatattttttctcaaaacttgtctggaaacctgcatgacatctattgcaaaaaacattaggattctagagagttaaactctatgctgttacctgtgtctcgtgctgtgatgctgtcaaagggctactttcctgggtcagcttcttaggtgactcttataagaagaggacaagagctattacagtggagcctgcaaaagagcatgcactcaatactcaatgttagttaagtccttattctcatattccaagtctggagaattaggcttttatcggtgaactccctttacaaaatatgcacgctttccaggctctctggctgctgctgttctcccttcgtccccaataccacaggctctgaaacttcaccattaattactgattcctttgtaattaacagagccctgtattaagagacaggttccctctcctgcagggagcaacagttcagctccaatgaatgaatctcaacaatcatttttgttgttgttgtcaatatgagggctttggccttagaggacacagaaggagtatgctgccttgaaatacatcatggtattggaaattcaagtctcagtacaaagaaagttggctttcctgggaagctgatttgtttttatttttgggccctactgttggtgggcggtgggtaatagaacccactaagatagtgcttctgacctcactctaccctcctggattagtctgttctcatgctgctaataaagacatacccaagactgggtaatttacaaaggaaagaggtttaatggactcacagttccacatggctggggaggcctcacaatcatggtggaaggcgaaggagaagcaaagtcatgtcttacaaggcagcaggcaagagagagctagtgcaggggcactctcatttataaaagcatcagatttcttgagagttattcattatcatgagaacagcatgggaaaaacccttatgattcaatcacctcccaccaggtcccttccatgacaagtgggaattatgggagctacaattcaaaatttgggtggggacacagccaaaccatgtcacttcctgtctgggcagtggagtgacttactggatcaatgaacttgagaagggaaagtgagtgcagcctcttcccaactcattgctcttatgaaggcagcacgggttctgtttggtttgctgtcatatggcaaagtaggcctctctgacaagtcttcagggctgcagggccacctctgactggctggctaagtctctccaattcagtttaggaaggcttccttcctgcatacatcagccatattttccacgtcagcattgtcagtagcactatgatatttgaatatttacgtaactcaactcatattcaacttaaattgatacaaaattttgtcaggaaagtggctccttttattgattagaatccctctcactctaacatataaaaatcacaattcatgattcaccctttgccttgatcttcaggaaattttcaacccaaaacataagatggttaacaagtgtaatgatacacagcaaaatataaacaaaatacaaagggactggtataatttttcttttcctttttttttttttttttttttttttttagatagagccagtgaagtcctttggccaggcatgaataaaagaactgtctttatttgttcttgtcccaatttctcttcatttgttgctcaggttctgctgagtctcacaggtctgtctcttattacttttatcccgggttagccaccagcatatgtgcttttctttgatgatagacataatatgaaattacagacaaaaatcttgatttctgcatactattgtttaaaaatgcaactttaaatacagacactcaatgaaaagcatttctgaaaaggtgttgctctaggcaagggttccctctgttttgtgatagtactgttcctctctgtctctgtgaaggttctacctctgccgttcttccttttgagtctcgttaacactgtgtttattttacactcctccacaataagagctgaggagtgggaaagcaacccttcgactggggtgtgatctgaaaatggattcctcctttgaacagaaactcagaagtgattacaacagctgtaaaaatgattaaacatgcttttccctctcccaaacacagcagctggagttttattgtttaaccaattcatgcccattgttagagagtttacagtttcacctccccaagcctcaggtttttcctccatgagggaccaaatatagattctctggcctctgagtcctttatttttcattgcttcctttctaagtgaatcaggtatccatggaaacaaccgaagattaatactcaaaatagacaatcattcatttctctctgaaccatacagcaaaaataaagattgttttagccacaatttgaattcttgcaacaaattatgaagttcagttgcacaatataggtagaaaggaagaggctatccctctaaacatttttttaaaaaaatatctgagtgtaaaaatcacagaaggccagaaacagtatgtttatcttaggtagaagcatcagctttcatgaacactggatctggtcacttaatgaaaccttttaaaattaggtgctgtttgacttcaatggaactgaggtgccaactgtatttttgtgctagtggtgacccagcttgccaaagctcccctactgtgacctgggccctgtacctacagcagttgtaggtaggttctagcctgctatcttgtttgcactctttgtgaaccacctcatcatctaatatctcagttatttatcttctttttcccccaactacattccctgggaccaatattccgaatggtctatctggatcacaagctgtatttttggctacaggagagcagaacaactgatctccccaaaggaaacaagactgttgtctagtagaagaatagggaatggatactgcaaggttggaagacaatccatgtcagtgaccaggttcacatgagatagcatgtgcagatgtggaaagacagcacagagccatgagacaaggaggtacatggttggcagaagtagtggggactgcattagaattcctcaggctgtaaaactgggagtttgagcctaggtagatgactgcacctgacatttaagaattggtagatgactgttgttagacactgtattgttttgactactagtggggcagaacatttgttgtctatttattcatgatttacagttctataattttctaatgttccttgtctactttctcttataattttttccgataaagcaatgctttttattttaataacaatgataactatttgcttggtagatttgtgataattctcccagttaataattttcttttagtttgatgttacaaacaagctttgtatttttacaaaataaaattgtattagtccgttctcacactgctaataaagacatacccgagactgggtaatttataaaggaaagaggtttaattgactcacagtttagcatggctagggaggcctcaggaaagttacaatcatggcagaaggggaagcaaacacgtccttcttcacatggcagcaagatagagaagtgctgattgaagtgagggaaagaacagcatgagggtaaccaccttcatgattcaattacctcccacaaggtccttcccatgacatgtggggattatgggaactaaaattcaaaatcagatttgggtggggacacagccaaaccatatcaaaaattaaataatctttttaatgaaattttaatctattgcttttatacttgacaagtcagtctacaatcacagacaagaaagataatacaactatattttcttcttattttacacttctgttttacacatttagctgcgtgttctagctgaaatttatttattttctcttctgagtgctgagaatttacaattatgtcctcctcccatagttagctaattgtgtagatatcattaatcaaataattctttcctttagacttgtgatgccattatattataaacaaaatctttacacatgctagagtttgtttttaagctatctattctgattcaacaatctgtcagttgtcataagtacaatattttttgaattactgatgctttataatgcatttaaagagagaaaaactgctcttcaccaattgctcttattttttaaaagactccttagcaattctgcttgattgtatttcttaaagaaatgtcaaatgatatttgggaacaaaataattttgggattttgattgaatatttatgttaattcaagataaatatacatctttgtagaaacataatcataatagtacttggtgtttattgaatacttttgatgtttcaaaagtgcaacataaataatatctcatttaatttccaaaacaaccttatggaataggttcttttatgatattcacttaaaaaatcaggccaagaggaataatttccaaaatccacatcgctgattagaggcataaactcaggtctgactctactgcttatgtatgagagatccttccaattgtgttctttttctctatcatagtagatttttatcattttgcttatatggattttatacttttaaaattaaaattattcctgcatattttatatacgttcttgctttcattcattttacttctctgcagttatttttgacaaacatgaaaggtgctaatttgtatattgatagtgtaccaggccaacttgggaacctgttgaaaatgctctcagttaactgtcttggatgttcaccagcaaaaaaatgatgtgttaatattgctaacgtggcaagtctccccaatttgatctacagattcaatataatcctcatcaaaattctactctgaacacagatgcatgaaggaaatgaaataatagaaaataaaatgtaacagtatatcatggaaataatttaccacgatcaagtagagtttaacctagtaaagttaggaaataaatcaacaaaataattcttgtgaatagtacaacaggcaaaagtatacttgatcatctccttagtcggaaaatggcatttgctaaaatttaacttctgtcagtgattaaataaaaaacattaattagaacatttaattaatttatttttatttacttatttaattagagatggaggtcttccttccttatgttgcccaggctggtctcaaactcttgcactcaagtgatctcccaggctaggcccagccctggcctcccaaagtgtcgggattacaggcgtgagccaccatgcccagccagaactttttagaagatagttttctttacatatgataagattgacaacatcatattaaatgaataaacacactagaatcaattttactaaaaccaagaataatacaaagatgcctgttaccactgtcaactatttagcacagtttaacttttaggcagtggattaaataaagaaataaaaacaaaagataagtccattgaaaagggagagagaagatcctcagtatttacaaatgaattaattatattttttaaaaattctatagaatggaatgagaattacagagaaaattaattattagaattaataagaaaattcagtaaaattgttcaattaagacatcagtgtacagaaatgtagcaattactagagcatagaatggaaaaaaattccattggttgggcacctgattatgaggaaacaattgtaatgaatctcataggcccctgcttttggaatccttgtgatttaatgtggagatggcaaatggaagaaacccccgctcacaagctctgctgctttgccatggcaggcgctgctgagttcacacctttcttcactctgaataagttactacctcagaagctttcccaatgcaagttcccgagagactactcaccatcttagatggtgaggaaaacaaaacttgtttgatcccttatagggcctacgttttcccaaatttcctttttctgcaaaatgaaagttttcatttttgtgacaatggatttcagctatatctcagaagcccatgctattaaaacaatttcatgctcatttgtgaatttttgaagatctcttttacggcattaatgctttcactagaacatgacagaggagtttgtaaaccccaaaagagtaaactacttgtaacaaataattgaaagagagagaatgactttttattactggattgacctaaatttggaatcagagaacagggctgaagatagagcatgtcagctctggaaggcatcaaaaggagaaccagtttgcttatctgaggaatttttttttttttttttttttttagacagtctctatctgtcacccatgctggagtgcagtgtcacaatctcggctcactgcaacctccacctcccgggttcaagtgattctgctgtcttagcctcctgagtagctgggattaccgtacacaccaccacacccggctaatttttgtatttttagtagagacagagtttcgccatgttagccaggctggcctcaaattcctgatttccagtgatctgcctgccttggcctcccaaagtgttgggattacaggcgtgagccactgctcctggccaggaatggatattttcaggagattatttgaaggctactggaaagtgagaaatgtttcatttgtctagaatggtaaagttttagagtgaatagaaactgagaaaaaaggtagggtttggtggggcttttgatgttgcttcaccaatttccttaatgtatagttttgttttttttttttctcccgatatggcgtcttcctctatcgcccaggctagagtgcagtggcacgatctgggctcactgcaacctttgcctcctggattcaagcaattcttctgcctcagcctcccgagtagctgggactacaggcatgcaccaccacacctggctaatttttgtacttttagtagagatggggtttcaccatattggccaggctggtctcgagctcctgacctcatgatccacctgccttggcctcccaaagtgctgggattgcagccgtgagccactgtgcctggccaatgtatagttttaaaaacttttcaatgtctttttcagctcagtggcttcaagcaaaaaacatctttatataaacaccaacagttcaaatgcattaggttttgtttaaaaccgaaacttcccaatactcccaatgatcagagacaccatcttaactcttctgatgaataaaaggaggtggccagagaggaactttgtggaaacaaccagacacccagctatgtgtatgtgtattaatgtgttaccatccaccatctctcttagtctttcctgacaatacacaatcacagcatttgccttttccccagaaatctgaggcttaacagagaaaaaacagattttggagtcctgcactgattcaaacttgaccttgctattttctgtctgtgctaccttggcaaattattcaccctctctgagtttcatatacaaaacacttgcatccccaggttgcagtgaaggataaattaaatgcaaagtgctacatggtaagtgcacaatacatttgagatccatacctctaaactcctagagcttttatcttctgtgctttgttgacaccttgagtttattcagccttatgtatgtggttagcattttatgcactgtcccttatcccaagtcaattgagagcaccttgaaggtggaggctaggtacaggaatctctagtaatgcttcgcatggtgttaggcatatgtcagatacccaataaatgaagtttgatttaacaaactcttttgaaccttcaacaagcctatcaatgataaataaattctaataggatgaaaaaagggaatggaccagtcataaataagtggggtaatacattacaggatcttccattagtggaccattatatagaaactaagattatgtttttaaagaatacttaatgaggtagctcatgatatattatttaatgaaaggggtagaatctgtaattgtctactctgaatatgatcagtattgtaatgtatgtgagacaagaagacttgcaggatatgtatcaaagtattagtattgatcacattagagcaatgagattactttcttattgttcctctttgttcaaatgatgtacaatgagcatgtattactgtacaatcagagggaaaaagcctagcaattttttcttatggaggatggaggggatattccattataaaatgaatttcctaaggttgctgcaaatcctgctttagggaaattgatcttgatggccttgttctcacagcaccccaccccacatagcaccaatgtgagttgtgttatcctattgcattaaatgttcaccccaaggttaaagagaaatagagaaagaaaggatttcctgcaggactgggccacttatttataagtcccttgtcagatgcccttgagatttcaaggtgttaaaaaggggcctccctgcttgtgccattaccaggtaagcagagtcttgacctctgatgtactctttgacaaccccacaaaatacatagtgaatggcagcagggtggatgtcaggacccctctcccaggccagaggatgctgacctgcagactgtgtacctgacatgacagcaagtctaataaagtggctcagagtcaagatggcatgttgtcatttgtgagttctgcaactttgagaaaactgtttaattgttctgtcttatttgcaaaatgggggataataacttcacctcactgttaaagactgaatgtttatgtcctccccaaattcatatggtaaaatcctgatccccaatgtgattatattaaaaagtggggcctttgggaggtgactaggtcatgagggtagagcccttatgaatgggattactgcccttataaaagggacccctgctgctctctccttttggccatgtgaagatacactgagaagttgacagtttgcagggaaaagaccctcaccagagcacgactatactggcaccctgatctcagacctcaacctccagaactgtgagaataaatttacgttatttataagccacccagtctatggtattttgttatagtaacccaaactgaccaagatacccaccaggacattgcagattcagtgtcatcatgcttgtcaagctcctaacttaacccatggaggataaccattactgtgactcttattagaccagtacggtttcatgaaaggagcacaggctttgaccttgaggacccatgttcaaagctcacttcaccacttattagctctgtgacaaagggtgtcacttaacctgcgtaagcatcagtcttcatatctgcaaatggggcttatgatacctacttccaaatgtggctataaggagtaatgaccatgcatagagtgaatgcagtagccaacagcagccaggcgggtagcaagagtgagtgaaacaggctgaatgttacaagctggagagcagccaaccagggcaactgtgactcaacaccaggcaactgttaccatccagcaattcagaagtgtgaggctgttgtctgatccgattttttaagaaaaataagatacttcaatttttataggaaattcatcagttttcaagtgctggcaaataataagaaactgtttaggcaacattatataggccaccagtggtagattggattcctaattgtttacttatagcctttgccatttgactttgcaagaggcagagtgtatttccccgccctacagattctgggcttgtccttttgacttgctttggccaatggcagtgtgagcaggtgtgtgcatgtgtgtgtgtgatttgacatggtctctatcacttctgccctgtgccaagagaggagcattccatggagggccactgtttctgaaagaaacatgagggacagacccacagcagagttgccccagctgatgaacagttagttccatgagtgaaaaaaaagaaagtgttgcttgtcatcagccattgaaattttgaaattattacaaagcaaaatccaagtaatgcattacacttaagttcccagtttaagaccaccaaggtaaaacatctggcaagtgactggtagataaaatgttcttgacgaatggttatcattacacttattctggtccggacaaatcttatggggtttctatactaaaaggcaggcttggtccaatcccttgcaaaatgtttgttttgtgctgatttgagttctgagaaacttaaacacactcatctctgtctatctcttgccaccttatatacttacagggataaatattaccactaatcttggaattaaccaacttgcttttgattttacaggctcctaggcggaaaagacttgtcttgtgtctcagatgagactttggactatggacttttgagttaatgctgaaatgagttaacactttgggaagtgttgagaaggcatgattggttttgaactgtgaaaagacatgaaatttgtatgggggtgggaggggcagagtgatatgttttggctctgtgttgccacacaaatctcatcttgaactgtagctcccataattaccacgtgttgatggcaggacttggtgggaagtgattgcatcatggcggtggcttcctccatgctgttcttgtgatagtgagtgagctctcacaagatctaatggttttataaggagctgtttcccctttgctcactcactatctcttgtctgctgccatataagacatgcctttgtttctctctcaccttccgccatgactgtaaatttcctgaggcctccacagccatgaggaactgtgaatcaattagacctctttccttcataaattcctcagtcttgagtatgtctttatagcagtgtgacaatggactaatacaatggcaaaaagtggtgtcatgatttcttacttggaatttcttcactcattcaatccaaccattatgtatgatagaggttagatattaagaatacagattacaatgattaaacttctcagagccaaagaagtctaatgggacagtgaggggtattcagcaacaacagaatttgaaaggaaatgctggaatgaagcaagaatcaggtgcttttggaccccagatggggcagtcaagcctaaccagaggtggggagatgtctcagaggacaagagaatcaaacagagtttttaaagacgagtagctttggttacataagaaggtggagaatggcattttaagaggataaatatttaaagacacatgaggcataaacatttggtgtattcagaaaatagtaatctagggtagtgagttaatcaggtctaagtggggagggagtgaaaataaaactgtaaggtaagctgaggctgggttgtaaattgccttggttgttgtagatgtttttttcccaaaggtgacagctatcaatttcttccctcctggtatgcacgtgccatttacccatcataagtgtagtctgtcctttagtgccttgaacctgggctggcttgtggctgctttggtggatagcatacagaagaggtgcttcagtgccagttctaggcactggcaatttctattccctacgttttgggatgctgtctcttgcaacaccctctcttagaacccaaccattatattatgataacctcatagagaggctatcaaaatgcacttcagtgaacagcactggttaagctcctacccaatagctagcatagtgagggcaccatctacaatgtccagcctagtcaaggctctgatgacttctcccccagctgccatctgacactctaaggtataaatcacctggcaaagagcagtgaactctcagaagggtaactaataataatcaagtgttctcttgagttaataagttttggattgttatactatgcaacaacaaataactggaataggtgttagataaattgttctatgcatcatctgtaatgattgtgcaatagtttgaatatgtcccccaaatttcatgtattgaaaactgaactcccaagtttatgtgttgatggcatcttgaggtggggacattgggaggtaattagtgttaaataaggtcatcagggtagggtccctatgttgaaactgatggctttataagaagagaaagagtgatctgagctggcaagcttttgccctattgccatgtgatgccctccaccatgtcacaatgcagcaagaagcccctcaccaaatgctgataccattcaattggacttcccagcctccagaactgtgagctaaataagctgattttatttataaatcactcagtctgtggtattctgatataacagaaaacggactaagattgtatatataaatgactttaaagaattgataaaagaaaacctaaaatggtgaggtgagggtgagggatgcactggaagttatcttaaaagtacacagtgggaaagcaataaagtatctgtttctctatattttcattagttctgttgctattacagtatacatgtgtaacaaacccgcacattgtgcacatgcacaatagaacttaaagtataataaaagaaaaaagaaaataaaacattaaaacagaaaaataaaaataaaaagtaagaatgttctaggaagggaatgtaatattctaggaacaaaacaaaaccaaaccaggctttacagtcaaggaagatccaggttaaaatcccaactgttgcattcctgatgtaggagaccagggacaacttacttaatggagtaagcaaatttgtgcccacatagatgtcctttattaagccagaacactggtcccaagatactgttactgttgcatctagttggtttcttctctgtagaatgcccctcggttgatgaagccatcttgctgtgaaggtcacaaatccctcatacattctggggatggttcccaatcaatgaagggttgatattgatacaggtgccaaaaggctgggctgtagcacaagcggggataactcttcagtgaggtctacaaagccttcacctcatggattaggcccaggaagctgactgtggaggcccatagctttccttagttctttctccttccctatcctgcttttcccactctcatatatatatatgatcttatatataatatatatataattttttttttctgtagaacatacccttaataaacctcatgtccctgaatcccagctttaggctctgcttctagagatccgaacctaagacacttaacctttctttagcttccccttttcaaatccccttcccagaattcagtgagatgataaattgaaattgcctggcacttaataaacaaacacccaataaataataacagatttcctctctcatctttctttatcattagtgcaaagtgaaaaatatgagtaatgttctttaaacataaaagatcctccagtgaattttccttactctgtatagaaaaataggcaggtgagacattgatttttaaaatggtaataatcatgcttatgctatggagttatcatgaggattaattgaaataatgagccttaagtagagttctttagtgcagagcaagcactcagtgactggaagctactgcctttctacttgactacaacctccaagaacaccatccagtctgtcttttcatgttgtatcctcggctagcacaggactcagcacagagaaggcatttctgtgtttgctcaagaagctgcagtgaacaaggaaagaaacaatacttcataaaagatggcacaggttgtaggacagtgcttctgtggcctcgaactgacccaattctctcctctttcttgctcttagttctcaagaataactgtagcatgagctgggaatgaaacatcctaagataaggggtgcctggctgaaacagcctgagctctggtcccaacccatcccctcatagaaacaggatgcccttcagtgctttagtccagcgtgtcacatgaccccagggtataaaacccaggtccggctgctttccaggttccctcagctgtggtgcaaatggggcttgcaccatctgccctgggcagcttttctgagtcttggggactaggtcccatgaatcctaggcttctgttgtttcttgatgcctgtctgtaagtaagtaataaacctgctccatgtaatttgttgcacataagtaagtaagtgtcttctggctcactggactcagacaagttggtaaccagtgcacagtgaacttacttcacacagattttatggttccacttcatttggagtctgggccatgaatctaagctcaatacttctgataattgtgagcagattgctacacacgtactcacacaaatagccagattcacttgctttggtcattaacacagtttattattggcacacttatcagtaaagcatacataaaatacagctgttttttaacacacggagccactgtgcctttacatgtgtggaggaacatattaatatgcaaatggaaaaattaattctcttataaagtttcacataaatacactggagttgcccaaaaacgaaaagtccccataaaagaaccaggtgagagctttacaaaatatcatacaagaaatatactataaaaagaaaggatggtcaactcaggtacaattagaaaacacacaaaggttcaggtttattaaactgcccacaaaaccaatggattacatggcttgaaaatatttggatcaacagcaactttacaaatgcataaattcttaagggtccaattgtctttctttacttaaaaatctgccctggtgtctttgatgaaaaaaatgacatttcttgtttcagcacttgggctaaattgagtcgactcaagacaagaaccaattgacatcagctcaaccataaattaccttgctgggccctcttagctgttgcccaatgaaagaaaacataaagaaaaaaaaaataaggtacatttaaattactttccaaagctgatttttttgtcttttctttttttactgaaacaagaaactctcagatgcaagtcaaaaagcagaaaatattttacaatattaaaaagtcatctgtagttaggttcggcatattaatgagatcctgagcactgagcatttatggacaatatggccttcgtttgatgcataaaaaggaaattcaacacaaacacgttgttaaaaccgtgccagaagatgcgctagagttttctctcattttaattacaatcagtgccagtatctgtattacctgtgaaggcctccaagaaagggtcatggaagcttactgggaataatcctctcaattagaaaaaaagaaagaagaaagaaaatcagatcattgtggtttagaaatagatatttgcatggaaaagtttttatctcttctgtttcctctcctgtaagtaaagatttgcaattgtaatgatcacccacgggcctattgacagtggattctggtgccgatcatcttattgggaagcctggggtggggggttttctgatttggtctcttgagtggcgggaggtttactgttccacgggctgttgttccccagcgcgggtgaattgttgaagtcctcctcgtcgtccatgccgttggccgcatcatattgcgtgttttctaatctagtgattagcctttcgtcctcgtccccaaactcacctcccatcagagttggctctcctaccaccatcacatcctgtgaacagcagctgacattattacagggaaaccttgggagagagaagctcagcttaaaataacagtgggaggagtcggggaatctaggacagacacactcgtgtactgtacaacggggtcaagtctcaatgtcgggggccgagacgcatatttgatttctacaggaaataaacatcgcctcctgatgtgtaacaaccacgcgagtttatgtccttagtgcgcagcctgacactggagaacgagcaatgctagcaatctgcagaaataaaaaaatgtatttttcaaaattaaaaaaatccatgctttcaacttgccgacattggggacttttgagagggctgtggaaccttctgctgggtgcttctcaatacctccaaaaatctgccacttttatttagggcctgtgagtggctttggaaactagcagtgaccggagacacacgtaaggtgcaattctgcaatattcacacaactcattccaaacggtattttctctgtcccagggatgatatacattttaattgaagacagaatctctcttttctctactcagccaggcccttttatgcagccaatatccttgacattctgctacttaattatggtaattaatttaggtaaagttttcgataaaaacaatgttcacactgatttgacaatttgcatagctaattaagtcattagcaaaaacctgctgattgccaacaagccttgaatttaccatctgttatttcatggtgcctgtcacctatcaccacacaggcaaccctgccacccatctgggcagtaaagagaaccggtctgtccagctggtgccataaagggaagatgaagaacgctaattataattacattgatgaagctggtagtcatcagagatggaagcgtgcaagaagaatccatctaatcactcttttaagtacaaattgtccttccatgcaaataagtaagccacctactgtagctgggagcatggggaggccacagctggagaggccagggatggggaagaagaatgcatacacagggcagagctccagcttctttgttcaaaggggaccatatggggttgatgagggaccttggcatgggacaggacatctgtcaggtggattcttctgggcaggctctgagcaatactccacttaaaagtgcagtaacttcaggaaagtgaccaactgtgatcagcctccactgaggccagagaaggtagggctagccagatgcttttggagatgagagggtggggtttccagtagaaaggctaattcaataaaatattttgacaactgggcagaaattcattttactagagctttgcccagagaaggccttcctgggacagtagaatggaatactgcctactgtcaggagaaggaccagtgggattttgaaagtgtccattgaacaaatcccttagttaccccctagtcttttacaatggaaaaccttgttttatttatttctgctccccaccattcttgagttaggggagataattaataggtttccaaactatgttttctgactaatcattcttgtgaatagataaaaatgattttaaaaagaaatgtcccaaatggagtaagtaagtgcctaaaatgtgagcttggtaaacccagcaataaaaatgccaggggatattcatctctgtgcttccaagatttatttatttattatgcaatgaagaaccagaaatgacagtgacatggaacgagactcatgaagactgttaaggtgagatgcaaagtagataccgtccttctgactggcagaaaggatgacaggattttagatggagtgtggccaccacagaggcatgaatggtattcagttagctgggcagctgcagtgttacctgtttggggatgttcaggataaaagagtgccactgagttataggcaattaggagatgacacttatgatcaagaacaaagggagatggaaagaatagggctaggttgtacagagcatgacctgagggttaatctcatttcatgacttgtgtccagcacacttgaagggcttggaaaacacatgcgtaaggcgtcacagggcaggagaaggatgttaaccaaccaagtgggtctgcattagtatcgtgactccaaagtcattgagagaggatgggagagtatgaggaagcataatttgaaagaggaggaggaaaataaaaagcagccaacttaagcatgatattaaaagaaaagctctcaacactccaaatgcattcattgaattagaaaacaacaatcattgaagaaaagtactatgaacatagtggtttgaatcatttccaatggagccaacaggcttgtaatctgttcggtgaatctttgttctaggagcagctggaaaagatgtctaggcataggtgtttttaaatgtactaaatttcaaagggatgccacatatgttttactaattatataaaatatccctagctagatacttagttgtgtgtgtgtgtgagagagagagagcgtgtgtgtgtgtgtgtatgtgtttgtgtgcgtgcataattgacaaatggcaagttaagggcttcatatgcacatagacagttaaggccacttaaaaatttatgtgcatgtttctattggttcttctaagcctctagactaggatagtgattatctgctctggcagtcttgatttgttattctcacacaaaataaataaagcatgatgcacattctaggctgcctctgattaggggttgttagcaacatttcccccccattttgttaaaaatccccccaacattggcagtgagagtacatttccttcccatctctatcctgtgtgtccacgagagacaacagcgagccatctgagagaggtccatatgccctcagctccccacaaggccaacttctgctccttgctggaagcccggaggtgccaccagctctcacccatttcacatcttctcactaatcccccgtgcaaagaccaccaacctctgaggaggactggaagtgactcctttcagggcccctcaatgcttctccttaaattggccagaaggggtcactgctgttgaatgacacaggtctccatccctcccagggttgaggctgcagttcgggatcgctcctagcccctgctcatggagtgagaagcagaatccaaggattaaaccctagccctcgccagacacacacatcgctgccgcagcagctacacagaccacagctgtggtcatagtggcacatgcctttggaccagacagtggatgcctgcaggtagcatctctagttaaccagtagaatagtgttgataactcagtagacagggttaaaagatatggtcaccacaagtcatccaacgcttatcatttaatgtccattcaactccaggacacatatgaatttgtacattttcctaatctggttgttctttctgcctctctgtaacatctgacaattttactttattaaaacatctttaactgcatagtgtggagatagtgatggaatccaactctcatttcctaacggtgccttgctcttaatcacacaaaatgcaaagggtctctacttgttacaaaccctctggatacaggtaacctccagtaaaatacagttgttgatttggaagacaggagcataacagagtacagaagctatatcctctttcaaatgaaattgaaatgattctgactagaccatatgtgtcaaaacatatgacatgtaagctgctactctcaacttctacaaccatgtcagacatcactaatggatggcccaccaaacccagactagaccttagaatcctcctcaataccatactctgagggctggcaggagagagaaaatgtccttgccatccctagattagacagtgagctcttcaatgacagggctttgttgttgttgtttttcaccttggtattgctagtacctggcacagtgtgggcacatagtaggagctcagaaaacatctgttgaactgattgggattcttgcagctacagtgcctttaagtagctatatcaccgtttcagaatcctctgagatgcactttttcttatttgctagaggaaactaacgaatgttactgcctttaactccaggattggataaagaaatgggctcctgtgtacactttttcagttgatttatctaaatcaggccattttctctattcaaaatttcaccagaagtgggcataacttgatacttttttaataaagagactctttatttccctcttttggctttttccccctgatcttcagaggtattaggtataaagcctagctcagaaagtggaggaccacctggagactattttcattatttgaagactgcaatttgtaaccttgtaaaatgtaacatggcaccttccattttaggctggtcattctccccatgaccccttctttctaatgcagtgggaatgaaaagtataccccctgtctgtgggagacaggagaagagaaacaatggcccaaggaatcctcagggtactgatggggttggttttggccaaagagaactgaccagtggaaagtagatacaagtaggtgggggcagatgtgaaagacacacttggaagtaagtggggaatccctgtgcgaaggtccactcgcacatggaagcgatggagcaggatcagaacaataagggtaaggatgagagcaagaagggtgagggggaaaaacgtgggaaagacggaaaaggtaaaattgtactggttgagggatgtaacaagaaatagggcaactttggaaaacagagtatctaaaaggtatccatgaagcactaagaaaatctcaggatttgaatgatggccaaacacctggtgatagggtggtatgacagggacagcagagaaggaacagaagcactttaaaggagcaaagtacttaaaggagatagtctaataaggggctggggagttaggagatgggagggaattaggcagaagggacagaattcaagaagaatgaataaaagatgaagaaagttcctgtgcagttttcactatatgggattaccctcagctgtcagctttggaattcaaagaagtccccttcctaatggtctttgtcaagataaagaaatgaaagaaaggggccaagggttcgagagagttgagaccaaaccagaggctgatcctcccccttagctaatgcaatgggctaagcgagagcttcactgagctacatgtttagtggctgctggttaattacctgagtcttaaaataagaggggacgcccatgttgggaaggcccagtcaaattacaatatgggactgagccgctgggagctagtttccagtggagcacagggtctccaatgatggtgctgagaggccttaatacgccaccaggcatgctgctaagtgatattttaattaaaccttaagtgacatatctcctgtctgtgactctgatggctttttaattcaggtcccattgcagcacgactcttaatattcctttctaattcccagtttgcaggggaaggtttccatggcagagttcctccctcccatcccaacctctgtccctgtcttttatccctcccccacctccaacctgcccaggattttttttttttttctaatgaaaagagactttaatttgggccctttgagtaggaagcagacagttaggatttcgggcctaagaggaaagcgagacttacaggtacctgactggacagactcaggtttgcagctgtggtcttcttcttgctgccagtgctgtttgcattgttcccagcgctgctgttggaagtgctgctggtggaatttttcctttttctccgtttggttgttggttgccttgtgggttctgctgcaatatggaaaagggaagagggatcagttctagggcaaaagcaacaaggcaatcatcagtatggttactctaaggaagctgtcttggtaaactgaagagtagactatttaaacattttccatttcttatagctttagaaagaataaaaggagaaaactgtagatgtgtttttagcacaaaatatgtgacactcttttctttgtgtgtagatcaaataatttttatttaatcattctctctaatggtatgtatttaattttgtaaaaatattttttaggtatgtaactacaagtaccactttcataattggatttaaaatattttgccattagaaaatttgggaaacttttttcctctggtgtatcttctctttaaaacagagagaggactcctgggatccctagggtaactaactccaaggtacgagtgaagtatgaactttaaatagccaaattcatgagccagtgtgcaacagcagcatctactggtgaaatgtcatattgcaacccacctctattatacctttatagaattctcaagtaaagtcagttccatcagctgtggatgtggagcttagggattcccaagttcagaaggaatacccatggtttgggccctgctgtttaataaatgctactaattccaaaattgctagaaaaaaatatgtctgagtacatggtatagccagcatattactgaggggaaactagacctcttaaagaaaggcctattcagaaacagagaaaaatattttggacttgaaggatggggcaaccctttaatagaaatatagagacccaaggtaaagtgtgataagagaaatattctttatttatttgtttgtttacttataaggtatagaacattatgtaatgcttgtcactattcttaatgtttccaatgcactattttatattcaaaaaatcctattagttaggaactattattgtaatctttgtttcataaatgagaaagtttcagaagccttctcctgccagttactgaataagttggaaatggcaagtaagagcatcctttttgccagctctattttagacctgactgtgatggagagaaggcaactcagggctacactggaaccaaataagagggccttgtagcattttcttaaaacacctatgctggacgggtgccatggctcatggcaataatcctagcattttgggaggacgaggcaagtggattgtttgagcccaggaattcgagaccaacttgggcaacatggtgaaccccatctgtacaaaatatacacagattagccaggtgtggtgatacgcaccaggggtcccagatactcttgaggctgaggtgtgagaatcacctgagcccggaagtcgaggctgcagtaagctatgattgtgccactgcagtccagcctgggtgacagagcaagaccatgtctcaaaaacaaagcaaagcaagacaaaatcacaccaaaaaaacacctatgccacttctggtggacaatgggaaggatcttcctctaaggctcatttcaaagatcacttagtccaatgagtatccctgacttctttttgacttttctactcacctactatttttttatcgtccctaaatattttgtctcttatgcttaaagattttcatcaaatggtctatcatttccttccatcgagttcagggtgcttgctctgaaggatgagaggaacaggatatagaactgttccaggtcatggagttgaataaagggttgaggaggacattctaaagtccagcagatactcaggcccactcctgacaagtatcttctttctttgaccttaagagtataaatttggtgctctttttatttatactttgaccatgaaattggggcaagtgtacctaaaatgcgtattctggactattcccattaccagtaggtggctgtggtagtaaaataatagactttggagacataaaaaccttttggtgacacagtcctccttcatttgttagccatgagactggctgtgtcaaattactaccctaagtctcagagtgcactatataaaatggagataatacatttaaagttatggtaaggattcaatatttttgcatgctttattcagttttgtaactcccagtggctagaaccacgtctggagcctaataaatctcaataaataattattgaatgaatgaaggaattaatgaataatatatcaattatatatgcctatgttagaaaatatagcacttgctgagtggattacgttttctccataaagtcttattagcgttaaaagaaaaaataaagccaatttaagcacatttaatatatttgaaaaataatattccaaaagtctaaaattcccataagatggggatgtaactattctacataaaataacacttattttctcagctttctaaatatgtacttgattaaatttgctatattcattttacataaaacccctggccacttaccagccgaaggtgaccattatattttgtgattcagaaagctatgtgcctcgtgttaataattactttttataaaaataatttttagcaaatggctacattttgcttttatgatgaatgaggctcaacacacgcctgggagtgaaagtatattagataggaagacaattaatgatgacttgaatcggtgatttcagaaccccagcaggagactatagtatctaaactgcattctagggaagtgagggaaatggaattgcttatatattctcttcatgatcagaacttttgatacaatatatctttaaaaacagagcaaacttcatttttccttcatcctttcctccttcattcatctgttcctttcttccttccttctttccatcccttcttttttctcctttccttcttccttatcttccctttcttccttccttttcataatgtctgtcattcttaaaaaacaaaaacctaaaacattaggccgtgagaagccagcagtctggctcagtggaagaaccactagattagaagacaggaacccctggctctgatctcagctttgccaatgaccttcttgatgaccttgaacacgttattttacctctctgagttgcaggtcctaatctggtaagtgaggagactgtagataattcttaaggatgtttgcctgtcacaaattcattgtctttatgtccacaaccatggtcagaatatccctaataagctacttgtcctgataaattaatgatcactttcttctttttcacatcacttcatccctggaagacacctctgaaaacgtgtttagagagagagtgaagaatgagggtgtacctggcggagccaccatcctctgccacttctgaaacaagcaggtcttcaggcagtctcggggactgaggttgtaagttttatgtctcgacatcagttcctgcattggctccaatattacacacaactgcaagaagttcaaagacattggcatttcactacttcataacactaattacaataaataatgctaacagctggaatcaagtag

SEQ ID NO: 100 - DNA, 206628 bp, Homo sapiens
agtctgccagattggcaatttgaaacgcactgtctgtgacggctgctgaggctgctgcgggggagtgaagggctgtcatgacgatgacccctggaggtaatgagatgccccctaaagccgggatagcggaaaaagtccccacgcgctcggggagattcattatctctgcttcagcagcgccgcatttgagcttgttcatgcattcccccgccaaaggtctgcagtgttcaggggataaggtggagaggaaattagtatttgccatttgcaacgacggctctggcgggcagccagctttccccagcctctgggagtcgtttcggtggtgcatgctggtcctgctgccgccgccgccgccgccgccgccaccgccggcggggaggatcgccgaggaggaggaggcggaggaggaggcggcggcggaggaggatttcctgccgcccccaccacccccgcccccgcctccgccgccgccgccgccgccgccaccccccccgccgccgcccccgcccccgccgctgccccagagcatggcggtggcggcggcggcggtggccgcgttgtcgcagttccagggggacatgccgatgcgcgcggcggccgcggcggcggcggcgctgctggggaagatgggggtggtgatgcgcgcgatcttggccgcctgtgggaaggcgcccccgttggtcttgtagaaggaggtggcaaaggagcggtagcgctccatttccgagttgtaatccacaaggctgttcagagccccctcgggcaagtggctttccttgggcaagcccggggcctccgggctcggcccgggctccacgcagacattggtgttcatggtgcagggggggaagaaggggtgcagggtggaagtggggaccgcctggtccgacacctgggtggaaaagggggaaaggtgggggggagggaagggagtgatggtggtgttggggtgggggccgaggcgggtggggaaagtgggttcgggtggggagagcaaggtgagggctgctttattcctctctggggctcatttccacagacggtgaattcccaggcagcgtcttcctttgcattatcctccaactgttacaactaaaataaagaaagtcattccaacgagctgcacgaggaaaaagattaaaaataaacaacctccctcactaacccaccgcagacaccgaaagctcccacattcttccatcaggtcgtttgcataagaatcatcaagacgtgaccccccccagcccatcccccccaactctcccaacccccgctccctccctccccacagcaaaccacagctcctcccccctattcttataaccctcctgagaaaatgtattaatagccaggatacccagggaaagaaggaagacgggggtgacaaacgcctaaggaaaagggcaattggagtgctaaagacatgcaaatcatgggtgggagggcgatactacctataagcagagggcatttaaacattatgaaatgtgtgaacaagtgctgcctgggcatgcaaatgctgtaaagtagaaaacagcaatggccctatgaggaaaatgaacaggaaattagcaaatgaagtactgaaaaagtctacaatacatccgagtataaactgtaagcaaacacaatacaactgagagctaagagactgcccacatacaatctgaactaaagaggcagggaaaaaagaactaccagctgccacagtatccttctgtgtctgcggtcattagtttgaatcccagcacagctggctctgttagggtcttaattcaatggaccaaggacaggtctcaattgtacaagccatttggtggtgggtcttggtgggggtaagagggtggtgttctacttgattttttttaaggtagaaaataaagataagccagataattacatatatacatatttatttatatcagcaatgtctcaggttttaaaccaagtgcctgcagcctctataagaatattcctaatcattcctaatggagattgctgtctcttccgaagacaagaggaaagcatgggactttttgaaaaggatatctcacaatcactgatttttacattgagtaaaaggggggggggctttaacgtgttctttgccagagaaaaataacaaaattattttttaattttgctctttttaagaggaaagtttaatgttaactgggtatttgcattaatctccttgcttacaggccattattatgctttaggaagaggtattttagttgtttattacagagggagaagtacatcacagccttttaagaagcaaagcaaaggcataaagtgtatattcacttaaaaaaccagtttctttgtttccagattttttggccagaatatctttttgtgacatcttttgaagcccatagattggtctagaatgcagagttcagggaattctacatgggggcccaatagtctccgtctcaaatattcagagttcaaaatggttatcaattatagtaattatgcttataattaggttaatgaaccagttatgcccaaactccaagtgcaaaaacttcaagacctactgatgaggtgctctaaaaagaggggtttatgtaaacaaatccctattaggcaaagtaaatcaagataaggaacctcaccccaggctggattagaagcttgcaggcatctttcaatcacagcaagtccctaatcactcaggaaccacctctgtggtttcgcattagggaaaactgctgccttctcaggtctgagggcaatacaaaaggtgcccccaaaatgctcttggctaaatattcttgatgcttggaaggggtgagggaagacacagcaagaatatgcatatagcttcagtttctgcgaatcacattgtaactgcaagaccataataactgctactcagtaaaaactagttatgtcaaccatgcattagatatcatcacattgagtggagggaaaattttcaaccttttagtcttttgaccttgttccaaataaataaataatttaacgtcccttttttagagtcttagagtggtgtttccaaacacaagctttccttgcttttctgattgccatcaccatccctcttcctacctcaaggtttaataccaccagaaactgtagaaaatgattatgcccagtatccaggtcattattgtttaatcaatgcatctctggagcatgaaaaaggtatctaagccacagctattgtttggattttatttaaaaacaaaataaaacacacacaaataactatagttctatgccaaagctaaattagagatccatacttcatgatcctgttttgcctttaaacaatgtgactttacatgcctaatactgtatgtctggtctaccagagacatagagatcaaaggtcatatttaacattcaggaggaggggcgggtgcagactaattaataaattaatacagcgacgctttttcttgctggagtccagcattaataatctactttcacaatcccaacggacagcaaacatttaagagaaaaaaaagccagagaaagagaaagaacaatcacttaccagtctctttttatttggggagccttagaatttgcagacgctgccagtctgcctttaattagttgcacatcaccccctaacacaaagaaacacaaatccagatgtgtcttggcagctcccaattacaactttaatacttgtaaacaaactgttgggggggggggggtaaataaatatgcggatcaaaaaaaatacctgtaaatggcttttttttcttgttgcagagagaaggaggaggagatggtgttagtggtgggggtggaaggaggaggaggtggggggagaggaaagagtcgagtgtgagtgtatgtgtgagagcgcgggtctgttgtcggtggtctctcctctcccagcgcgttgctctccgtccgtctccagtcgctgtgtgcgagggagggagggagccggggagtctctcctctctctctcccctctctctctctctctctcttcccctctctctcaccctccccccttctctctctgtttgtgtgtgtgcgagtgtgcggttgctgggggaggggagccacagagaaaggcgagggaggaggtgtggaggctgggggcgggggcgcgggggtgggggtgattggcgccgaggtgaggaggacgcagggacgtggacacctactgatgattggctgcaaattacacggggaacaagaggcgcacgcgggccagcgctccttttcacaaatcctctcctcggcagaggagccacgttttccctgctcgcctgcggatcgccctccctcctcgcgcccggctctccggctcagcccagcacacagggctgttgattattttcttttgctctcggagataattgtttggaagggttggaaagagggcgtttccgccactctgcgtgtggggtgtgtgtgtgcgtgcgtgtgcgggtgtgtgtgtaaataaacttgtctgggatttctggctgggttgagaagagcaatacaagaaacagagaaaaggtcatgtttgtttgaagaatgctcttagttcgtacccaatggcatggttttaaataaatttcctggtgtacccaggaagactttaaaaaaaaataccatttagatctttaaagtaagggaaaacggaccggtgtggttcttcagaccctcgaagtactattatgccagaatgtaaaaaatcggtgatatgatgcttggccaatttcaaaatccatctcaatctctgtctctcttctctactcttctctctctcctcccaaaatcctcttttactattccatctggtagttccaaagaataaatcagatttttaactcactgccctattttttaatttcaaactttacttaaacaaaaacttttgtctttcagtctattttagaatagtatgtaattaacatttcacttcttgccacttgggaaaacatagtttatgaattgaaacataaatattgtacggcacgtcaaatataaataaaactcgttcataaatgcagctgtaaattaacctcttcactgctgcctcaaataaaatatttgtggacacatgctatcctactattaaagtatactctagtggaaatagttataagatacagaattatgaatacttttgaataattttttttctaagagcaaaacagtggctaaggtaagttatagagtaggaaagaaaaaacttaagattatttaaattggtgttatcaagcagagtacaagttttgtattaaaattaagtgtttattctagagtaatgcaatattaattgttcagataagtgaggaaaatataatgttttgtttctttaataagaaaaaaaagctgaaaagacattttaaaccattttgtatttgaattttcaaaagatagactttgaccatatcaagacattaccaactatggaggataaattgttgataacaagtttgaaactgtggtgtgtgtatgcctaaatgaaggtgttatttcaagagtgggctactattgcaataggaaacaggtgtattttgtgactcattgattaatatacatgttttgtaatttttttaaagcataagctgtttgattattaccggttatttgacatctatagacaaaataactggagggttaataattattcaagttaataagatatttttattcttgtgctaatgcattataaaagcaaaaaaggaaattttccatttgattattttgttttagctcagcttcataggaaatttatcaggaaaatgtggtcactttttaatgagtgaaaacatgctagaaaaatgatagattcttaaacatcttttcacaatatttaaaatatcagtccaatgttagaaattttgaagtttataaataagcaatgtttttaatcaaataaagacatcatgctttcttttgccaaattttcttttctggaaattttcctttttggaaattccttttctcatgctttcctttttgggactcttcaagcttactttcaaaatgaaatcttaaacacgtgagagaaaatatgttctaaattccaatgaattttactttccagctaatgaaggaaaactacagaattcttggtcttaataattaataataatagcccctattaatgacccattagtgtcagatcctgcactaagtaatttgcagatattctattttgtccttgcaataatcctgtgaagtggctattatttccattttacaaacaaggaaattgaggcccagagaaatgaggtaacctagattaggtcacaaagttagtatgtaaaaagtttgaaatttgtacccaatctggtctattccaaagccttatgtttataacctctaccctagtctcactgtcaataattaatcaatcaataaaccttctctggatactggaacctcagatttaattatgattgtaggcccctagttgatatgggatcaattaaatttataaaagaaattataaacaatatacctcatggctctgatatagcattctgtttcctttccactagggaattgattgcatacttagccaaatatgatcaagggaaatcttttttctcatctatctcatatccattaattttttatactagtgtagatacatatatgcaccatgtctcacattagtctatgtttgtcttctttaaaatgatatatcagggttttgataataatacctgagaacactcagttctctgttaactctctttaagtccacagttttatatgatatacgaaaaagtgagattgttttctctgcaaaatgcccattacagcttccaattacctggaagtggtttgtgcctttaccctgctttatgattttttaaaatcttagctaggagagagttcaaaggtttcatagctatcctgatgggactttttttttaatcccaacttgagcatcacccaaaaaaagtatccccactcagcataaattttatgtactgctctcaaatatctttaaagtactgctactttccaacataatcatgatcatcattgttatccagaatctccaaaaaggtagcatattctgttgaaataaatagacctcaaaatttaccaatgcaaaatccacagaagtatgtgttttctcatgtaacagtccagggtgggaatttcagatcagagaccattcttctctatgagtgatccatagattaagattccttttatcttgggacattttatctccaaaggactgctcaactacatcaagctggcagaagggcatgaaggagctatgatggcttgttaaaagtcttggtcttaaagtggaacatagcactgtagctcacatgcaattgtcaaaaacttgttacatgccacacctagctgcaaagattactgggaagccaactccaagatgcagctttattactatggggtagagaaacaattctgagggacagctagctatcttccacgcagagtaacacagaaggagaataatctgatgaagtgattaagtagaccacacagccctgaatctaaccttgaaattcctctgctccctggaagttattttgctgattaccactgaaaacagtcttaatgactttagggaaagtttggcaactgtgaaagaactaagctttcttaaatacttgtaggatagccaagacaaggttagaagatttgaacaagaatttactgaagaataaagaaagcagaagtaatacaatcagagaaaatagcataaataaaaaataaactaaccgagataaatcttggggacctgcagcttgtctgctggtgttttcaaaccaagaggtaatttttaacctcgcacaaatgagatgtttcctattagtcataagaaaatatacaacatggaggtcagaaaaggtgtgtggagctttcttacctaatatccaaggactcacatctcaacttacattcatgggctctgaggaccacctcttttgccatagtaattcactgtggatatagtaaataaccacatcctttatagaaggaatattcccttaaaacaaatagggaataatttctttaactcttttgactggccaaaaatctacctaggatttttatttacctggctcctttcccagaatttgagttggttgacattgggaattgtgtcttatacagctttgtgtcccacctcatacctactatgcctactacatggcaggttccaaacattctgagtcatgcatattgaaataatgtagtatacacaaaatgtatggaagtaaattccccattgcctataggataaaagtgcaaaatttataaaattaattttatgaagcccttctccaactggttccatcttttgaatctactctactagtattccttccaagaacccactattctagcagatccacttagctcagaaaacttcatttgccttatgaccagagagggagaaaatctttaataatgaactgtgagccaaaatgaagtactattatttccataaaagaaatctttgcatataaaaaattattatagcataatgaaataatatttttaaatcccttaatttaacgttttcagaagttgtcttggtgacttaacaattgggatttgatgaagctacttcttaaaatcaatattctgcacacctgttgttttctttcacttctaattaaatattgatacgttgttatcacaatgctgaccttcatattcaaagctggtacttttaacctaccaacacagtaggtcacatgctttgagctgtttttccagctatctttactctcttaccttgtctttctaatgactaacaggaggcacttatggaatggctggccactgttaaggacaaaaactgtgacaattgaggataatgaaaataatgggttcacagggttaaacccattacgttggcctcattaacaccatattcaaatcaactaagctaatcaagcttatcacattcacatattttcatatacagtttggacactagacaaatatgtaccaagtattattttgggcattaatttttagaattgttctttgcaagaccaaatttggtctagccccattttaatttactcatgatattttttctcatcatataaattctcatttctataaaactacagctctaacactccatggaaagtgctattcccaaacacagaaatccaaactttctctggtaggctagaaagggaaaactccagaagaatgttttttcttctataggctcactgacatagcttgatttttattagctattgttttccttgtactttcccaaaaatatttggtatcctttgttcattggattattagaaaatacaaacaataacattccagattttgtcaaagtatttactcatgaaggaaacaatgggtcacttttgctacaaaacaccaagtgatggtaaatagcttccaggcactaacaaatctaaactcagatttgtaacatgggccccaagctgttctttggggtctcccttttcctttgcctggcagaatcaaagcattccatgctggcctttgtcccaggaaaattctccttaatcatgcaactacctgtgtgccttctggaaagataaatctcttcagatagataagtaatggtaaagtaatataaagtgaggaaatcctgtggtgaaatttgtagttaagagctaaccaggaaacactttgtccacagtgctcagtgtgccagtagtccgtgttcccctgacagcagtccagaatgtggcggtgtcacttccttctgctgtcggccattctcttctgcacacaagtcttcttagacagaatttataggacactggaaatcaagtaacatagtcccctatctcaattcttcgaattctctatcaaaactccaaactcagtaacttaggaaaccaatgttctattaatacttcgctcaacaggaagaagtggaccttttatttaaaacaagcttacatgcagacactggacattttattaagaggcctctgaatcttcaaattgctagacaggacttacccagttagaaaaaaaaatcttcaatttttaataatagagttacttcaagaatgtaccttgtaaagacataaaattaggtttataaaagtcatattgttaagctctgtgaaactccaaaattaaatctgtcttaaaccatttcctattatataatatcaccatttttgaatttgccatttttaagtagaataaagaaatttttacaaaatggttgtgaacacaaaaattatatttttttccctggagattttagacttccagtgtaacctagatatctccatttgcaaaagttcaggtttcttaatattagtctcaatattttatttgaaatcaaagccactcttcatgcttgtttttttttaagtgtgtttccatttagtttatcttcaattaactccctttttaaaaaaggaattctatttttctttgttgagaggaagaattcaagataatatccctgagttgttaacgttcagtccagaaaggtttttttccttcccagtgctgacctttgttatgccgtagttatagcaacaagaagagttccttctgtctgtctgttgtgttctctttccaaactaatgacagtcttttatatgctgttgtgcagtatggggaatgctttacgtgcattgatttcttgatttactgatgcatttagctaaaccagcaatttgaatggaaattttttaaataaatgcaattaattgaaatggaatttgcacattatatatgttatttatggaatacagatcattcatttaggcatttttctagattgtctttgagcttccctgaccaacttgcagtttaacttctcagtgatgaagtttatttatcctatcattatatcttcttagtcgaaacagaaagaaagcaaaaagagagagagagccccttctaggggagtaacatgatgtaagaacacttagtttttctgccaacctgggtcatacaatcattatgaccttgggcattctacctctcattttaccgatctggaatatcactttaattacagtaattacctatctcacagggtttgtgaggtttaattaatgttagcaaagtgttgtagctatttagtagagcagtactataaaaagcaaactacctgaaaatcacaactatgttctccccacatagtacttaattttacacaatccttttctttttccttcagagttaatttaacatttattgcttttttttttctgttcactccatatctacatctatggtctttgctacttgagacttactttggatgtaaaacatagcctctgtcccacttttgttagattgcacgatcacctccaggagctcaacatttctgaatctaactggattgggattaacagtagtatctgagcaagtagctgtggctacacacttcctttaagtccagttataaactgccagttaacaatatgagtttggttctcaaataccttttgtttggaaccatggtgttaaacaaactcaattagacttccagtttttttcataagttggaagttctgaaagtattgtgtctacattccatcctggaaatagtagctgtagctattattagtgatggagtctccagtttgccggcacttttagcattccctgctgtctgacacttgcccacctaagcattggaatttgtaactcaaggcatctaagtacgcttgtgctagctgttcactgcacaacaatgcctggccaaatgggcaagtaggagctggaatccagcccattgctttgcttgccaagccatgttctggtgggtctaattagcaaaaaggcattctaggggctagaaatggccttatcagtatccccattataggccaattaagtaaagcaatgaacattgcagccacctttattcatattaaaaagttagcatctcatctttgaaattatatcccacaagattatatttagattaatattaaaatcatattcaattttatctttatcccttttttgtgaaccaatttcacctaaaacatattccaatatgaactaattttcaaataggatgtaaataatatgaaattttcaattgtatgaactcattaccactgaatcaggagttatgtttcattgaatatcaacaaaatgactagtaatgtgagttggatcgtcgtaataacattgtatttctttctttgggaacaactactctttaaaaagagggagacactgttcagaccccagttctttctgttatctgctaacattttataatggtagcactgcttgaaagagcagttgtttttaccaatttgtaacttggctcttttaaaatgcatgatgatacgatggcatttcctttaaaatgtttctattttaaaacatatcctattcctgtaattcttggctactttgtattagtgaaaaagaaacaactctgttacctaatgggaacactgattgatttacatacctttctttagcaagtatcaagagtccaaaatttgaagaatgtccaacaaaagctagcctctagatattttactgcatgctaatctccttgcagaggaaatccagacaggtatattcatttgttatagaaaacaaaataactttattctttaataaagaatagatagaaagaaggttttgagaattctgagtacatgtaagagaaaattactcaaactggcttaaatgatgaggtctcttgtagggcagactccaggcaaggaacaacctgtgtggcttatagatatcacacataatataggcttcttccatctctttgctcatcattcctattatcttattttttccttcaagcagttccctcacagttactgctccaacatcataatctatgcataaaaaagcgttagggaaaagaaaaggactttcttttttttatgcgtttttgtctttagagtgaggaactttcctagaagcaccatcactgacttccgctaagatccaattacccaaaattgagttacctgatgacacataaaccaaccattttcaaagagaatgaaattgtcttattcttaataagtatctaccagccctggaactagaggtgtaatcattctgaaacacatgacggtgtgaaggataggaaatacctgaacatagccatgatttgtttaagaaggaagaagaagataggggattggatggttgttggtgagaccagtatcagtatccgttgtcttatataagtctattatcacttgatttttattgtcttagaaaaactaaccagccctaaatctcatgaagcatgccagattacatataataagagaaagtcagtttatggatgccagctctttattatgagttaattaatgaattataattacagccatgaatgcctataagcaggatttatttttagcaacatggctttcctggcaaagttttgatttactgacctatctttattgaaacttatctcatgttcatcattacagaccttttatactatgttacataaatcagggagtatctgagcttgatctataaggtatagggctataggatgtgaggagaaagcaaagagaatgaggaagttaaaagaaattaagagaaacaatttaaaaaatggcaaggtacatctatttccataattaagtacatctggtatattttcatcttataccttctactggccattaaaactattaccttaacatatttgcaagtaatcagaagcaaagtaaatagccagtccttaaaatttcaagttgatccccaaactgactcaaatttgcaaaaatctggcataatttaaaagtaaataaatagaagcaacacttagcagaaggttcctaacataaacaaagctgtgcacgttttgtttatttatgggatctatgcaaagtgtcatattcatttaaaaatattcagcacgagagtgattgattttaaaaattgaatagaattaagaaacataggcattctttaaaatttaaagttctgtaaaagaaagaatggctattttttctagtattatacttgggaaaacatttttctcctttatgtctgttcagatttttttaaacattgactgtgagaaaaatagccagcattttattcaaaagtgcattttaattgggatgtagcaaaccccaatattcatgtaatacctgtatgttgctccagattaagtgttaaatattaagtatgaaatctcctaaattaatcttttttattcaatatatttttatagcattcttaaaagacaaaacatgttaaaatccctatccttatagaacttatattctactgtcatcttaattcaactaatagccatttactctttctttccagcctggattattctttatcatattttaattgaataagtattttttgaacacgttatatgcatgacataatgtcaagtactgaaggaatgagaaatttccttgaaaaactaataatttaatagagggtactcagacaggaaacacacacagttctaatattacatttatctcacctcttctataaaaagaagaatttaagtaagtagagtgtaataaaaaccagatcctgaaaatttctatattgtaagtatcaatgtagtgcattaaaagcaacgaggaaggactggataatttggaggtctgggatgctcctgaggaaaacctcacaaaagaagtatttgaagtggaatgactaacggagaaggggagaaagaatatttggcataaaggacagggtgtaagcaaaagctgggggaacacaagtgcatagcagagcccagaagtggtacattgttgattgtggctgcagtaatgatacatcaaaaagagacaagtgatgggaaatgagacccagaaagaatactgttaaattgcatatagcctttaaggttatgctgaggaaaaagacttgcttaggggtaaaaagaggccaataaatgttgtttatgtcaggaggtctatgctcacttgtgtttttttgtttatttttgttttcaagtatccttctgacttacactggggaagatggtttagaggaggtgaaacattttgtcctttagcagcgttttagataaagatcccagcaacaggatggaataggagggagacaatatagacaatttgaggaaaacctagagtttatttgaaggaaagatgaacttcagaggacaagaagggtgattcacaaaaagtcatctggaagggagatgttaaccaaaaaaaaaaaaaaaaaaaatcccaaaagcaaggatattcctaaattgagtgaaccattgatgctgaaggatctacaaaggcttgaaagaagcttctaggggcaattctagagttgtgctaagagcagtttttaaccactagttggtttgggaagagatgggaaactcctatttctactgttgcttggagtacaacgtcaaggggattggcttctgctcatttgtgtgccaaaactatggttatttcatgatttattttatgggaaattattatttattttatgtcaaaaaacagaaaaactagaggcttttgctacatatttgagcttgccccagattgaaaccaataaatgtggcaataagaaaaacttgtcagtaaacagtttcaaagacctaatggttacatggataactgtgcagtcaagatcatcccttttctgatcttcacactgtcatcaggatgatttatgggagaagagaatcccataaattctaacctttgcatactccccaacacttacctcctccaatactggccaaagaccattaggactcatctctttatatactttttcactattgtgtcagtcacagccataaaccctggcttcctagagcattgttgattttcacattccagtttctatatatagctccgtatatccaccttttagtagccatctcctgacaccgttgattcttgagaatgagtgtctgccatcagcaaagcccccgtgttctcaataacttctctgaaaattcccttcatcttgctcttgttgaaatgtggttctttgggaagcacttgcatgctctgtagtgctctcaaatggtgatcatggggaaggttccttcttgctcttcattgtcatttccagactgttccatgctattcaagccccattctccactgctgtaacagtaatgccataagactatgctccctacttctgttccttgtttaaatcatctaaaggattgaagggctctcctcagtctatgaaaactttagctgtaactcttggctcacaccaccacaactctttccttgattctgagtgttttcagtatttagccatataattcttcaagtcctcttgcctccttgatcacctccctttgattctttttttctcccgcctcccttctgtcattaaactctgtggtcacactctagacccactgtctactcatcacttcctatatttctagatcacttcctcaaatccttggctctcaaatatccttcaattgtccctcccactgaacctacaatccattgatcctgctactgttaccctcatcttcccatgcctctgtttccctacatactcctcagcttggtcaatcattataaacattccctttcaaacactctaaatttcccatgatcaatcattttgaacactccctttcctatacttcaattcatttagctatctcttggctaaacccttactttgggatttgtaagctgtgtttaaccaaagtaaacacagtaaaggaatgcctgctccattaccttacctgaatagccacatatggctggaaaaacatttacaaatctaagtcttatgttagcttcatggtagttactcaagtgggcctttaatgttgcagagcaattatattacatttactcttcctttttctttctgttttatatcttcttttttcaaacctctaacacatctccctgttctttatgcaagtttctacttcactgtgttcatagaaactactagaatagcagtttccatgagctcctgctatcatatctacttaccttctagtatctgtatacagacattcttcctttcctcccactggaatatattctgcatgtttctatttaaagacaccctctcccattctcactggatcacacatagagtctcactccagcaattctcccctctttgtcatcatcaaactattcctctcaactgtagtattaccattagaatacgttttttaaaccatttaaaccacatttttccctctatcaatcaccccattcactccttagacagttaaatttcttaaaagaatggtatataccaatgtcataatttgcctttttcccttatctgttgaattggcattagtccatctcttttcaagatttccagtgactgtaccttgttaaattcaaagatgaacttcagtcttcctcttattttacccattagcaacatttgatgttctctttccagggcttttagaaaaccagtcccctgatttatctcctaccttgctatcctcctaacactgaagtgacccagagtttagactttagacttcttttcttatctgtttacactcactatctttctgatctcatccaatctcatggctttaaatttcatctgtgccctagacactccaaaatgtaaatctccagtcaatacttttatatctaattactttaaaattccagttaaattatctaaaattgaacacctctctcccttaactaccctaaaacgtgctctcagttaatggcaactccatcattctagttgctcagatcaaaaatcttggggtcattcttattactctttatctctgtgatggttaattttatgtgtcggaatgactgagctaatagatagctggtaaaacattatatctgggtgtgtctttgagagtgtttctggaagagattcgcatttgaatcagtaagctgagtaaagatcgctctcaccagtgcaagaaggtatcatccaatccactgctgaattgaacaaaaaagcggcagaagggagaattctgtctctttcttcttgaactgggacctgggacatacactttctcctgccctcagacatctgtgctcctggttcttggttttctggacttggactgggacttacatcattggctttcctagttctcagactttggggcctggactggaacaataccatcagctttcctggcctccagcttgcagatggcagatcatgggacttctcagcctccataatctcaagagacaatttcccataataaatctttctctctcctctctctccaaaaagggaacaaaaagggaatctaaagcagcagagagaaaatgagggaataaaaaggcaaattctgaggtggagggatgaaaaacagacttcaattctgattacttgtattgtttcattgaagcaagaggtgaggagtatctggtaaaagtgagggcagattcaatgcataaaatcagtggtaaatatctgaaacattagctttggaaagcaaggagggaagtctaggagttaatataatatatgtaatgtattaaatgctcattgagtatgtgttggcttgaattcaattaagtaggcaagagaaagggtaagctggttgaaagcaatattaatagttcaatctgaaagaaatgaatgtacacctttgcagtggatttttagccgctcaggagcagaatgctaagaaatgtgttcctggattcatgcagagtagatgataggcattgtgagtgtggtcaaacttcatgaagatgatagaattagtatatgttaatctgctgctaacagtaacagcaaatgcttagtgagctcttgggcaaagatttcatctgtacccatctcttcatgttcacaatggccttacttgatgcataccttaacaacccccattttccagataaggaaaataagattaaataactccctcaagtgtagctgagactctctagtgttttaaactctgttgacatttggtgtgcttttctggttctgaacttcaaggagatgaatcaaaattccctttattcatgttagctataggctttgggttcaaattcttaaatttctttggtggtaatttgggcatttaaaatataacttatttaattttcacaacatatattttttaacattttgaagttttataaatataaaatgaattatgttccataataatctgttattatcttttaagaaaattttacaaagaatgtatttgaaaatatatataagccaggatgtggctggtagctcagaagaacggggtagagtagggccaaaattgatgacaaaaaagacgaagtttaattacacaaattatcactaggcttagcacagtctacatataaataattcttggtcagccaggatatcttatttcactcatctaataatgtataatgttcatgtctgtttctagcacccgtattgatttttctcctttttgttatgaaatataacatgtatattaaaaataatagggagtaatataattaataccatataatctttacatagattttaaaacatcaattttttttccatttcttcagaattttcaaaagtaagtgaaacaaaagctacaggtagatttgaaagcctatttatactcacacactatctggttgggtacataattctgtacatattctttacatatatgtagcaatactattatatggtgaccataattctgcaacttgcggttttagggtttttccatcttcaaattttccaacacacttaacaggttcctttcttgagatttacattggttattcccttttccaggagcatatttccttcaggtttcaacatggctaacttcaagtcttttctcagatgttattttttcaatgagacctacattttaccactctttattgaaagtccaacccaccacttctcctcttctcaccctagttcaggcattgtgatcctccgcacataattatttttccctatagattttatcgacatttcagttaaaatgtgctgcactgcctagatttttcctttactctcgtagagtcactcattcccctattgctggtggtgacttataaagctaaactgagttcccctccaacaattgccctaagagagcagcctcactgaaggttatgtccctcctaaagggcagcccgcatacaatgattagcctttgcaagaggctagatggtctgtcccccatgcctaacgttggaataattgtaatgggccagccaaactctagaacttcctgtaggatcagctgaatcttctgttgcaactgcatcactgttcagcttctccttctgaccagttcttctcctctcatacctcacaattgtttctgagatctctatccagtattccttgtgtacacaccttttttgttatcagagttctatgaagattgacctttgacgtttatactagagctaatcctagaaagcagagtctaaaatgggatgtttgtaggttcatgattttatttggccagctgtcaagaaaaactccttcaatgggggtagatggaacattgttaggtccagatatttggttgcagtgaaattattaaaattttcagtgatgtggaactgggaacagataggcattaaggggaattcactggcaggtaagctatcccaggagtttgaatttttcagggatgatagtaattttaagaaatttggaattagatggctatttcttcagggcaatgatacatggagaatggcaagaaaagtgtgaatgttattaacaactaatataaaaagagtctgctgtggccagtggagagcaaaagctagagattcaacatttaattaaagagcagcacactctttaaaaagtggaatcctcaacttcaggatctgctatgccaagattaggtccctgatttgaaaagagtagaactttgaaaactgggatgtggatatctggattgaagcacttccaaactttgaatctccagattctcttgaactcttttagactgtcacagtgatacactcctctttgctaattaatgggctggcctacctctgcttgagatgtcttccttgcgagaccagttgtgctctctttaggatataccaccactctccatcccccatgccccaaacagtaaaccaataactgggttaagtcacaacctaacccatcaggggacatgctgaagtagcaaagggattgtaacctgaagcaaaaactagccagtgtatagtggcagcatccaggagagtatacatgggactggattctgaggatgctggataaaagagagtttattgatgtgagaacactctccaggttacacgatttaaaacctatgcaaggtctctgggatgtggagcaaacaaggtactaggatgactcctagaagcttagagaaagtaatggactacactctgtgaggttgaagtgccagaactactttatcttacagttgtagagggatcaaagggctcacagaagtgggcatgctagagtggatacactaactaggtcagaaaacctaccagaccactatgatccatgagaggaaatttcatttaccaaaggaaaaaggcatatgctggtgagaagggcatgggcattactgagaagctcagtggtggctgtcttctatcagccagggatgagggtaagagatgctgttaataactgggctcactgatagcaatgggactcataggatccctaattaatagagaccaggtggcagtgctgaactgtcagacaccagttggggcaattattataatgagcagcaacatcagagtggcagccaggagagagaacctgtggagagctatagaggtggttagcagaatacagcatgtctaggtacagtaagacatatgtgcagccaacaaaggcacaatgtatacaaccaaaataaaggatggaagatgaggaggctgagggaagtcatccaaataaaatgtttcaatcccttttccagattccaagtctgagccagttttgcagacctcgaaattgctgcttgtaggctagacttttgcctcagaaggaagaaacctgccacaccacagaaagtacacagtaatgattctcccagtccctcccaatcagaccttgccatttacttgggtaattgtacagtgaagtaagagagaaagaaaaacatacttcaagacttgctagacacaaggtccaagctgacatagatacctgggaggccgaaagcagcaacactctcctgcttgggagaggatggtacttattaaatggagtcaagccccaggtgtggctcacggtggattcactgggaccactgggtttgcagactcacttggtctctgaatgaacaattgaaatagacataattagattttgaaaataccccacatgtgttctttggccacgggctaagagctatcatggtgggaaagacaaaaagtcaaagtcactggaacttgcccctcacagtggtcatggatgaattgctattgaaaccaggggagagtaagcaaattattgccactgttaaagacataatagattcaaaattagtgacttgcattatatttccatttaattttccaaacaggtctctagaaaactcagatggatcctgggtttacggcttactgtaactcaattaaaaggaaaccccaggtgcagttgctttgctagataagctattcctgctggaaccagttaatgcttccagtccatggtatgtaataagtgatctagccagggtattctcttccacctcttcagacaggagggcaagaaaccatctgtattcactctgaatggacaacagtatacttttcagttttcatacagcactaccttaactctcctgtcctgaatcaagaattagtctgaaagtatccaaatgcagattctatctgtctacttctcctattctcagagggagaaaacttgcaacaggcagcacaaggagcatctcttagtcattaaacttagtcattaagctatcattttgggctacttgtacctatttccttctgttctcttagttgttcttcccaagagcatcctccaaaacactcctgaatgcgaatcaccgagtctgacagcctgttttctcaggaactgggcttcaccaacttttaacctactgtagtatttaactcattaattgctcttatttttttaattttttttattatactttaagttctagggtacatgtgcacaaaatgcaggtttgttacatatgtatacatgtgccatgttggtgtgctgcacccattaactcgtcatttacattaggtacatctcctaatgctatccctcccccctccccccaccccacaacaggccgcagtgtgtgatgtttccctacctgtgtccaagtgttctcattgttcaattcccacctatgagtgagaacatgcggtgtttggttttctgtctttgcgatagtttgctgagaatgatggtttccagcttcatccatgtctctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagcagcatgttttgtaatcctttgggtatatacccagtaatgggatggctgggtcaaatggtatttctagttctagatccctgaggaatcgccacactgacttccacaatggctgaactagtttacagtcccaccaacagtgtaaaagtgttcctatttttctacatcctctccagcacctgttgtttcctgactttttaatggtcgctattctaactggtgtgagatgatatctcattgtggttttgatttgcatttctctgatggccagtgatggtgagcattttttcctgtgtctgttggctgcataaatgtcttcttttgagaagtgtctgttcatatccttcacccactttttactggggttgtttgtttttttcttgtaaatttgtatgagttctttgtagattctggatattagcactttatcagatgagtagactgcaaaaattttctcccattctgtaggttgcctgttcactctgatggtagttccctttgctgtgcagaagctctttagtttaattagatcccatttgtcaattttggcttttgttgccattgcttttggtgttttagacatgaagtccttgcccatgcctatgtcctgaatggtaatgcctaggtcttcttctggggtttttatggttttaggtctcatatttaagtctttaatccatcttgaattaatttttgtataaggtgtaaggaagggatccagtttcagctttctacatatggctagccagttttcccagcaccatttgttaaatagggtatcctttccccatttcttgtttttgtcaggtttgtcaaagatcagatagttgtagatgtgtggtattatttctgagggctctgttctgttccattggtcgatatctctgttttggtaccagtaccatgctgttttggttactgtagtcttgtagtatagtttgaagtcaggtagtgtgatgcctccagctttgttcttttggcttaggattgactcagcaatgcgagctcttttttggttccatatgaactttaaagtagttttttccaattctgtgaagaaagtcattggtagcttgatggggatggcattgaatctataaattacctctggcagtatggccattttcatgatattgattattcctatccatgagcatggaatgttcttccgtttgtttgtgtccccttttatttcattgagcagtggtttgtagttcttcttgaagaggtccttcacatccattgtaagttggattcctaggtattttattctctttgaagcaattgtgaatgggaggaagtcaaattgtccctgtttgcagatgacatgattgtatatctagaaaaccccatcgtcgcagcccaaaatctccttaagctgataagcaacttcaacaaagtcttaggatacaaaatcaatgtgcaaaaatcacaagcattcttatacaccaataacagacaaacagagagccaaataatgagtgttcttattgtttatcttctctttccttcctgtagaatgtgagatccatgagggtgagaatttttgtttgctttccatctggatgtaacccaacacctacaacagattccaccacattaaacacactcaagaaacatttgactaaatgtatatttcataaaaaagcttaatttattaacattaacttttggatattatgactggtgtcacaactcatgcctccgaaaaccatttgtcttttagagcatcttcctacatgatttaaacctttggaaatctgctctttgaaaactgaaggctttgttttaatcaagtgatcatgtcatttgctattaatttttagttttggctgggtgtggtggctcacgcctgtaatcctagcactttgggaggccaagaggtgtagattgcctgagctcaggagtttgagaccagtctgggcaacgtggtgaaaccccatctctactgaaaatagaaaaattagctcagcgggtggcggacgcctgtaatcccaggtactcgtgagtctgaggctggagaatagcttcaacccagaaggtggaggttgcattgagcagagatcaagtgattgaatgacagagtgaggctctgcttcaaaaaaaaattaatagttttgtaatttttcaaattatctaaacaatacatgtttacttttactcaaagaacatagagacacataatggaaaggtagtcacaacttagagttaaatactattggatgcccattccttaatacttctaagtattatattgatgtattttaaagtttacctgtataaaatattatggactcttgttattaatatctttcccttttgttttgtttggttacttatactacctccagcccaactgctttccccatgaccaagattatattctacttttctccatgcatatgtaatcatttacaaatatgtttataccttttgggttctggcatactttgttttaggtattgtgagggacagaggcaccacccagattgttcctcaatgaagaactaaaagcttgggggtgggggtgctatgagtagatgcctcagttccttcagtgattactagcttcagagaactgcctcacccatggtcacactatttcctgagcagcccacatcaaatgactaatctagttaagagtatgacttactggccatttggacctgatacagggacactctgatggcaattttagctctagacctccccattgggtcagccaagattctcatcaggcttgcttcacaactcaatttcaccctctgcccaattttgctttttctctcccctgtttgtacatgttaattgcaagacacttacagataaatatcttaaacttcatctcagattctgcttcctggaaaatctaacctgtgtaagggatcatactacgtattcatctctgcttcttgcttttctctctcactataatcagactctgacccagacgattgacatagaactaaggctttcttttgaatgactatgtaattttccagcattttcatgcaccacaatttgttcaactttccatactagggaacattctagtagtttccaaattttatttttaaacatacaaaaagttctgaaataaatgtccctgtcacagatcaatttaaactcaaaattacatgattacttacttccaaagttcctgttacttttttttcactagtcagttcttttttttttaaataaagttcacattactccacttattactttatgcactttctgagagttccaatattatcaacacaagccaataatttttaaaatccatggctaatatctatagaattaaagtcttccacaatttttggtcattcctcttttcctaattttgtgaaatatatgaaaaaggtacttatcagtatcctttagctgggataaatcgctcacacaaaggtaacgaggctgcattcaatcctctcaatctaatttacatgcactgaaaaaaatactaaaaactgtaaatttttaaatcacaaacactaggttggaatcctggctatacaaaaaattacatgtgcaatatccaacttactaacactctctcaatttcagttttctcatttgtaaaatgtgaatgccttgccgggttttagtgagaactaaagattttgtaggttcattgcctgggaaagtgctttgcatagagaaggtcgtctataagtcattataattttttttcatattcttggattttcacacacgggtgtgtgtgtgcatgtatgtgtgtatatgtatcaatgctatactcacatttttttctaatagttctttttcttcttaaagaaatccacatttgttctgctttatgaaagtaaagcatactttaggtacttaggttggtgcaaaagtaattgcatttttggaccgtgaaatttaaattcttatgactaggctcaaacacatccttattaatcaaaataaaaactattatgatcacacatttttgccaatgagaaataagtttgcttattcctatagcataaaaatccatgcttcaggatttgacaaactcttggaaagaattttctgcatcctgctggttgtggaagcgttttacctgcaaaaagttgtggagatgcttgaagaagtggtagtctgttgatgagaggtcaggtgaatatgaaggatgagccaaaacttggtagcccaatgcattgaacttttgaagcattggttgtgcgacgtgtggttgggcgttgtcatggagaagaattgggccctttctattgaccaatgccagttgcaggtgtggcagtttttggtgcatctcatagatttgctgagcatagtcctcagatataatggtttcaccaggattcagaaagctgtagcggatcagaccatcagcagactaccagtgaccatgaccttctttttggtgcaagtttggatttgggaagtgctttggagcttcttcccggtccagccacagagctggtcatcactggttgtcatataaaacccacttttcgtcacacgtcacaatcctatcaagacatggtccatcgttgttgcatagaataagggaagacaacacttcaaaatgatgatttttttaaattttcactcagctcatgaagcacccacttattgagctttttcacctttccaatttgcttcaaatgccaagcgaccctggaatggtcgacgtcaagctctttggcaacttcttgtgtggttgtaagaggatcagcttcaataattgctctcagttggcagttgttaacttctgatggctggtcactatgctcctcatcttcaaggctctcgtctcctctgcaaaacttcttgagctaccactgtacatttgttagcagttccttggccaaatgcgttgttgatattgcgagttgtctctgctgctttatgacccatttttaaattgaataagaaaatcactcgaatttgctttttgtctgacaccatttccatagtctaaaataaacataaaataaacagcaagtaataagtcattagcaaaaagacataaagtgagaaatgtgcattaaaatgatgtataacacaaccacacttaagaacttattctaatatcaaaaggcaaatttcaacaatgcaaaaactgcaattacttttgcaccaaccttgtcttatcttttatcttatcttatgtgggctttgtgatacctaattagatgcatttacctccttataaaatttcccaagtcaacagagtatacaatccttcacctacatgaaaaagcagaagtagatagaaaaaccttgtgaacctgataaattaagccagactttcagtttcaaaacagaaagaaacaaaaacaaaagcaaaacaaacaaaaacattacagttttaaggagctaggtcagatctaaattataactgttgcagaaatgtcatgtggagttaagtcatatcatttctcatctccattccctgggcctgaagctggtttcctcaactcctggtacctacaagtcttctttctttctgtggaaagaaccagaagctgctttttgttttcagatgattctgatttaccttatagggaatatgcaacctgttatacagttccagtggttcaaatttttattttccccttgatttcgcgatgtattcttaatttggcaacattttactattcttttttttaacccccttgatctcctagctttctttttggaatatttcttccactctctctagcaactctactaacccaggtatatacaaacattgcttatgatctttcatctcttctctaggtgaacagtgattcaactcatcccagaatctctcacctgttggagattagatccttaaaccatgagttggaaagcagcaaatagagtggaagagcctccaaaagaaaacacaaaaggggcaatgtattatctttcagagaaatcactctaaatttttacccaaagtatgtggcaggagagagtgaacccaagatgggactagcactgagaaaaaaaccaaacctcattttgatgttgccctttgtgaaatcttacagagcagagctgtaccagattttaggtagtatttaaaaagtagcatttcaggatgggctttagaagatctaagtgtaaaaccagatctaagagtaaaacaagggttcacttggaaaattttattagtgtgaactttatgaaatcttttatttagtagtccacaacctggggtgttacctattcctctttggagtatttagaaatacgaagggacattttcgattaccagaatgtctgagtggcactacttgcatattgttggcaatgaccaaaactataagtgtcttgtgggtactcctggaaatccagccaataaagaactgctttacacaaaatgtcattaatactccaagaaacacagtgacatggatataattatactgccaggctaatcataaccacactattttacatgttacctagtataactcagtctataatgcagcagttactcctgcacccatcacctctgattctatgtaaatgaagtctacagttttcaaaatgatctattcagtatcaaggctagaaagtcaaaatggtcccttgcaatgaaaaatcaaaaaaataaaaataaaaatgcctagcagaaagaatctgccatttttactgcctcatcagctgagcatgcttgttttcaacacaatacgtgcaaccgagaaaacaaactagccagactcagagaaccaagccccacctaggccaaaaggtttttaagtattacacagatatatctgtgcatacaaacacacagatagccacatacaacttgttattcaaatcagcaaggactaagacagttacgctatgctgtttatttaaaaaaacttctctgaggagaattcacaggaatgttattgaacatcctcaagatactgatggctaagagatgaattatcattaccacagtgtaaacagaaagactagtgaaaatttcccaagttgctaaaaacttccctttattcagttgaaaatgtttctaattatttgtaaaagtgctaatgtgctctttgatagtgggacagaggtttagacatttatatcctcatgtggagaaagttatacctgactggactaaccgctgcaacataatttttctgattagcattgtgtagaatataacaatctaggcaagcagaatgaccttatcttccttttgatgtgcatattttattaagggtacaaaaatttttccttacaatctttgattcaacagttctcttaaagatttagtttcaagatatttgaaacaagatgatcagtgacaagttaattagaaaatgtccttagtatttgaatagttttcatcaaggaagattttgaagggcaatacttattttgaaaattgtgttaaataaataaaagtgcttcttttgcttctaggatcatattctaacctctatatgctagtttttacatgcaaaaacttctcaaaaattctcccctcccccttttccctctttgcactagcaactgaaggaaaaccctatcatatagaggagattccattcaaaagtacaaactacacagaatttctttaatacagctcaaaatactaaaattagatttacagcatgtaaccccactcttatttttatgctttagatttttagtaatgtttgaattctttttttttactattattattgtactttaagttttagggtacatgtgcacaacgtacaggtttgttacatatgtatacatgtgccatgttggtgtgctgcacccattaactcctcatttacattaggtatatctcctaatgctatccctcccccagacccccaccccacaacagtcctcagtgtgtgatgttccccttcctgtgtccatgtgttctcattgtccaattcccacctatgagtgagaacatgcagtgtttggtttttttgtccttgcaatagtttgctgagaatgatggtttccagcttcatccatgttcctacaaaagacatgaactcatcattttttatggctgcatagtattccatggtgtatatgcgccacattttcttaatccagtctatcattgttggacatttgggttggttccaagtttttgctattgtgaattgtgccacaataaacatacatgtgcaggtgtctttatagcagcatgatttataatcctttgggtatatacccagtaatgagatggctgggtcaaatggtatttctagttctagatccctgaggaattgccacactgacttccacaatggctgaactagtttacagtcccaccaacagtgtaaaagtgttcctatttctccataatctatcccatgcctaaacaaacatctaatatctttggtccagtttgagattcgacttaaaaagaatccagaagacacttttgcagagacacagaaagtaacaaagtacagatgtcatagaaattgtagtccagcagtaccaggggagatgtactggcccaaagactctaatcctctagactacctgtagagcaagatatctttccatttatatcatctccatatggtaactagtactctatgatgcataggtaaaatccgaggttccctagctttggaatattagatactattaaaagagatgagattgggaacattaatgtcacaaactagtttgctcaggagttgggcagacctgctctctaacctaagctgtaccacctgctgagttagtcttctacctcttgatgcctcatcttcctcaatgagattcatcagttgaaaatgatcacttctaacttgaaattctataatgttgaaagtcgttattttcctgaactttctgtagaagttgcaatggaagcctggaaaacaaaacaatagaaaacacttgtagttttaataacctacataaaataaaacattctctatgctacataaatagcatgaaatattttctatgccaaaaattatgagcaaaagtacaagagcaacctcccaaatggaaaaaaaaattataagaaacattccagagcgtaatatcttcatatataaaaaatttacacgaattcaaaagaaacacaccattaaaaaaaaacaggtaaataagacaaaaaagtgatttactaaggtcaaattttaaatcacgaataaacttatgaataaatgcactagactgcctgaaaagcctaccatttttctttcccatactctacttccccatatcttgaaacctttcttttgtaactttaatttcttctcatcacaactggccaccctttcttctgcatacagtccaattcttaattatgtctcttcattctctattgagaaatagaaataatcaggcaaaaattcttcccaaacagcagcaaatctatacatctacttgcatttgttcctgtgttttctatcctcctattacacgagttaaactgtagctattgcaagagccagacaaaccctgtacttgttttctgaatcccacatacccttatcttttcaagggcatctacaagataccccttctcattcctgtgtaatcaagatctttctctccagaattattccaatatcctaaaaaaaaataaataaataaaactcacttatagtatcacatatccaaaaagcaaagaaagtctattgcccaaattttcttgcctttattaaccaccagatgtcatgcacaaatgatctgctctggctgtattccttgctcctcgcttgtttattcttccacttgcagcaagtcagtgtctgaacccacatctccacagaaattgctattgtcaactccactgaccacatgtagttcactattctaataatcacttctctgtctcattttactagctctctcagcagcgttcctctcagtgatgaatcctgaaaaatttctttcttttagatcagggataccccattcatctagtttccaggctgctcactgtctgattaatttcagtctcctgttctggctcctcctttttgaacttgatctaaatatcacagtttctcagagttttgccctagacttctcttctctttttggtctgcttctctagatgatcttacatagtctcattcatggctttgaattttatcaaagtgctgacaactccaaggtctctgaattcatctatctacctgtcaattcatatctttacttttatattccatagaacctcaaaaataaaagattccgtccaaacttcttattttggtgtccctcactgcctgtttcttccatagttttcccatctcagtaaatgatatcatcagccatcagactgttcaagacaaaacctaggaatgagtcatctttgacatctttgcatccataacccccacaggaaatccaaagtgagtcacatgcttttttattcaaaatatttaaaaaatagaagcaccatcatgtctcataaggtgcatagctatagtcttctactttgtctctctactgtcacttgaaccactcttttctactctcaacccaacagccagaaagtataacatttaaaactctcctaagtcctctagttgtacatctaataagatctgaccaccacactaaggcctgcaaggctccatatgacccatccttttctatcatactaactttatgttacagtactttttcctgctaattacactttgtgtttcctaaatatcaactttgttgctttctcaagacctttactcttaagttcatctctgcctgacaggccccccatcatagcatcaaacatgtggttcattctttagactttggatctaagttatttcctcagaaagtatcttctcagactacccatttaaaatgccccgactctcaaatcaagcagttgtttttcaacatttttttcttcattactatctggaatatttgtttacagtgttctttgtttacttgtttgtcatctctcctactagattataagcttctgattggctacatatttactgttttatgtatcactttatattagctaccagataatgcaatacatatttgttgaataaattagtgagttgaaatcacttcagatagcacaggaagaagccaatgcgctaccatttgaaagtctgacataaaaccttaaatgtagcattacaacatcatataactgacttctcccctgagctccacgtacatacaaactgcttcctcagtatttttacttgggaatcttgtagacacaaactccacatattcgacacagaattttttatttaaatccccaccaatacatttagttcctaattccccctctccccaaagatgcttaagataaaacctagaaattaaacacatttttgtatatgtatattatacacacacgcatatgtatatcccattatattaaagttacatatgctggaatatctatttgtgggtctgtatttatatgcagctatctatctgtattttaaataaaatataccgaagtgttcatgatgactttatttccttgggcaatgtgggattcagagtaattttgtatacttcagagtataaaaaatatgtgtttatactgttttttttccctaggattttgtttcgtttctatggtctcttattttttaaaaagtttatttatttatttatttatttacttgatacagggtctctctctgtcccctaggctggagtacagtgcccaatcatagctcaccacagccttgaactcttgggctcaagcgatcctcccacctcagcctcctgagtagctacaactacaggtgtgtgctaccatgcctggctaattgtcttattttacatttttagagacagagtctcactatgttgcctaggctgatcttgaactcctggcttcaagctattctgctgccttcacctcctaaagcactgggattacaggcatgacccactacacctggccatgtgtcattttaatagaaaaaagtaaaaccttaaaaaatggaggattctataaatttatggactatggtactgagaagaggattactaaatttttccagttcaatagtacagatttctatactattatatagatttaactggatccagttaaatctatgatagtacagaaatctagaaaaaatgacaattttgtatgccatattttgggatgtcattgttattgtgtatgtaaaggaaaatgaaaagttaactgtaagctgcaagagcagaattatgattttcctaaaagataaaactctctatgtatatgtgtgtgtatatatatatatatatataatttctaaagtaatattcaaattacttttgtatcattaccaccaaatttgtagaaaacaaaacaaatagagttctaccaggaaattacatcttttaaaactattgattatcattgtaaagacaatacgttagttagtgtagccagcaatcatattatactatttttgcaagatgtggggtaactgccttgaatggtcaggttgctggtgcatttgctggtagcttgatctgcaagtagagaaaaaagtttggattaaatcaattatttttggagaatccctgctttattttcaaatttattaagatatatttttagaatatatcctacactttgttagggatagtatttccttttctcttttcttcaacttttattttaagttcaggggtacatgtgccatggtagtttgccacacagatcatcccatcccctaggtattaagcccagcatccatttgctattcttcctgatgctctcccccatcctgtctctgacaaaccctagtgtgcgttcttcccccatgtttccatgtgttctcatcattcagcaaccacttctaagtgagaatatgccgtgtttggtttttctgttcctgtgttagtttcctaagtataatggcttccaactccatccgtgtccctgcaacggacatgatcttgctttttatgcctgcgtagtattccatggtgtttatgtaccacattttctttatctagttcatcattgatgggcatttaggttgattccatgtctttgctatcatggctggtgcttcaatgaacatacgcgtgcatgtatcttcataacagaatgatttctattcctttgggtatatactcagtaatgggattgctaagtcaaatagtatttctgcctctaggtcactgaggaattgccacactgtctttcacaaaggttgaactaatttacactccgaccaatagtgtaagtgttcctttaactccacaacctcgccagcatctgtttttgtttgtttgtttgttttttgaccttttaataattgccattctgactggcatgagatggtatctcattgacggatagtatttctatgtgataagcatcacattgcttgttaagagtgatcatatggatatatgtaacacttcaagttggtggagactaccatttctagggagaagaagcagaaaataaagtaaagagcattgtataaagaatcacatgtgctgcgatgaggattttggatattactcacaagtccagtggttttcaacctgtgctcccatgagcaattaggtgtctctcagggggaacatcactttaaagcagctcaaaatagactaagcacttggtccttgtcagttctggtcctctgagaatcaaatttcaagacaagtttagacataaaggatgttcttggggagctatgaaggatgaagggaaggcagcaggagcaggcaggtggagatatttagaccacaatgctggtttgtgaaaagagagaggaaagaagaattgaataggaagagccaaactgcaaaactgcaagaaagtcttacctcacccatgaagtgtctcttagccaaagttgccaaagagagagactgcattttcacgaatgggacagcactagtatgcacgctgtgcttactcactggctgtaactagactggtagaaagatggcctcggtacaaatatggtggatctgcagtcaaccatgcttctccaacaggttttctagaaggagatccaagcagtacccactccatggccgccaattctcaccatgcccatttcacaagagctgctacatttttgtttggtttataattatgttttgactaagattacatttaacccaaaggctccattttcattcatcaacaaatgtttatcaaaatgtactgcacattggtattaactaatatcttagctatattacaaagatactgcatcaaaaataaacaagaaattcagcagcttgaaatattaattattatcccagtcacaagttggctgggactgttctgcttcattatgcacacctacagaatcactggaataaattggttccatcattccagtgatggaatgatgaatgggcatcagtttcccagtagaaactctagacagagggagggtaagaacaccagaggggagggtagagcacatagaacctcttatgactgggtttggtgctgtattcctgtcattctgcccacattgcattggccaaagcaagtcatgcggccaaggccaacatcaatgtgttaggaaagcatattgcctctaaaggagggaatataaaaccacttggtaaatggatacagcaaggagcaaagaattgaaaacagaaatgcagtctaccacagttaggcggttcaaaggattgaacaagaaagacaaggtttttgctccttatagaaatcagtctagtagggagattaaaactataagtagagtggtgtgggcttatagcacatattagatttgagaattataaggactctgtagaaacctaaagctacttttgaagatgagttctaaaagagacaataaaaataaagaaagaaaagatccaaggacagaatcacggatttaagagatggtaaagaattaggatctcctgaaagagatggtaaggaaagggccagatagataaaaataaaaccataaacatgaaagaaataattgaaatcaagaaagaagtgattttccaaaagtcgagtaatataccaaaatcctccaaacagttcaagaagattgtgggctgtcaagggtccacctgatgtggctattaagaagttgttagtgatgtcgatgataacatcaatggagtgatgggactagaaactagactgaagttggttgagaaaaatagaaacagtgaatatggtctcctaagttcataaacttagttacagagggaatgaaagtgaccagaaagttgaaaaggcttaaatagattagtatagaggaagggatataaggtaaaacataagatcctctatgaacaaaccattttttttccctcaatttttatatcctgtttgttctccccttcaaactgcttaatcacttagagttcctcaaatacgccatacagttatacttggacaagctattttctgtgtttttccctgcttgaagggacttttcgcagtaaggtatgttcttgttttcctacatatctttacaggaacaagtacaaatatttatgaatacctactatgcactaaccactgtgttagagacataaaaacaattgtcttaatgaaccatcacataaactctgtattgtaggcataattatccccattttagaggtaaaaaactggacttggaaagatataatgacttgtccagatacacatctcgtacctggtgggttagaaatttgaatgtattactctctccaaagtttgtgttctagtctcaatttcattaaacatataccactttgtaaaagatctcctgtctgagggtgtgatccctcctataagcagtggggcagatggaggaggttttgcattaaaattgattagtgttgatcttgccatcctttgaaacacagacatatctcgcatatgtcaactacagcacttattacactgttttgtaacattaaaaagtatatgaagtactcttgccggcaataaagaggcatataagtattgaagtaggggtgagaaagcaaaagcacttgtgttaatggggagggtgcattcgaaaggaagagactagaagcagagagataactaataatttataaatccaaatgagataaatgagggcctacctaaagctgtcatagagagcccggaaacaagaggaaataatcgaaggaggtttaagaaacagaatcactaggacttggccagttggctgggaggagagtgatgacacacagttttctagctgaatggattgaatggattgatgtatctcaatgaaaatggaaatatgggagagagaacagatttgagaaggaagtgtggagccaactatgaaatatgtgtgagatatggaggagggggaaagagaccacaacaaagagatcctgagtcagtatatttacaaccaagtctgagaagttttttatccaatactcatttaatctacaaaggacttttagttcctaactgttatctgtggattttgactcagaagaagctggcaaccaaataaatttatatataagatttatcaaaagaacactatttctcaaggtttccatggcaaaattaagatatattcttcaaaaatatttcattttagttagaaaataaactttttaatttctattgtattttagttttgtgttgctgaaatgttatatatttaatgctcaccagcatcacctctacccaatggtttcatggttcttcgataataatgacataacaatctgggtgttgctttctggattcctttcgcatctaaaaactaggacagccctttaggattgactacaagcctcagggaacacacaattgccatttggtaaaggacagagcatagcataattctagatgacattgtgccagaatttgagcagtgaaatgatgtcacattccacacagtcatatttatcactttccctcttggtactgacattgtttgtaactttgaaatattttgtgctatgttgaagtttaaaataaaaagacaggtcatactaatgagtttgcaatctacctctattttttttgttgttgttgttaaatactgtcatgacacaaaacactgaagccattctctattaaagattctgtattcatcaccatatatattattagatctttagggaagttaattgaagtggtgaaaatgtattgaggagatttataaaaagtgaaattgtccctgccaaagtttcagcaggaagagtttggtcattagtgctctctagtggagcagggattttgtgcttaacttttcagacatgtttcagaaagctgtttttccagcaaatctcttctactgctcagcatggcctgaagctcagggtctttatatgctgtactgaacgtggggtcataaggtgttggcaatgagtttttgagcattctggactttaaagctgccactctatttatcctatctgttttggaagtgagtgatgtttcatcctgttactttgttgaggaccatgaatatgcacatttatctttcatgctctaggaaatactgggacaagataacttcagcaccagacctaattgttgtagcatactgcatgcttttattttattactcataagttataggtaattattattctaaatttattaaattttaaacatttattactcaaattaaaaataagcaaaaattatagcagggaagaataacttctgagtccaaagcaaattactttgataaaactatgtttcttagattaatctgagtctgaactgagaaaaaaaattgtaaatcctttctggcaaatgaacacagggaaaactatctggaagaatactgctggtactaatttaacaaagcactcagatttttccaagttgactttaattggagtactgcataatttagcacattagtgaaaaacttaaatgaatgatgtggaaacaaatgtttaaaggtgccttttgaaaaaaatttaatgtggaagaatcctggcagggtaacttatattttggatactttaggtcatttgcacattataaaactaagtggcgaatttgcatttgtaaaacaaattttggtgcttaaatttccaaatcagtagtttttttttctctctctccctccctacacacacacacacacacacacacacttttgaactagttcagagtttcttacactcttattcattacatttatttcctataattctattgctttagagcttccattaatagttcttacctcatcatgcatcagtgcaacagtgcagcttcacttcttttttcaccagtgcttttcttcccatcactaagacgctactttagtctttgcttttaggcaaagaaatttattctatagaacaaaatttgtcaaatagaaagcaatggtgtgcagtgaatttgaaagacaagacagaggtttagtaagaataaaaaaaaagttgatggttggatggctaagataaagaggaagaggtggaggtgaggcttgagttggacctttcaaaagacaggagccagcacagggcaaaggagggcaagggaatggaatgtagcctgaatgcaggggagcaggcgagagctgtttcaaggaataccgcataccaaagaaatatatcactttaaaaaattactttccctctacatcagctgacagagaccaagcatcctggaccttgggcctctggtgatttctatttttcaacaaccctcatgtcaaagtatttctgctgtctgaatagcaatctccatataaaggccagcttcactatataaatagcatgcaagaacagttcttatggtgttgtattttatactggcagtatggttaggctactttgccaactaccatggttttattttatcaacacagtctatacctctactcaaaatattcctttctattgtttctatgatttttcattccatgtaattcaccctacccacatctgcaattctataaataattacctagaggaacatggttcagatcaaccctcagatcacactaaagactatgaaagccgtgattaataggagttgaacccctggagaccttttcttagtgagaaattttcttgtgtctcctctagcttactcagccatattaaaaactctggtgacagaaaattattaattctgtggctttcacctacaactcctagcatctgaaaagacttgctcagtgctctaagcaggaccaggaaggatcctgactccatagggaactctttgcccaacacctatgagcaccaaacatttccatggatagagtgtcctgaatgaaaaatgtttttcatcctttccaaaaagaatttgacaaagtttcataaacgccagaagtatgatttatggcagctaatgctgggacagattcctctagagcctagtgaaatagggggtgcacttatctaacatatgggcgtgagacctggctgcagtgctaggcaccatctctgactcagtgtttacctccagcactgctttctaatgaccaagggagagagaagtaagtcttagaagcagagttgcacctttaaaaatccgtatgtggtgccttttaaaaaaaagttctatatagtgtggaacatcaaaaatgtgctagggtgagaagaatgatatgtagaacctagcttctaataattactttttcttcatccactgatctcgctttctcgcttccctcttatattaagtggtatggggaaattgcttgaaaaggatccttgcagcctcttctttctgcctactctttagtctccttctgtttcatgaattgagctcttttgtccatggcttatctgaatattatgttgcatgtcccagatttctgcttctgtcctattcctatatcatggaatatttaagagtccaaacatggaatttttgtagagagtctctggcaatttaaaatagattgtttggaaagataaatgatggcaagcacgattgaataaaataatacatgttaactattaaagtatataattggatgataaaaactgtagtttcttatgttattaaaaatgcactggtgaattttttggtgttatgaagattgtatgtttttttccacattgaaagcaggaataaaaatatgtgtaattatggcataagtacaaacagaattgttaaagtagtagctataatgggcatggtggtacatgcctgtaatcccagatactcaggaggctgaagaaagagaatcacttgagcctgggaggcagaggctgcagtgagatgagatcacaccactgcagtccagcctgggtgacagaatgagactctgtctcaaaaaaaaagtagcaatttagtatgtcatcagaagtttgataacaaacaagcatattattatttttattaatatatcagatattctgctcttggtgaagccgaagccatcttgaccaaaaaagtaaacaaagctggaggaatcacactaccagatttcaaaatatgttacaaatttatagtaatctaaacaacatggcagtggcttaaaagcagtcacatcgacaagagcaataggatagaaagcccataaataaacacatctatggtcaattgatttttgaaaaaggggccaagaacacacaatggggaaaggacagttccttcaataaatgctattggaaaactagatattcacatgcagcataaaaagaatatttacaattctgtcttctagctattaatatacagtacattattattagctatagttaaactactgcctaatagaacacaataacttattcatcctaactgtagctttgtacctgctgactaacctctcccaatccctccatctcttctacactctccagcctctggtaactactattctactctctacttcaatgagataaacttttttagattccacacgagtgagataatgcagtattggtcctgtgcttggcttatttcacttaatatagtgtcctctacatccatccagattgtcacaaataacaggattccattcttttaatggttaaatagtattctattgggtatatataccacattttaaaattcattcatctgctgatggacacttaggttgatactatgtcttggctattgtgaatagtgctgcaatgaacatgggctgcatatatctcttagacataattgatttcattttctttggatatattcccagtagtgggattgttggatcatatagtagttctatttttaattttttaaggaacatccatactgttgttcataatggctctaccaatttacatttccacaaacagtttatatgagctctcctttcttcacattcttgccaacatttgtaatttttttgtctttctgacaatagccattctaactggggtgaagtgatatctcattgtggtttttaaatttctatttccctgatacttagtgatattggcatttttcatatatttattgatcacttgtatgtctatttttgagaaatgtctattcaaatcttttgctcattttaaaattggcttatttgttattttttgcccattttaaaactggcttatggaatactttcttccattatgtaggttgtcttttcactctattaattgtttgctgagcagaagctttctagtttgctatagttacatgtgtctatttttgcttttattgtttgtgcttttaaggtcttatccaaaaaattattgcccagtacattttcgtgaagcatttccctaatgttttcttctaatagttttatagtttcaggtcttacattgaatttcttaatccatttagagttgattttttaatatggtgagagattagtctagttttatttttctgcatgtggaaataaagctttcctagcatcaatattcctttccccaatatgtgttagtggtgcctttgtcaaaaaacagtaggctataaatgcttggatttatttattggttctctattctgttccactggcctgtgtgtctgtttttatgccagtatcatgctgttttggttattatagctttgtatcatattttaaagtcagatagtgtgatgcctccagcttttttcttttgttcaagattgctttgactgtctgggaacttttatatttctatacaaaatttaagattgtttcatctatttctgtgaagaatttcaagtgctgtttgataaaaattatgttgaatcaacagattgctttgggttatatggacattttaacaatattaattattctagtccatgaacatgggatacattttcatttctttgtatacttgtcaatttcattcatcaattttttttggacttttcactgtaaagatctttcacctccttatttaagtatattcctaggtatcttttttttttcttttttcttttttcttttttttttttttttttgagacggagtcttgctctgtcactcagggtagagtgcagtggcgtgatctcagctcactgcaacctccacctcccgggttcaagcgattctcctgcctcagcctcccgagtagctgggactacaggtgcccaccaccacaccgggctaatttttgtatttttagtagagatgggtttcgccatgttggtcaatctggtcttgaactcctgacctcaggtgatccacccaccttggcctcccaaagcactgggattacatctattttttttttttggtagctattataaatgcaactgcgtttctgatttgttttttcaggaagtttgctattgtcatttataaatcctacttatttttggatgtttattttgtattctgcaactttactaaatttattttttagtttttaaagttttcccactaaagcctctttttaaaaatagcatttctaatgcatgcatgattctccatgccatggatacagaaaatttgtctgttttatttcctctatttttgtaaaattaggtttcccccgtaccaatttttgcacttaggaaaattactattataaaattatatacataaacaattctatgtatttacaactaccactttaaaaaaatccatatgactaccagaacttaaattactggaccaaaaagctagaagctttcttttaaaatttagtacatatttttaaattgctttggggaaaatacgagtttccagcttatacagccctagttttaaaattgttatgttaaatttaaaattcaatgttattatatttattagtttattttaacatctaattattgagtttaatacaatttaacattaacttttaaatttattattatttcattgttaatttgaaagatcttaatgtgtcaatttgtatttcttaaattaatagaaattagcatcttctctaaatttataagctttttatgatcttcatgtcttatctgttcagtcactttataatttcatggtaccaacattaattccttgcagctctccttgtgccaagtaacatttactctgtcattttttgctttattatttgtataaatttatggggtacaagtgtaattttattatatggatgtagagtatagggatgaagttaaggcttttagtgtatccatcatcagaataatgcacatgtgcttgttttaaaattgcatttgtaatatttaggccttctaagttttaaatttttatgtgatctaatctacctgttgtctttgtgattttcccttcattgcctataaattcaataattttgagtttagaaaattattgcctagacccagagtcaaaacatatgcatttctattttcttatggtttttcaaaactttgattaagaaaaaaaaagtttaactatttaaagctaaaacttattatggtatgaaatataatttctaaagtactttttatataccccatttattcattcattttataaataattatttagtgttatactctacattaagctgttaggaagtcagtgaacaaagcagaaaaagtggccttaagaacttaaattctagctagagggagacagagatgctgttaggtagatagatgtaaacacacacactgcaccacccctccacccacacacacgtttctttttatatatgtgtgtgtgtgtgtgtgtgtgtgtgtgtgtgtgtgtgtgtgtatattctcaatgaagtaggaagcaaaatcaactactactagatgggagaggagaaggtataaattgtcatgtaggagggtggcagaatagaggtactaggaaaatacagtatgatttcctggcagcctggagttcccacttgaacttagtgatcattaattattcagcatgattgtatatttttctccagctccattcagctgcaaagctttaagtatgaagtgggcagagagttgaatttactcaggtttgtgtattttccaagtgagcatcagtaagccagagagaagcgagggagtagagggtgtatatacaagggaatgattatgatgatggaccatggaattaaagatggtaacaaagagtgtgaaagtatcaaaggggtaagggacaattaagtgtataggaataatccattggtgtaagtgaagaattattggagtaggagtactagaagaatttagctgaaaagttgggacattgaggttatcatggggttgcagtttttcgtaatgacaagacactggcatgcttctgagagtgaatacctccttaaacttcatacttgcctcttcctagttctaaccccactgtctacatgaatattgaaatggtccaagataagaaggcagtattatcggatagaataacaacgaactaggagataaacttgttgaaatatgagaaagaatgtcttggagaacagcagatgacagaaaaatgagagaaagaagatgatattctgtgatgaaatgagactctttaggaaggagaaagggaaatttgccggcaagcagcaatgatcacaaactccacccccaggctcagtggaataatccccaataaaggaagcacaaaccacagaaaacagaaaagtagtaatgatgctaaatgttcatgagactggaacctggcccttgagctcccataactccatctgtctcagcctgatctctttttgtctcagcaatctgctgcctgctctagatttcccagtttggcaaaccaaccgttcagtttctctggctctttactgtttctcttcatcccccatatgatggcttaattttccctctggcctagcacttgttttggaaaatgcttctggtaactgacctctttgtcttgactaagagatttgtttcttgtgcatggctcggtagttagtccagtaaggtgtgtacaggaatcatggaacatacattctaccttatttgactaaacacttatagcaagaaagcacactaatgggctgattaaaaaaaaactgatcttgatttcaatcacagtagaaagttatataacttgatctctactgcccatttcattttcatggaaatttatagtgagattgaaagtagcaaaaaactaaatttctataccaaattctcagaaataaaaatcaccaagggcactgattctcaatcgttctcttttttttttttttaattacactttaagttttgggatacatgtgcagaacatgcaggtttattacataggtatacacgtgccatggtggtttgcctcacccatcaacctatcatctacattagatatttcttctaatgctatccttcccctatcccccaaccctccaacaggccccggtatgtgatgttcccctccctgtgtctctgtgttctcactgttaaactcccacttatgagtgagaatatgcagtgtttggttttctattcctgtgttagtttgctgagaatgatggtttccagcttgatccatgtccctgcaaatgacataaactcatccctttttatggctgcatagtattccatggtgtgtatgtgctacattttctttagccagtctatcattgatgggcatttcagctggttccaagtttttactattgtgaatagtgctgcaataaacatacatgagcacctgtcattatagtagaatgagttataatcctttgggtatatgcccagtaatgggattgctgggtcaaatggtattactggttctagatcctttaggaattgccacactgtcttccacaatggttgaactaatttacactcccaccaacagtgtaaaagcattcctatttctccacatcctctccagcatctgtttcctgactttttaatgattgccattctaactggtgtgagatgatatctcattgtggttttgatttgcatttctctaatgaccagtgatgatgggctttttttcctatgtatgttggccacataaatgtcttcttttgagaagtatctgtttatatcctttgcccactttttcatgttttttttttttttttttgtaaatttgtttaagttctttgtagattctggatattagccctttgtcagatgggaagattgcaaaaattttctcccattctgtaggttgcctgatcattctaatgatagtttcttttgctgtgcagaagctctttagtttaattagatcccatttatcaattttggcttttgtggccattgcttttggtgttttagtcaggaagtctttgccgatgcctatgtcctgaatggtgttgcctaaattttcttctagagtatttatggttttaggtcttaagtttaagtctttattcatcttgagttaatttttgtatgaggtgtaaggaaagggtacagtttcagttttctgcatatagctagccagctttcccaacaccatttattaaatagggaatcctttccccattgcttgtttttgtcaggtttgcaaagatcagatggttgtagatgtgtggtgttatttctgaggcctctgttttgtcccattgatctatatatctgttttggtaccagtaccatgctgatttggttatggtagctttgtagtatagtttaaagtcaggtagtgtgatgcctccagctttgttctttttgcttaggcttgtcttgcctatacgggctctttttttggttcatatgaaatttaaaatagttttttcctaattctgtgaagaaagtcaatggtagcttgatggggataccattgaatctataaattactttgggcagtatggccattttcacgatattgactcttcccatccatgagcatgggatgtttttccatttgtttgtgtcctctttcatttccttgagtgatggtttgtagttctccttgaagaggtccttcacatccctcataagttgtattcctaggtattttattctagcaattgtgaatgggacttcactcatgatttggctctctgtctgttactggtgtataggaatgcttgtgatttttgacattgattttgtatcctgagaatttgctgaagttgcctatcagcttaaggagttttggggctgagatagtggggttttctaaatatagaatcatgtcatctgcaaacagagacaatttgacttcctctcttcctatttgaatgcactttatttctttctctttcctgatttccctggtcagaatttccaatactatgttgaataggagtgatgacagagggcatacttgtcttgtgccagttttcaaagggaatgcttccagcttttgtccattcagtatgatattggctgtgggcttgtcataaatagctcttattattttaagctatgttccatcaatacatagtttattgagttttctttttagcagaaaggggtgttgaattttatcaaaggccttttctgcaactattgagataatcatgtggtttttttcattggtactgttcatgtgatggactacgtttattaatttgcatatgttgtactagccttgcatcccgggtatgaagccatctttatcgtggtggataagctttttgatttgctgctggattcagtttgccaatgcaaaaggctgaaaattccaaacaccagaatgcctcttctcctccaaggatcaccactcctctccagcaagggaacaaaacaggacaacgaatgagtttgattaattgacaaaagtaggcttcagaaagtgggtaataacaaattcctcctagctaaaggagcatgttctaacccaatgcaaggaagctaagaaccttgataaaaggttacaggatctgctaactagaggaaccagttgagagaacataaatgatgtgatggggagaatggaaccaagatggaaaacactcttcaggatattatccaggagaacttccctaatctagcaagacaggccaacattcaacttcaggaaatacagagaaaacgccacaaagatacttctcgagaagagcaaccccaaaacacataaccatcagattcaccaaggttgaactaaaggaaaaaatgttaagtgcagccagagagaaaggtcaggttgcccacaaagggaagcccatcagactaacagtggatctctctgaagaaaccctacaagccagaagagaattggggccaatattcaacattcttaaagaaaagaattttcaacccagaatttcatatccagccaaactaagcttcataagtgtggaaggagaaataaaatcctttagagacaagcaaatgctgagagattttatcaccaccaggcctgccttacaagagctcctgaagtaagcactaaatatggaaaggaaaaaccggtactagccactgccaaaacataccgaattgtaaagaccattgacactatgaagaaactgcaccaactaatgggcaaaataaccagctagcatcataaggacaggatccaattcacacataattatattaatcttaaatgtaaatgggctaaataccctattaaaaagacacagactggcaaattggataaggagtcaagacccatcggtgtgctgtattctggagacccatctcacttgcaaagacacacataggctcaaaataaagggatggaggaatatttaccaagaaaatggaaagcaaaaaaaagcaggggttgcaatcctagtctctgataaaacagactttaaaccaactaagataaaaaaagaccaagaagggcattacataatggtaaagggatcaacgcaacatgaagagctaactatcctaaacatatatgcactcaattgttctctttaaagattactgctgaaattatacctcttcaacctccagccaaagaaaggattcaaaattccatttgttgttaaatagatatttatttatataaatttacatatttttataaataatatttcaatatctggttaatgtggttccagttttttaaaatcacttgacactttgaaatgtctgacactgtatatcactaaggtatataatttacagtctgttataatgatgttcttttaactgttggatctttgataagaaatatttcttctttgtcatatacattgcaatgtatagtttctttttagaattaggaatttgatcaattgtttgttcacttcagtaaaaatatgactttcacagtagaatgtcaacccacctccacttactcaacccactggtaatcaagattccattcctctaaaacacattaaataatgctgtcacccagtattgtcagctggctagtcacccttctgtagtcttcagtctatagcctgtgctcactggttaaattataggtttaccaagaagcagttggatttgccctcaaagttgtttcattcacttcacttgttgtcattttaaatttaaataaatattctataaattattaagtatgcatgaaagaaaaaagaaaacaaatttgtttctaggaaaattaaactgaatgctcggaaatgtcttgataaagttaaatcataaatcgaagttgaattaggtgcagaaaaaaatctaaaaatttaagaaatgtttttttcttctaagggctttaaattttaactccacttttacagaattcactattgaaaattgtaactgatgtattgtgattgtaatttattcaaaaaggagagcaagtaactaagtaaaaggccttgcctatgagaatttgatgaagaaatgtgcctttatattctttcagttaaaataacctttaaaaatatgttatattttatgattccctttaaatctatattttagattaacagattaacaaaagtttgtaatcttggatagaatggcactaccgtataattaaatgctgattcatctgactccaaatcctttgctttttaccactatagtaacattcaattcttgcctaatttttcataccttaaaacaaacaaacaaaggacaacaacaacaaaaacctttttttttatattaccttctagacaaaccctaatttttcttcttttcaaagttaagttcctcaaaataatctactatgatttcttcctccattcactctataagttgcagcagccaaagttctgacaaataagtaactctggccaaggcctggaactgctgttgaaaagtccacccatgagcctttcaattagacttttctaatgggttctattcatccccatcttgttcgatttcagtagtattttagatggttggctgttttcttcctcttcaaaatgtctcctttcttggtaattccttctacagcactgcgtttttttgtttttttttgttttcctcagtctcttgcaggacttctcttcgtatttacttatttgtctcaggatttgtcaatggctcttttatgtccctttctttcattcatttttctgattataaaagtaaaatatggccattatagaatattagaaattaaatattatcttgaaatcaacacaaaacttaaaattatgtataatcatgccacctatcaattactactgtcacatactgattattttctctgcctttttatgcctaacagtgcttaacagaaaggaaatgatactcatatttagttttgttttctacttttttcactaaatattattttataaaatttccaacattattaaatatttcttgaaaatgtgatttttatagctgaataacattttataaatttgtgatggtttaagcattctgccttccttactgacatttaacttgcttccatatgtatttatttttaactcaaaataaaaattttacttttttaacagtagagtttaattcacatttattgtcataaccaatgtaacttccttctcttttcaataaaggtaagagagtgttttttccaaacacacaccagagaatgtatttctgtttttcttctcacaaatagttaactcttggcttggcacggaattcttaagtcatatttttgccctatgaaaacttgatatttcagattatgttctgaaatttagcattgtgaagcagaaatatctagtcaccatgtttttatttatacaggaatattttttcttcccatctgtttgcttataaaaacttttattcacctatgaacttaacaatatttactaggctatgtctggattgattatccaaaattaaccctggtagagtaacttcatcaagagccaacagtgaagagtcatcagcattgacatctttttctaaagtcataaaaccaggatgttcttaatgcagaactggctgactaccaaataacagtattattaaatatatagatgctgacaagcattcttcagatttatgtagcaatttatacttacagagaacttgacaaatatgaagatacatacataattcaactctgacccaagaattatttatttgttcatttttatgtttcctagttataatatgtttatatataacttaatgatttacaggaacctgcaagaacatcatttaatttgattctcatcacaactatgagagggaagtttggctattgcttccctattttatggataagagaaatgatccccaaagcaattcagttactttcccaactttgtccaactactaagtcttggagtaagatttgcaaccaggtattttgtttccaaacagtttgttattcccattattttggatttttttacataatttatataattatgagcccaaaagacagaaaaggagcccctgtggactgtagcaagaatgggtgtgattctcagtatgtgctgataggtttcatactatccacctggaatctcaccacactggcatgattatacaggcccttaaagaacttatttttcttcagaaagcccatataaaacacagattttcaataaaattacaactaatttttttaagggagcatttgttagtaggcgaaaagaataacaactagtgcaagaaatgtatgttgaccaaaaaaaaaacaaaacaaaaaaaaaggaaggaggtaattgttgaaagagaataggcccatatatatatttttttctatttcattagatacctcttgtattacttctacttgaagattctgtaatactttaaatatgttataattcacatgctttgaattgtcacctgatataaagtagtttcttcataatttaaatacaaaatattttaaatttgataggcactacactataaatcccccaaatatatatatttttaggagattttcatattaaatactttatagcattgctaaaaattagaacattttctatatatatatggtgtacacatttttaaggtaataaaaattaggacacattatattgtaacaagtgtgtaagttttgtaccacatgaaagttgatacacttgccatttgattactacaatatacccattatgactaaatagtattgcagtaaaagggttctttactttcagggtattttacttgcactttttgcatttacttgtgttggttttttaagctccattttccacagactcatgctaaaggggccaggtgacaacctcacactcaatgcattacattacaaaagaagaactctgaacttatgaatcctctcttatggacagatgtgatgcctcccctttgctctggaggaaaacactatctctatcttccaaggatatttgctatataataatctttaaaagacagctgagaacaaaggaaagttagtacttcactcttaagatgtgcagaaacacaaggtacccatgaaaaattgtctcccccaaatcatttgaaatacagttagaactttgtgataatttctgactatataagataaatactgaactacatattcatattagcattgttgagatatatgaccttgcctttcttttacagctttaatagtttatgtctggtaacaatgtctgtgtggttcaagattaggaatctattcttcagcttctcaaatatacaaagtaaatagctatatgatgcctgaattagttttgaacattattaaagctaacttatatcttttttttatcttgccactgactggcatttatctcaatcagaatgcaaaaaaacacaagacataagaaaacattgcttgggaaaattagtattatgttcactaaatgtatatttaaacattttttgaaattatcttattctcatcattatatgaaaacttacataaaattatggtatgataacttatgaaaatcatggaaaatattgtttgttaagcaaaattcaaattcacatgtattaaaatatttgtaactgatatgcacatatatacatatatcgatatactagatattattgagaatgtttacattttccaaaaagagaaatcactccagtgttccactataaaactaatgcagctcatcaatatattttatatagagtatatattaaaaagtaaatatatatctacttgtatagtgtacatatatactatgcatatacatgtatagtatatatgtataatatatacagtatatattataagtgtacattggacatgcatatatgtacatgtgtacacttgtaatatatactgtatgtaatatgaagtttctaatacatactgtatatattacacatatatactacatgtgcatatataatatacacagtatatgatcatatatattaagtaacatatacactataatacacagattatatatattttaatatggacaacttatttttaatattatcttagattctcatattttggtaatacatatgattatctagcatataattaattaaattcctgcttttcattctagttttagaagttcttaaatatatttttgctcctttaaaatgaaaacaattgggaggggttggggagaaacagaggtgaaagaggctggaaaatacttcttcaaaaataaataaatctatccactattcaagaatgagtcaaacattcattatcactcaaacaactgccaagcaattgaaatccttctaattgcaagtaccctaaacgtagcttattgccttcctttcctgtttcctgacttctctgggtcgtttcattcgcacctttcttttaagccatctgggatcctctgtacaaccgagctttaatgctggacacctggtctgacaatgtttgcttctctctttcacctgccagccctttgttcctccccaagattgaatgagccctactagtcctgtcaagcatgcacacatagcagcttttctttcattcaatcttagactagtccttaagtttggtaaatcctttcattactttgccttacccatttagctgttccatctatttcgtgatctctagaatcttataatccacatgagaattatatctagataaatgtgatacctctagaacaccagggtggaaggaaggaaaggcatgactgaaaataaaaatcatataaaactccctgttcttgctagaaaatagttataaatcattggggtttgtgctcaaatttaaaaatgcaaaatatacaggatttgatatgtgtaatcagtacttaggaaaatatcatatagctctttcacaaagcaggtaagccctacttaccactcaagacataatttttcactctttgtctagtacctcccaggatttgtatcccagctctttagctcctcctacacacaaagctccttttacacttccaaaaataatttctgatctgacatcccagtgatattgagtctatacctcaacttccatctgtttcccactctcaatttctatagactgtacaagtaagaatatggtacttggcttagcattcattccttttaattattcagaagtctttccaaactttagcctttttcaagttccttctttcagtcaatacagacaactttcctagtttaactcaaacacaattatacttctcagaggcttctgttaaaatgatgtcactccagtgctcaataaaacaaatccagaaaaatatttgtcattctaattgtatgaaaaaagaaaataaaaataattataacaaaaattctgtaagcactactgagttttataaaaagaagcaaataagttggaaggtcaaggaatcttatggcaagtctttagtcaaattagatatttcaatagaacactatgaagaagccagctttgggaatgaggtaaggggagtaattgtaaactttattgaaataatgaggataagggtcctgttattgacggcctcagaactgataagttgcaactaggttttgataacttgcacttgataagccagttccagaaaaatattttcacagtgagtacagggctcaagagaacactgatttagtcaggtaaccgtggagaaattgtaaacactgattctctcctacctcctcctgctctgtagaactgctcccaggttcttgcctgctgttcctcctcctgttccatgtcccattgcctgtgagaaatatcacccattttcacaattaagtaaagaatcagaattaattaatctcttaatgatacagtctgagaactcaagtgattttttaaaagttacaagagagagaagaggaaaattctaatccgagaaaaaaagagaaaaatttccaaatgtaatatctacatatactgtcatttatctgctgcagcatagaggaaggactatcagtggtgaaggtgaattctaattcacaggaaaatatactgggaatggtgtgacaagcaaaacttgcagcctcatctataactgtctggtatatcaagtaaacttagttaacttgagattttaaactaagaaactaaatgagccctcccaacagaactgaacttttgtgaggccatatgtgaaaagtggaagtaaaatgattcttggtttaaaagataaagataggggggaaaaaaaagcatagtagcacagaatgccatggagctccataactgtggagaagcccacggggagggggaatttaaatgaaggacaaaggagacatagatataaatgtactataggtcacccagttagactgagaaaatttcagagagcaaaaaaaaagtgttgaaataagacatgcaaagatgttttaactagtgatagggaacctctgggaagagaattgcagtggtatgtttcaaggatccttttattgtctccatcttgatggacatgtttaccagtgacttggatgaggccatggatgcaagttgatatatctgcactaagaacaaggtagacagaaattctaataactggtttagattttccagttcttcaactggtccctcatttttctttcactattgcccttgatctttcctacactgactcttcctttcccttcccatacaatcattcctaacaatgttgctatatccatgactatgtttcctaaattatattcacatcttggacctctgaaaattgactaccacccccaccatcccaccagagctatccttgctaatgtccttatttaggaaggtgtcttagttgtcaagttcgatggacttcttgtgtcatacctcatcctattagcctctctggtattcacctcctttgacaaattcatccttattacattctctgtcatctcctttgtgtccttcctctttaattcctttaaaacattggaattccttatagttccttttgtcttcttactctctgctgccttttagagcaatctcacatactttcatgactaaaacaaacaatggatgcagtcctttaaccccatgttccagaccaaatatctcctctatgtgacattcaacaaaacgaattcgacaaaactaccattgctttctacgcctaatctacccttgtcctccagaaggcatgagctcaaaaaatagaagcagaaaacatgagtcatctatactagattataaattccttcccaacctcatgctctatgttcagtgaagtgttggaaatcagttgagtatagttaaccagctatagtgtttgtagcaacaaggaatgcaatttgattgcaggttacttcaattcttataaaatcttcattaaaatatcatctttacaaaaatcaaaagggcaatttcaaattctgagtgttcattttctcggtgaattactgtctttattttgcattattcttatgttcattatgtcaaaaagtttacacacttaattttctttcttgtatcattcatattttaaggttagaaagtttgtggtctgtaaaggccatcttcctacattaggaaactactgattatttctatgtataaaatttcaggtttggcctttcgaggaaaacaacgcatcttaattttaaaatagatgttcttataaaggatatattttactttttactgatatttggatgatataaacattcacgtattcttatttgataattatttgaggggtgccataaaggattcatctacaactatacaaaacttccttctccctcttatatgcaacctttctaaagtaggaagagaagagctgggttgccagattccaaacacacatgaaaaccattgcacctaaatttagaattttaaaaaatcttttccatattccaatttggctttgataaaatttgaattctgagctacactttaaaagttattcttttttttctctatctaggcttaggagtagggtaatgctgttcatgaagctatgtcattatgtgtgttaagtctaattctacagaggaagtgagctgttataaaatcaaagtatgttcattggatttgatgtaagaattagaatggtagagagagaaggagaagattattttattccattcatgaataacagagaaaatggtctctcctgcatgtcctcttgacttatataccatgagcgtggaagcatagatatgagaaaattgaaaataactggttgaccacaaataaacagtgattcttatttccaacattccaaccatagctttttccactcaaaatatgcaagagttctgttacctgggagatctttctccccttgtatcatttagctattgttatgtaataatcctcctcatccagcccccttcccccaagaaaatctcagtggcttaaaacaataagcatttattattttgcatgaatctgtaagtcatctgagtgttttgggtgtgtggggtcttagatgggctcactcagtcatacacctgtggtcagctgcagattaagtaggtacctctgataatccaggcagatctctttcacatgactaattagcgataagcatgtgtaggtcaataattctccatcagcctagcccaagctcaaggaggaggcaagagcagaagtgcacaaggcctcttcaggcctaggctcagaacaggcacaccttcacttctgtctcattcttggcctagatttaaggggtggacgatggactccacttattgttggaaggagctgcaaaatatattacaaggagatttgttccagttactattgtgaataataacatattccaaaacataatggctaaaaacaatttatgtttctcacagattctgggggtcaggaatttagacaaaaatgcagtggctgtcctttactggtttcaggaagacttgaagcttaggagtagcttggcagctggaggctagaatcatctgaaggctcattcattcacaggcctgggacctgggctgtggagattcaaagatgagtagtgttgattgggtagcctccatgtggcctctccatgtagtttggcttccacatagtatagtggacacaagggactcagacttcttatgtggtagttcagggctccaagcccaggactccaagacggaagctgaattgccttttataacatatctttagaagtcatacagcagcaattccatcatatttaattaatcaaggcaatagaagctagattgaaaaggagaagaatcagcctccatttcaacagaatgtcaaaaccatgttggagaaaattatgtgcggcaggagatattgttgcagtcattttaaaaaaatacagtctgctgtaatctgcattttagcctcaccaatttacattccttctatatgcaaaatacattcacctcaccccccaaaacctctattaggatgtcaacttaaagaccaacagttcattatttaaatcaggtccaggtgtggatgaggctccttgaatatgattcgttgcgttagactcttaaagtttctctagttttctctaattctgaggatctgtgaactaaagaggacccctgtcaggctgctatggaacaacgcactcaagagtctaaggagacctaatatttaacagagaagttttgggaggcatggccttgtgtacttagaaaaactttcatctgtgtgaaagggtttatgaagcatcattgttaatctttctgaggtgtgaacaaagggttatattgtgaggtcattggttttatcttgaccctattagctgaaacagttatgagcccactctgcctcttgatggggaagtaaaaatgttatattataataagacatgtgatttaggagatattggtgctatcatctttggaaaacataacctgccatagagtgaaaccaggaggttaagtgagtgggatataaacctgattaatctaccataccctcttaaaaagttattgacttactttttggacaaatatttatagtgttttttacgttccaggtagagttctaggtactagaaaaaatagtgaataaaaaatacattctactctcatagtgctttacattctcatcttggggtcagaataataagtaataaacaaactatgtagtatattagatagtagtgtgtgaaaagaagggaaaaaagcataaagaagatagaaggtgtatgtggtagattacaagtttagatagcattactagtaagttctcactgagaagatattctagtaaagacccaaaaacggtgagagagtgagacatatagattttaggggatgagaactccaggtagaagatactagacaactttgtagcaggtacaaagttgtattgaaagtatagcaatggagtgagcaagtggtaagaaatgaggttgcagtggtaatgaggggcaggtcatgtagaaatctattggtctttgtaagtaattagacattcattccgaatgaaataggaagcaattaatgggtttttagtttatgagtgaaatgaactaatttccctttagacaaaatgactttggctgctttgttgagaacggaaaaaagaggaaaggacagagcagggtaagtggttaagaaatgattgaattaatacagactaaatgggctaaggtggtagcagtggtggtgaccagtagtctgatcctgcatacattttgaaggtagggacaacaggacccattgaggtattggatgtggactataagaaaagaaaagtcaagaataatgccaacatttttggcttgaactatttgatggatttttctggaaagatgaagttgagaaggtatgaaggcaggaagaaaacctggtgcctaaatactctgctgtgttttaagaggagcatctggtatacaaattgattcttctttgcaaaaccaagaacaactgtggattatttgtttctttatttgtttgtggcattgataaatgaattattcccagtgagaaatgagagaacctagaaaaagcatttaagaactcccaattctttgtctaataaactagcttttgttatgctaggatccctgagtctaatatcagtcattcaaacaacctttaagaccttgtgtcaaaaaatatcaaaataatgttattgttagttcttaaagctaaaggtaaaaacacattctcttgctttttacttgtcttttttgggggagttggggggaatggtttcacagtccatctaatggatgccttatggattctctaaatggcagccccaggtatacacgcattggcttttgccgaaccttcagggtgagtgtcattcccttcgctctttacttagttgaaattctctctatgcctgaaggcacatttcaagatctttctcttccataaagagttatcttaccactctagataacacttatttttataacaatcacttattattctttcattttttgtgtgttagatttccctttctgtttaaattataaaccaatttttgggaggcaatgtatcccatgctgagaaggaattcatcacatgcactgatgcatttgtgatttcataaaaatagaactggacttttggtcaaaaaacatggtttaaaaataagtcttcacttaaacgttactggctattgatcaagtaatgttaagcagttatactcaacttttccaaggtttagtttgtttgttaatactgctgaaatatttcactgagtttgaaatatgtttgatttcccagcattatggggaggattagatgaagtgctttgtcaatgttaggaaatgtagttgtgttatattctagaccagagtctccattatgggcagcactgatcacccagcaccatatcaagccaggctcttcaggagttactcaggctggttgactttttccaacacttcagcagttctctccttaatggcttccacatagctaaaatttccatgtatcttctcatttactataccttgaatattttgagtttccaaatagctagagtttttaacatgtcaaaaagctctctgggtgagtttagcattgtcataaatggagcactttgagatataaatgatgagagggacaacttccctttaatttcattgattactatcaactgccaatcaggcagtacttaccccacctgctaactaatccaaaagcaacacttagctcagagaaaagcaaaggtaatatgcaaaaagccgacagtttcagctgttaacaatattattaattaaccatttccagaagagttttaaattattcattgacattttattgttattaacaatacatttattgagcacctatcaagtactaagattcccaaaatggtataaaacacagcgactgctcttgtgtcatttaaaatccattaaaatatacacaattttttcaggtgtgtacatgtgctcaaggttctagtgcatacttaactgtaataacgggagagtgagaaatccaaaagcaggagaggataaacagatttaaaaaaaaaagtcggttccctaagtttacatgaagaatgtgtttacctaaaggcttctaagcgacattttgataaaaacagtttatgagatccacttctaccaatgataactttctttcctccaaatctggctgctgcttacatctctctaaaaggactactttttatatgcagagggacattaattcattttctaataacagaagcaaaaacttagagtgacataaaaaacaacagaaggaagtagaattaaagtaccatgaagatagagactatgactattttgcaaattcccaggactcaggagggagactgaaacacagcaggtactctacaataaatattttttgaaggagtggatgggtggatggacggatgggtggatggagatgggaattaattgaatgaagcccttcaaattgcaattgttaagtctaggacaaaaatctgcatttgagatatggaaatgggaactttaatttattatgacaaaattctgaatcttgctctctggttcacaatttcctcccgtcttaaagaaaatgattggatatttaagatcatttctaggtctaaaataagatactttgataatatgatgacttaacattttgagtcttatgtttagctatgattcatctctgaaccagtaatttggaatgcatttttaataataacaatattaattactaactgacttcatgcattagttagctaaataatcaaaataacatttctacaaagtaagaatcattaggtgcctctttatccaaatgaagaaactgaggtttattcaggtaagtaacttgtccaagagcacagaggtgggcatgatagagttgaggctatggatcaggtctggctcactctgattcccatgcctggaactgttgtctattatttaacacaccttcttttataagacatttgtgtgtaagaggtccataacttgagaagaggtacaatgttgtttctttacagctaggccagtcaccagtgttgctgacctggacatagggttaggattaggaaattccatcaagcataaaacaagacaaagatgaatatcttgtgtcaatgtgttcaggattcagccacaaggcaagagagcagataacagggcagaaggaattaagagtacggggcagtttgggtggactgaaggtaaaggcaatttgaaattttggacagtagccagaaatcagggcatatagaagaacaaaaaagatcagaacaatagcaagcaagagagcagagctcatgatagtgtccattgaccttaatcactggagcagatctcttctggtgggatttttttttaatcattgcatatagcagaaaccaattttcgattgcaggtctgggaacagcatgaagaagcagaattggcggctccaagctaactggggcaggggatcagtagcagctgcgggtgagaaactcctgacaccttagcataccttcttagcgcttgagagtttcactatctgttcagtcccttttgcaaggggaaattggttctgcagcatatatcgtagcttcccagctggaagagtgcaatgatggattgctggagtccacacaactgatgggttctttcttttttcccctgtcaggaaaaagtgactcacggcaatcatatattggtgtcatatacataactcttaccctccctgcccttctgcaccacccccaatatactaactcaccattggcataaatctacttttgtaattctacattgcaagttcctggtatttgcaagatgctgttctaggtggaggagatgaaaagatgaatgagatatgattcctgcctttgaggagttcacagtctagatgggagaaaggcatgcataaaccaataatcatagctaacagatatggagcacttatagcaaggcagatgctattatacttgctatatatattagctatatatattacctcatttaatcctcaaagctaccccataaggtacgagtcttatcctcactttatagatgaagaaactcatgcacagaggggctaaataaattactcaggatcactcaactaataagagttggaacccagaattctaaaccacacaatgtggccacagggcctgtcttgtgaagatgacatactgccttctcataaataaaaaattactgagtacaattatcagagcaagaattgagacatacagaaaaggaaaatgaccacatgaaaagagtaaagatttgcaatgagtagagtaagtgggattatgttgactgtcataggacttttaatatacttttcaatttttctggaccttaagttattcatggggagaacaatacatatgttcaggtgttattgtaaagataataaagactgtatagaaaatacctaccacagtgcctggcatattagatatttaataaatgatgcttataattgaaatagtggtagttgttgttgcttttgttatcactgtgatgttgtacataagtactgtagggacgcaaaggaattgtgactgattctgtctgaagagggaaggtggttgaggaaagatattgtgaggcttggcataaaaggtggcatttgaactggaccttgaaagataatcattttctagacagatgaagggaagaaatgcattctaaatagagacaacatgtgcataacatatgtggaaaataccaagtttttgttggtttggataaatcatggtatgtgtgtctgcatgtgtgcgcgtgtgtgttgagagtggctggagatgacactataaagatttgaagggcacacatcatgaaaaccttgcaagtcattgaatttagccctaaactcataaaatatgaaaagttatatggtaactaactcagcagtgttttggatccctctaaactagttttttaatggaatgtttccttttcttccttctaaatattttaaaacacaataatactgctttataagacaattatatggtgttcaacagctggccaaactttcagtttcattttactctagagttactatgtgtacttctctgtctatcaacaattcatgagcaaatcagccagtgtcagaaatggacgatgaagaataaatgtggcagaaatattccatataatgacttgttggaactgttgcctttactggtcaccctacttttgacccagacataaattggcaaagacccattgctcaacatttagataagaaccctttttttttttaaatttcaactattagtttagatacagggtatacatgtgcagatttgttacatgggaatattgagtgatgctgaggtttggagcacagatcctgttaccctagtagtgagcatggtaactgataggtagtgttttaacccacccactcccaccctctagtaagccacagcatctagcatctattgttctcatatttatgtccatgtgtgctcagtgcttagttcccacttattagtgataacaggtagtatttggttttctgttcctgtgttaatttgcttaggattatggcctccagctctatacatgttgctgcaagacattatttcattctttttatggctacatagtatttcatggtgtatatatccacagttgctttatccaatgggatgatttcatgtctttgcttgtgtaaatagcacagctatgaacatacgaatgcatgtgtctttttggtagaatgattttttttaatatatacccattaataggattgctgggttgaagaacccattttttgactgttgttaaatttaattatccctgtgaagggtaataagcagtatgtgtgtgtctatgtatgtgtctttgagtgtgtgagtgacaaaattcttgtttatataaatattgtacacacttgtttgaaaccatctgatgtctcactttcccagcactaaaacgaaatgaaacaaaagcacaccaataaataaataaatacttggccaaaaagatactactttttgggacaattaataagtaaaataagcataaaagttttttgaagaatgaagaaatagaaaaacaaaatgctattatttcctttggtctttaggcagaaggacaaatccaactacaatgattttgtagccttatctaaaagccaattagggggaacctccatctgctctcattgctaacatagtatagtcaagacgccttttgaacaactgtttgactcttcagcagttattgctattgtagctgattctcatcactttcttttctcgcatgacccctggaatatacaaatgatcacatagtagataattgtatacaattgtttatttagccttccatcagaaacatcattgttactattgttttaatgaaaattaccaaataatcttaatctggattattcaaagaatgccttttactttgaatgaactgagttttgctgtagaatgccttagtgaagaaagttattacatatggttctttgtgtttcctttgcttaggtttgcagacaagatgaattattttaatttttttcttataagttcatcaggctaactctttaatcatttttattgcccatctcatctcagttatattaaatctaattttcctatatttgggtacattggtaaataccaaattatttttaatattcaaatagttgtcccatcagaattatataaacagtattttactgtcattgttaagtgaatatttaacatgtccagttctcaaataccgttttcatttttgactccattacattgctagtaaagtcaaatctgccgtaaatggatggtacattctttctgtccattatacatgacttgcttttgcttccactgagtgaattttaaaaaattatttttaccaattgtactagcctgatttttcaagtataaggtcatttttacttacatataatccttcaaaatcatttatctaccttgtcataatgcatgctaacagcacccttcaattcagtatcatctgcaaatttcattaacatattgtttactccctttccaggtgattgatgtagatattaaatatgactatagttaacatcaatcccttcctaacttggttacaaatttcttcaaaataaaatagcatttttagtattactcctaatttgtagttcttcaatcaattttgtattctaatggtacgagaatgtttaatgcaagttaattttaactttgaaagtctgtctcagattgctaaaataaaacatgttctgctttctgtatttctcacattaagtaattctaattctctaaaaattgtggacaacctcgttaacctgtaaaagtaatttataaatccaagttatctctgaaacatgatgcaatcatcttggggagacttgaatgtctacaaaatttctctagggctttataatatcgctggtctgagaaattccattaatgtttcatttggaaatgttaactcctatgaaactagggtattcttgtgtttttttttttttaaatatactttaagttctgggatacatgtgcagaacgtgcaggtttgttacataggtatacatgtgccgtggtggtttgctgcacccatcaaccattcatctacagtaggtatttctcctaatgctatccctcccctagccccacatcccctgacaggccccagtgtgtgatgttcccctccctgtgtccctgtgttctcattgttcaaccccacttaggagtgagaatatgcagtgcttggttttctgttcctgtgttagtttgctgagaatgatggtttccagcttcatccatgtccctacaaaggatatgaactcctccctttttatggctgcatagtagtccatggtgtatatgttccacattttccttatccagtctattattgatgggcatttgggttagttccaagtcttcgttattgtgaatagtgctacaataaacatacgtgtgcatgtgtctttatagaagaatgatttataatcctttgtgtatatacccagtaatgggattgctgggtcaaacagtatttctggttctagacccttgaggaatctccacattgtcttccacaaaggttgaactaatttgcactcccaccaacagtgtgacagcattcttatttctccatatcctctccagcatctattgctttataactttttaatgatataacgccattctaattggtgtgagatggtatctcactgtggttttgatttgcatttctctaatgaccaatgatgatgagcttttttttgtatgtttgttggctgcataaatgtcttcttttgagaaatgtctgttcatatcctttgcctactttttgatgggattgtttttttcttgtaaatttgtttaagttccttgaagattcagggtattagccctttgtttaagtttcttgtagtttcaggatatcagccctttgtcagatggataggttgcaaaaattttctcccatactgtaggttgcctgttcactctgatgatagtttcttttgctatgcagaagctctttagtttgattagatcccatttgtcacttttggcttttgttaccattgcttttggtgttttagacatgaagtccttgcccatgcctatgtcctgaatggtattgcctaggttttcttccagggtttttatggttttaggtcttatgtttaagtctttaatccaccttgagtaaatttttgtataaggtgtaaggaaggtgtccagtttcagttttctgcatatggctagccagttttcccaaaaccatttattaaatagggagtcctttccccattgcttgtttttgtcaggtttgtcaaagatcagatggtcgtagatgtgtggtgttatttctgaggcctctgatctgttccattggtctatatgtctgtattgatatcagtaccatgctgctttcattacggtaactttgtagtatagtttgaagtcaggtagtgtgatgcctccagctttgttctttttgcttaagattgtcttggctatatgggcacttctttggtttcatatgaaatttaaagtagttttttctaattctgtgaagaaagtcaatggtagcttgatgaggatagcactgaatctataaactactttggacagtatggccattttcatgaaattgactcttcctatccatgagcatggaatgttctgccatttgtttctgtcctctcttatttccttgagctgtggtttgtacttctccttgaagaggttcttcaaatcccttgtaacttttattcctaggtattttattctctttgtagcaattgtgaatgggagttcactcatgatttggctctctgtttgtctattattagtgtataggaatgcttgtgatttttgcacattgattttttatcctgagactttgctgaagttgcttatcagcttaaggagattttgggctgagatgatggggttttctaggtatacaatcatgtcatctgcaaacagagacaatttgacttcctctcttcctatttgatcatgctttctttctttcttttgcctgaatgctctgatcagaacttccaatgctatgttgaataggagtggtgagagaggacatccttgtcttgtgctggttttcaaagggaatgcttccagcttttgcacattcagtgtgatattggctgtgggtttgtcataaatagctcttattattttgcaatacctttcatcaatacctagtttatttatcatttttattatgaaggtgtgttgaattttatcaaacgccttttctgtatctatctgttgagaaaatcatgtgtttttttcccactggttctgtctatctgatggattatgcttattgatttgcatatgttgaaccaatcttgcatcccagggatgagtctgactttatcatggtggaaacgctttttgatgtgctgctggatttggtttgccagtgttttattgaggattttgcatcaaggttcatcagggatattggcctgaaatttactcttttgttgtttctctgccaggttttggtatcacaatgatgctggtctcattaaatgagtgagggaggactccctctttttctattgtttggaatagcttcagaaggagtggtatcagctcctccttttacctctgttagaatttggctgtgaatcctggttctgagattattttgattggtaggctattaattactggctcagtttcagaacttgttattggtctattcagggatttgtcttcatcctggtttcgtcttggaagggtgtatgtgttcaggaatttatccattacttctagattttctagtttatttgcatacagatgtttatagcattctctgatggtagtttgtatttctgtgggatcagtggtgatatcccctttatcattttttattgtgtctatttgattcctctctcttttcttctttattattctggctagtggtctattttgttaatcttttcaaaaaacaagctcctggattcactgatttttttgaagggttttctctgtctctatctccttcatttctgttctgatctcatttcttttcttctgctagcttttgaatttgtttgctcttgcttctctagtttttttaattgtgatattatagtgttaattttagttctttcccacttgctcctgtgggcatttagtgctataaatttcccttgaaacactgctttggctgtgtcccagagattctggtaagttgtgtctttgttctcattggtttcaaagaacttatttatttctaccttaagttcgttatttgcccagtagtcattcaggagtaggttgttcagtttccatgtagttgtgcgcttttgagtgagtttcttaatcctgagttctaatttgattgcactgtggtctgagagactgtttgttatgatttcctttctttgcatttgctgaggagtgttttacttcgaattatgtggtcaattttagaataagtacaatgtggtgctgagaagaacatatattattttaatttttggtggagagttctgtagatgtctgttaggtctgcttggtctagagctgagttcaagtcctgaatatccttgttaattttatttctcattgatgtgtcaattattgacagtggggtgtcaaaatctcccactattattgtgtgggagtctaagtctctttgtggtctataagcacttgctttacatatctgggtgcttctgtattggtgcacccactaaatatatattggtgcatatatatttaggctagttagctctttttgttgcattgatccctttaccattatgtaatgccctttttgtcttttctgatctttgttggtttaaagtctgttttatcagagactaagattgcaacctctgcttttttttgccttccatttgcttggtaaatattcctctatccctctattttaagcctatgtgtgtctttgcacgtaagaggggtctcctgaatacagcaccctgatgggtctcgaccctttatccaatttgccaggctgtgtcttttcattgtggcacttagcctatttacatttaatgttaatattgttatgtgtggagttgattgtggcacttatcccatttacatttaatgttaatattgttacgtgtggagttgattaacattaaatgtttaacatttaatgttaatattgttatgtatggagttgattgttatgtgtggagtaaagacagtgcagtctttatgatgctagctggttattttgcccattagttgatgcagtttcttcatagtgtcaatagtctttacaatttggtatgtctttgcagtggcttgtactggtttttcctttccatatttagtgctttcttcaggagcaaggcaggcctggtggtgacaaaaatctctcagcatttgcttgtctctaaaggattttatttctccttccacacttatgaagcttagtttggctggatatgaaattctgggttgaaaattcttttctttaagaatgttgaatattgtcccccactctcttctcacttgttagggtttctgcagacagatctgctgttagtctgatgggcttccctttgtgggtaagtaacctgacctttctctctggctgcccttaacattttttccttcagctcaaccttggtgaatctgacagttatgtgtcttggggttgctcttctcaaggagtatctttgtggtgttgtctctgtatttcctgaatttgaatgttggcctttcttgctaggttggggaagttctcctggataatatcctgaagagtgttttccaacttggttccattctccccatcactttcaggtaccccaatcgaacgtaggtttcgtcttttcacatagtcctgtatttcttggcggttttgttcattccttttcatggttttttctctaatcttgtctacatgcatgatttctttaagttgatctttaatctctgatatcctttcttcagcttgatcaattcagctattgatgcttgtatatgcttcacgaagttcttgtactgtgtttttcagctccatcaggtcatttatattcttctctcaactgattattctagttagcaatacatgtaacattttatcgaggttcttaccttccttgcattgtgttagaacatgctcctttagctcagaggagtttgttattactcaccttctgaagcctacttttgtcagtttgccaaactcattctccatccagttttgttcccttgctggcaaggagttgaggtcctctggagaagaggcgttctggtttttggaattttcagcctttttttctcctcatctttgtggatttatctatttttggcttctgatgctgaggactttggaaaaggtttttgtgttggcgtcctttttgttgatgttgatgttattactttctgttagtttttcttctaacagtgaggcccctcttctgcacgtctgctggagtttgcgggaggtcctctccagaccctctgtgcctgggtatcaccagcagaggatgaagaacagcaaagattgctgcctgctccttcttctggaagcttcatcccagagggtcacccaccagaatccagctggagctctcctgtatgaggtgtctgttgacccctgctgggagggtcaccccatcaggaggcatgggggtcagggacccacttgaggaggcagtatgtcccttagcagagctcgaatgctgtgctgggagatctgctgctctcttcagagcctgcaggcaggaaaatttaggtctactgaagctgcgcccacagccacatcttcccctacgtgctctgtcccaggaagttgggaagtctatctataagcctactcaagcctcggtagtggcagatgctcctcccccgaccaagctcgagcatcccaggttgatttcagactgctgtgctggcagcaagaattttaagccagtggatcttagcttgctgggctctgtggggatggaatccactcagctataccacttggttccctggcttcagccctgtttccaggggcatgaatggttctgtctcactggcgttccaggtgtcactggggtatgaaaaaaactcctgcagctagctcgctgtctgcccaaatggccgtccagttttgtgcctgaaacctagggccctggtggtgtaggcacccgagggaatctcctggtttgtgggttgcgaagactgtgggacagcatagtatgtgcactggagtgcactgttcctgaaggcaggctccctcagggcttcctttggctaggggtgggagtttcccgacctcttggacttcccagctgaggcaacaccccaccctgcttctgctcgccctctgtgggctgcacccactgtctaaccagtcccagtgagatgaaccaggtacctccaggtacctcagttggaaatacagaaatcacccaccttctgtgttgatctcactgggagccgcagactggagctgttcctatttggccatcttaccagccacccaccctcctttttttttttttttttttttttttgagacagagtcttgctcttgttgcccaggctggagtgcaaaggcacgatctcagctcactgcaacctctgcttcctgagttcaagcgatcctcctgcctcagcctcctgagtagttgggattacctcagtagaattcagttgggtatttactttattctaattttacttgccttctaatgtaaatgattatataaagtatttcttccagttggtgtgtatggaaaaggtaaattgcatattagttacttatacaatttttgttttaatcatttttattggtcacctataaataggcaattgataaataattttttctatctcccctacaatccggaaattaaaataatctaatcacaggtcacatcaaaatgataatttaaatgggactgtctcctacatagctgccaagaagttttcagcacataacttgaaccacataattatgaagtaatccccatgacaacaaaatacattttatgtaacaaagactagtttcctgcgaagattttaccattacaaatgaagaagtttggcactgtatattttactgtgtctcattccttctccccaaacagatttggctgattaattatgtcactgtcatcccttgctagggacgaggaacattaagacaatgtgggccaatgagagagcaggagagatttgctgggtgttctggaaaaggagttccttctcaacaattccatatcttctctctctactccttgatctcttctgaccaccttctgacatttcctaccaaagccacatgcacagccacaaagcccagactgccactggcagcaaacctgccaccacgaggggaaccgtctaagaatgaagcctgagtgtaggcagcaaagtagacgcaaagagcctgtcttcatgacctcactgagccagcagaaaaacctgggacccaccctgaagcatactgtatctctgtgtctgctcattgataaacacacaaatgccctttctctatatgtcggtccaaagaggatttgttacatggagccaaaagcatcctaattagtccttgagtatacactttgtaagctaaagttaaccaaatatgaacatgtttgtattggtttagtaatcatgcagattcttgtttagattggatatcaaaattaaacttttcaaacttaatgtatattctgtatcataatgtcttttaaaagaagattttgaaaacagccaaaggttacagagctagtcagttgaagggtcagaatttatccctaggcagtctggccgcagagcctgtgcttttaaccagcaaatgagagaggacactgcagggattttgacaagcatgctcaagatggagcagaaccaaaaactagtagtgtctaaaaaaaaagagagagagagagaaagacagacagagagacggtgaggacagagtgtcataaagaaaacagagtgatcagaaatgtgcaacgcaacagaaaaatcaaaatatgaaaagatcttaaattaagccttcatatgaattgaattttactgctggactttgaaaaaccaggtactctagtacctgctaggctgttaatctgggggtagtaatttaaataataaataaaaagaggagaaaagtaaatgtatcaggtatttaatttttgaggttactaaaactggtattactattattattattattttatctgtatcacaaacccccatggagtcttttcatccctaaatcttctccatgtgttctccaaaaatatgtgttctcttgaaacccttttgcatctcttagtatctattaagttagtgcaaaagtaactgtggtttttggaattaaaagcaatgacattttaatgccaaaaactgcaattacttttgcaccaacctaaatctatttaatctgtctatctgtcctctatctatctatctatctatctatctatctatctatctatctatgtggttatctagctgttatctatctatatatctatctatctatctatgtatctatctagtaagaatacacatgttggaagaaatctattgattggtcttgtactggaatccacatttttcctaacaaaatattccagccagacttttcttacatacaagtgtgtgtagcctcattagggaaggttcctagcccaaaccattgatttgttattctatgtacagtcaaggagttgtgttgtgcaatcatatcactctgacatctaaacaataagacaggtggttttcaagcagttaggacaagagtacttagaatgccacagggaaaaataaaataaaattacattgagagacagaatgaataatggaaataattaaatagtatctgaagtagtctagctaacctggattggaattctgttctgccattcgtcaaccatgcaaacttggaaacttccttaacctaccttagattgtagtttatcttaagtaaactgaggagtaatactaacttcacaaaattgttgttataattagccacacaatgcagggcctgacctatagtgggtgttcagagaacaacagccattatcatatgtcttattgagtttgccctgatgtaactcctaaggttagggatggcatgatacataaaaagacagcttaaaacaagaaaccaaataaagtagtttcatcaatcttagtgcattgaagtaagaaagtaaaagaagtgagatagttgctactcctctgaaaagaaatgttataaggcctcttgccctgtaacaaacatgacaaactgaaacactgaccaagggatcaagcagacaatacaaatgataaagcagataagtatccaggttctaggcttgtttgccttcagatgtctatgtcctccttgccttgctctgttctgtgtcacagaaggactcacccatgcaagatgcattcctcaggtttctgagtcagctgcctccagcagggtgaaaacaatggcaagcactggcaggagacttgagggtaggggactagtaggagaccaccaagttagctccattctccccaccccttcttgttcgctgtgtctgactgtttctctagcaatggcttcatctctgtgtgttccagtgtacccttcacgtaaccatgaccctgggctcctacaacactagctcctcctttttctctccagccaagtgttagtagtatcttcttgccatgtcaatctctggtttatgtcattgtcggtatcacctgtataactagttgcctatgctacagtattggcttctgtattcctggttagaccctgactgatagaatctgtaaacatggacacaagtaaaattgataggatttcacaaagtggtgagaacctcctggtcatctggtactcacctgtgactaactgatgcattttaggaatatgggtaccatatggtcaaatcctccaaattttcaagaaatgctgaactatgacgtgacctgcaactgtcgtgattttctaggaagatgtgaggagagctgtgactgacttagtggtttagtgctattgaacattctgatttgtgcgctggaattagtcaacattgagaatgaaacactaccaactttcttaatgtatacaattgttatttcgagaaacattttcgagtgtctacattgtattactcaccaaggtaaatgcctagaatacaagaaagattagttgatagttaactactattaattatctagtttgatacaagtacttttagatacataataaaacattatctttactatgaaagttcatggtcattacccacaagttttgttttattttcactttttgaaagctgagactcagagataccaatgaactctccaagtttacgtagctggtttgaaggagatctcactgaaatccatagttggactctaaaaattatgctctttctgcagtgacatgcatagtcttcctggattacagaaaacataaaatgtgcatgatcaagtaagttacatgttagcagggaggagagataagtaagtagctataaagcagtgaaggaaatgttatgttggtgggtatattttaatgctccattgattatattgacacagtaggtgactcggttgttcacaactttacacacagttttctttcttggtcataccccaagccactttctataatttgtagaaagcatgtgttcagaaaagctgcttaacaaaatagttgtgtaccataggtgaaggaagcataatgagatcatctttgatacttgcagctaatataaatttaaaagagatgtaagcatttataactctctttaaatgtgcggcaatagttagcatagaagttatttgtgaacaaagaacccacaattaactgaacactaaactcgactttgtaatacttgaaaataaaaataattgtattttagtaaagcattttatactatcttaacattcagtttctgttccctttttaaatgttcagtctttccactgggagacattacaaaatgaatttagtaacagtaactaacacttaccgtagttcttactgtgtaggatcttatttaatacaacaaccctaggaggaggctaatattattatccccattgtacggagcattttagtcagggttctctagaggaacagaactattaaaaataggatatatgtatatatgaaaggaagttttttaaggagaattgactcacaggatcatgaggtgaagtcccatgataggccatctgcaagttgaggggcaaggaaaccagtaatggatcaatctgagtcccaaaacctcaaaagtagggaagctgatagtgcagccttcattctgtggccaaaggcctgagagcccctatcaaactactggtgtaagtccaagagtccaaaagctgaagaacttggagtctgatgttggagggcaggaagcatccagcatgggagaaagatgaaggtcagaagactcagcaagttcactccttccatcttattctgcccgctttattctagccatgctggcagctgataagatggtgcccacccagattgagggtgggtctgcctctcccagtccactgactcaaatgttaatctcctttgacaacaccctcgcagatacacccaggaacaatattttgcatccttcaatccttcaatattgacactcaatatgaacctattaaccatcacacagaagaagtaactgaggaagaaagaagctaaataatttgtgtaaagccacatagattctcagttgcagagccgtgattcaaactgaggtgttgggcaccatgcctaagcaattaatcctggtacctcactgtttcttcataaagcaatagaagtgcttactatatgcaaaatattgtagggaatatgctaccactcctgagtggcttggaatctaattggagagtcataacataccaccacataaatttgtattggtcttaaataaattttaaggaagtaccatacaagaggtactgaattattattattgattgaataagtaagaaagatcagagaatgggaaggtgaaccagttaatttttattgccagtatataccaaatatggaatatattttgatccttataaattgcttgacagtccagtgaaatagatactgcaagtcttcctattttagagatggagactaaataacatgcccaaacccatgtagctaggaagttgcactcaaagtgtgcttcgtggacaggcagcatgaaaatcacctgagaggttgtcagaaatgcaaatttaaggtccaacccagacctgttgaatcagatctctgggactgatgcacagaaatgtgtgttccaatcagttttctatgtgattctcgtgcacattgaagtttgagaagtacctacttaaggtatgaatttgtggtaattgtgagatctgtgtaatgttaagcctcatattcttgccacagcaccatgctgtgacgtgggctagctggggaagtttggaaggaattcaatataagagctgttctttgaaggactggttaagtacaggtcggaagaaagaagaatggaaacataataggagagaacacttactgaacatgtcgtgcatgatggttgccatgtttatcttcccatcctagctataattatttcacccaaaactcttggttaggtttacttatcagactaagggagggcacctgatacaaaggtaggccatctgtagtctagtgagcaattcaaagagaggctttgcatgaagtgttctgccaatgattaataatggtaatgaagccaattatttagatttgcaccatggactgtggaggaggaattatcagtaggtatcagcaagaggataatggagcagacatataggaaaagacaaatacaatataaggaaaacaaaaagacaagctttcccctatacctcttattcatatattttggctatttcttatttctatttatgaatatcctcctctaggaatccagagtaacactataatctaagactaaccataatcctttatgtaacataataacaaagacaaagagacttaaagcagcgagacatttggaggggtcagctatgggctcaatctagatggtcagaggtcttttttctcaagaagttacaggagacagggccggtgataagaaagttcagaagagtagaaacaatttcttaggctggaaagttactttcatacttcctctccctaactcccatttctcttcttgtaatttgtatctcctaccacgtaacagagccacaaactataaacattaaaaccttacagggccaacttctttctggtagatttaattgcccctggtagcaaagccacttgtctctgaaggggccacttgtcctaagaaatgcaagcacttgcttcccttgattttctaagatgcccagaagttggctcctttgtccacacagatcagccctgccttagacctcaggctatttcacaaagcttgtctctgccctcttcttgtctctgttacattccttttgcacttcctttcctcaagccagcattattaaacatggtaataattatattaatagtaaatatcacctttctacaagattgtttagagaatataatgagactatgtatataaacacaattcataaaactgttaagtagacccaaattttagtgattgtaatgataatattttcgtgcatgattccattagagtttaaagttgtactggatttgaatgcttagtaaaaatgattgggttttactttttgacatcctgaaacatttagagcacagtagtgacaggttgaaagctgggatttattaataattaatctaataatcatgtagggagtggagagaggaaatactagcattataggattaatttaggagtttatttccaactacccaggtacttagccaaaaggctgaatagtggtcatttcatggtcactaccatggaaacagaaaggaaggggcactttgacgatacatttaggctgctaaaaacgttagttcttgatgaccgattgaatataaatggcaacaaagaaagagtcagaggtgactatatggcttggaacctgtgtctttgggaaaatggaattattctgaattacaccctcatgtctaagctaaactggtaggtttacttagtgactgggcaacttccgcatgatttttaaaacattcctttgtcatctttaatgcatactttaggaccttggggcactttttattacagcacaggccttactttcaatgatctgaatccaaatctcttttccaggataaagatgtgatcccgagatataagggacttattttgtccaatatgaggtctagttggaatagtgtcctctctaagtcagactctgtgagggactacaggaaagggaacaaaaaccagctcatcttcacccatcctgtgctttccagtgtttcactgctaccattcccttctgtcttagcttagtgaaatcagtgtcttacttgccctgaaacatataatgcccagtaatagagctagaactcttgtccaggcctgtcaaataaatttaaccaaatatttcaatgggaaaaaaagaataacttatgtcttgtgataatataaccaccatgctttcatgtgtgtatgtgtgtatgggtgtgtgtgtgagactataatttattcaacaaaaaaaattttggcttctttttttctcaaaaaaaaaaatcataaaaacttatctaatgctgaagggtagcaatcatcagttgatcttaaaaggacaccatattctctataaatatttctttctaaagttgtcagttaggtttcatcctgctttatcctttctttaggaaaggatagtgttaaagtgccatcaagtaaaatatgggattttctgctgaggtctttacatcagtgaatttacattttgtaagaataccctaaggggatttcagcttcctgacttaaaaagttaggtggatccatttcagttgtgcacatccagcttcatgctttaacatggccagattgccatggcttcaatttaagtcacaggtttctggtgataatatacatctacatttttacagtggtgcctgaaaatgggagtctataaagaatctgacttgaattattaagaatggaaaacttaaatgtctgaccccaaacaggggtataaattctgctatgttttaatgcattcactacttcctaaactgatacatatttccaagataatatgactaactttatatataaaaaatactttagttctttgataaaaagaaaaaatgctcttgaaggtcaaaagtcaaagtatgctatcacaaataaaaatattagttctctaaaatatgtaacttgatttcttttgtatagtttaaaacatgtgttgaaaattaaatatgcctgatttttataaaactgtcattaatgttagagtatatttgagttttatatatcataaattagaagttgagacagtgagtgtatctaattaatagttatgtcctgtcagtgtgtatgtaaatgctgagtagtcacaattttcaaaaatgtgttttctttttactttatcattttctggttatttcagattaaataaccataatttatattctgtggatctgattatttgtgtctacctcaagattccaacacaataaattgggatgaccataaagggaaagatgtgggaacatcacaattgaaagggtggtcccctgaggctaacagtggagattttaccacccaggacctgagtagagtctgtaaggaatgttatctagagagaagcagtgattcatttagggaaataactgccctatggtgaccctaaagggaagaatccaggagaataaataccttgacatcagtttcttacccatctctgatccatctctgatctcttgccaggactccttattggcagagcactatcagcagccagagttaggaatcccatggactagtccatacaggtctatatttcagcctcccggggacagagagcaaggtgggaaagcagggagagtagagctggatggccaaacaaaagatatactcacagtgtggccaaaataaataaattctagccatttaatgcttcattttaaaataattttcaaatagcaatttaaaacaatctgtcattgccattcattgagaatactttctggaagataagcagtgtcttcttatctggaagatattgttggtctcctttattctagatctctgtagcacctaacactgctaactgcagtcatctgaatatgaaaaaacgtttagtagggttagaatgaactaggacaagggtcagtaactaaaatgggcagtctagttggctaagtgggtggctgaactagcagatctattctttccttctgatgctaccctttgttccttctcctttgtgaatattggtacattatctatcagttctatattgccacagtaactctgtttaacaaaccaaactgctccaaaactgagtggcttaaaacaacagtagtctcttctcacagatctgaagatcagctagggtaaattaatctagactggacctaaataggtgcctctgcttccagctgtgggtctgattgggcatggttcactcagtccattttggctgaacggtcagcagggaaactttccttatggagatggcgcagataaaaagagggcaagtagaaaaataataattccacttaaggtctaggctaagaactggcacactatcacttccatccacatacaatcggacaatgcaacacgcaaggctaaggtcaaaatcaaggcataggaataaactttatgctctggatgagatcatgacaaggatatggatgcagaaaggatgaaaattggggacaagatttcaatctactctaatctacactcttggccacaattactcatttgcaagaccaccccatgcaaaaccaaaccaaaactaaactgaaacaaacaccctcatcctagaatctttaaaagtctcatgtcacatgacattaagctcaaggttcaggatcatgtaatcattgttagtccagatgaggctctttttgatttggaaacctataaactaaaatggcaagttatttcgcccaaacacaatacacttccggaacagagaaagaataatagcaataagctcttccatttggaaagccaaagagagtagaatgggatacaggcacataggaagccttggtagacggtaattttgaagtcccatttggaaaatattactaagtctcccttctctaggattagagaatggtccttagtaaaattcccaattctgcttccaggaagtggtccccagttttttattctcctgcattgtctactagtttggatgtcccttttccccaatcatccttcttgtccatttttacagaggactttgtctaaaatgctctttatagaagctgagcaatcgccttcggctgcttcctttcgtgagacagttggaaggtcttatattttcagcaggcccagtccatcttagtcctggctttcattgctttttgccaatcaaatctctcaaaatattgtggaccttctatatatttttttagaacacttcatcagccaaaaaccaaacctacaattttctctgatgcatgcttctctctctactcttaatcttggacatattaggcttctatgggattatgccaataaacttttgtaatacgattacattcttatataggaaacactttattttcatgataaaagttgctcctgagagtcaaaaaacaaaatattctaccaaaataaaatgttaactttctaaaatatataatctggttgttttatacaattcaagatgaatatgtttaaaattaaacttgcctggtttgaataaaactgttacaatgttagaattttctatatcatatatagttaaatcaaagcaggttattttatttagaaagcccttctttagatccctttttatatttggaaggaatctactggaaatgaccttaattctttcagagattttaataaatggtgtgagggctgaaccctggttggttctatgactcaaggctgtataccaatattgatttcatctttgttctcatcttgtatcttaatctgagaatcttttcctggctatagaagctaaagatgaggaatagtttaatttcccaagccagcaatttctggatttataacattctgctcacaaactttaaaattattttctgatctgatttgtttctgtatatctatctctttatgtatattttttgtagaaatacattatatacatataaaagagatgagctcacacttttcccatattgcctagaaaccatcctgtccaagtccacaagtttgtgagatacaatttttattttcctagttagagcaggcaaaagttttagtaaatattttacctctacacaatgttgttatttttctaaatatattagctttcttcccattttctcaaccttcatccattgctcagtcccaaatctaatggtatgtattttatgtgtatcccacttccagtaccaatttcagtatcagttagttattgtcacagtgagtctgatgaacaaacaacccccagttaatcatttattttcagagatctgaggttgatagtgaaggtgaggcttggctgggttgctctgtgttaagctgtaggttccgctatccctggttcatcactcaggttgactgcacagtttttcttataagagtggcagagctacaaagagaattggtagaaatccttgaggctcttaacacctaggcttggaactggctctttgacacttcctcccctaaatgtttttgaccaggcaagtcccatagctaagctcaaagtccccagttggagaaaactatacaccaccatcaatggggtcatagcaaatatctatgcagggaaggggaaccagaagtttaatctaccacctttttagagtcccaaataaccttggctgccaacttgtagatagttttaagaatttataaatgaggccagtgcttttttttttttttttttggttaaatcctgaatactaggatcataatcagccaatgcattcactcatcattattctatattttatagtatggctctggtgaacaagtatatgctgctgcctatttactcttaaaaagaccttcaattttcagccgggcacggtggctcacgcctgtaatcccagactttgggaggccaaggagggtgtttcacgaggtcaggagatcaagaccatcccggccaatatgatgaaacccccatctctactaaaataaaaaaaaaaaaaaattagccgggcttggtggcatgcgcctgtagtcccagctactcaggaggctgaggcaggggaattgcttaaacccaggagatagagattgcagtgagccaagatcgtgccattgcactccagcctggcaacagagtgagactccgtctcaaaaaataaaaaaataaaacttcaattttcatgtagaaattctaatttgaataaatggaaaattaaggctcatggggaaagttactgagaggtgacagcgtgctggcagtcctcacagccctcgcgcgctctcggcgcctcctctgactgggctcccactttggcccaccgctgcactgtgggatcccctttctgggctggccaaggccagagcccgctccctcatttgcagggaggtgtggagggagaggcgcgagcgggaaccgggctgcccccgctgcactgtgggatcccctttctgggctggccaaggccagagcccgctccctcatttgcagggaggtgtggagggagaggcgcgagcgggaaccgggctgcccccgctgcactgtgggatcccctttctgggctggccaaggccagagcccgctccctcatttgcagggaggtgtggagggagaggcgcgagcgggaaccgggctgcccgcggcacttgcgggccagctggagttccgggtgggtgtggacttggcgggccctgcactcggagcagccggccggccctgccgccccgggcaatgaggggcttagcacccggcccagcggctgcagagggtgtagtgggtcccccagcagtgcagcccaccggcgctgcgctcgatttctcgctgggccttagctgccttcccgtggggcagggctcgggacctgcagcccgccatgcctgaacctcccaccccctccttgggctcctgtgcagccacagcctcctggacgagcgccaccccctgctccacggcgcccagtcccatcaacaacccaagggctgaggagtgcgggcgcacggcgcgggactggcaggcagctccatctgcagccccggtgcgggattcactgggtgaagccagctgggctcctgagtctggttggggacgtgaagaacctttgtgtctagctcagggattgtaactacaccaatcggcactctgtatctagctcaaggtttgtaaacacaccaatcagcaccctgtgtctagctcagggtttgtgaatgcaccaatggacactctgtaactagctactctggtggggccttggagaacctttgtgtctagctcagggattgtaaatgcaccaatcagcaccctgtcaaaacagaccactcgactctaccaatcagcaggatgtgggtggggacagataagagaataaaagcaggctgccccagccagcagtggcaacctgcttggatccccttccacagtgtggaagctttgttctttcgctctttgcaataaatcttgctactgctcactctttgggtccacactgcttttatgagctataacactcaccgcaaaggtctgcagcttcactcctgagccagtgagactacgaacccaccagaaggaagaaactccaaacacatccgaacatcagaaggaacaaactccagatgcgccaccttaagagctgtaacactcaccgcgagggtccccagcttcgtttttgaagtcagtgagaccaagaacccaccaattctggacacattaccatttaactttcttctcattgtcataatattggaactgcgcctagattctcaaaatgttcatcttgtctgcaatcacttcaacagaagcttatattaaatatcaggtcatgcctcataaatacccccaaattttgagaacaaaaagcactgtatctttctattgtcacagaacttcctccagccttgatctgagaaccccaattaggctattcaataggttggctatattgggaaaggtaattgtaagaataaaatattcttaaaataagaagaataaaatattcaagaataaatttatcaaaagttgtttcaaacttctacacttaatacaaatttgctgaaagaaagtaaagacaattgaaacaaaaggagaaatatactagatttatgggctgaaagataatatttttaagatgtcaattctcctcaaatgtatcaatatatttaatgcaattccaaccaaaattccagaaggcatgacaagctgattcaaatagtatagtgctaaaatgtgatgtagtgtagagtagtggttaatattcagattctagactcagatgcttggctctaccattttctatctgtatgtatgacctttatccaaataaagttttactagtcactgatcttaacttctgatatttgcttcttctgtattttgatgtcaccatactttgtaaataacacttttgactctctgtaaactgatgtgttggtagtttttcaaatgggccaccaactatggtccagtaacatagacccaatatcaaaacttgaccctctctgaaattttctttacccatttctaaagagcctacttcgtagaattatgtcaaggttagatgagataatgaaagctacttagcctagtccctggcacatactgagggctcaacaaatatgaactatctaaaggcaaaaagagggataatagatgtcagtgtgatgcaaacagtgctttcatagctaacacaacattatatcgtctgaaataattaaacatgatcagttactggatctcagatatagaaaaggtcatctatgcaaatccaaaaacataactatattgggagaaagtaagctacttaacctatgacatatcagttaggattcaatcgggctaagggaatcactataacaaataagaaacaacggatttctcatagaagttatgcagttgtgggaactgataatgacatctatgaaaaactgttttctctgtgtctggtggtggatctgaattcatgaaatgtaagtagggcatacatatagagataaaaaaggtgggcatgaaatgggtgaaagcaaaggcaaattgtaatccacaagaataaacagaaacccacaaactggaaactgcctgcagttatctctcaatgcaactaaacctgacaacatggatgacctgcatttaaagctggcatacttgacctaaaagctttatttgtgcctggtccatgactcagagaagctgaaggagaacatccagcaagagttctggagcttcagacacagctgctgcctactgtcaacaaagtgagtctgtaaactagcaacaatgcataaaaatcaatagagtttttttcaatatttttcagtaagaccaatctgaactcctgtgttaatttatgatcctatttatactttgaacattaaatcttgtggtaaatatataagaataaatgcttcgtatgagtttgagacatcaagaactatcatattgataaaaaatgcataaaagagaaattcacattattaaatgcttattaggtatcaggtatatttccttacacatttcaccttattataataatcctcgcaattgcattgtaattttttctctaattttgtagtatttttatttaaaaattaggttcagaggttaaataatttccaaaggacccagaatatattgcaaaacttagatctaagcatgggggttcctgatgttaaagagtacttactttctactgtagtatgcgagaaacaataaacatcactattcaaaattttaaaaatatatatatattgagaactttctacaagcttgaacatgtttgtggcaaatatgcagaagcattgatgattagatggcttgaaaataactcattttaaaaaggcactccatccagagaagggaaagttgaaaggtaggatggtttccacatatctgaacgtttcttacttgtaggattgcatggttgtcaaaaagatgatgattatgtgattgacagaaagacacccatatgtacagacaaatgatacacattcccttaatgcagtaaaagatgcttaatttactattcacagacagctatacaagccaggcaacactccagcacacccagtcagagatgtgagccatgtcccctaacccttcaagtcttcatgaaatccccttgagctaatctgagtgaggattgtgtcacatccttcaaccttggtttgttattctcaaatattttataacctcctgctaattctagctcttcttgaaactttggctaggtgtttgacttctcagtaggtccaagatatttgtaaaaaccacagcacatggctgacttgaatttttccaggctcatcacatccgtagcttacctagactctatgcttgaccgtgatccattctacaaggagagcttccattttgaaaaatggatggatgaaacagagaaaatattcttaaactctgaaactgaaggtttaatttagagataacaagacatatgatagtgagacttttaagagatagaatgagagctatagaatctatatgacatgagtctttttaaatagaataggtcctttcaggtttactttgtgattttagacttctcatattacctccaaaattttattcatttacttatttaattattcatttagaagatgtttattgaatacccaccataacccaagtactgggctagatgtcaaaaaaaaaaaacaaaaaacaaaaaacgggagatttgatcacggagatttcaggaagaaagtgtaacaacctttcctgatttacattagtaaaatcatacttctacaactcatacttctacaactgacattatcatacttctacaactgacttttttttctatcagaacaattctgtaaaatctgtaatttgatacgttctctttctttgcgacactggtttctctacataattttcataaattcatgtgtaagttctttgtatattggctacaaatattgattccatttggatcaagttttgcccaccataatagcaaattattcatagaaaacacattttgaaaattatagaaaagttcccataatttttctcaaaatatctcaaacattttgatttgccatcagctactaatgatatttgaattttttattttctggttgaacaaaatgtagcagtgaggttttatgaaataattatgatgcttgtgcagtaacagaggcatttgtgactattttatatctttttttttacctctttaatcattttctttcaccttccggcataggtataagtattaaaccaaatgcctgccatatgctgcctactttacagatgctgattaacattgccctccttgtttcaatagctttctaggaactttcctaggtctacattaagggttaactagacctatatgtatccaccattcatatgatttcctctcactattctagtagtatgtaaatttcctgcttcaaattttccctatcaaacttataaagacaaaaagacaaatagttgcacaaggtttatgacaacaaaaacaacaaaaaaaagcagtctcccaattccctaaaggcaattgatttcaattattttcaccctttttttgatattttcttccatatgcctaaatatacattcagaaacctcttgagtttacagttttagctattatctgttgacttgttactttggatgaagaaaatgtatgtcgtttatatttactccaactcctttctatgtgcgactgacacacacacacacatgcactcacacccattttcctaacaatggccatataataatttttggtaagattaacattcactttcagcattatgaaaactgtaaatagcatcatagtttagttgtataatattccataatcatattcactgtctctttggttttagttgttgttgttatttaaatttctttctctacttaccgctctcctgttaaggatttctggtttcctggaccccatataagccttctcctctgtttacacacttcttttggtaaacacagattctagtgatttcttcaaaaagagtaaatgggaggcaagtttcttaagatcttgcatgtccaatgttgtacacttatatttgattaaaactttaactgggctataaaaattctatatgtcttctcagaatgattttcctcataattttcaacgcatttctatttttttctagttaccagagttagttttgagaagtctgatgctggtttgattcccaatccttttaatgaaatttattttttttcctcataaagttttagaatcttattttgggggcaaaggataccctttagactgaaaggcactatgaacagaatagtgcctttaaatctgaaaactccttaaattctgaaaaatgttggtaaataatttatttgatcattttctgcacttcatttttttctgtgatctctttaaaaatctctgatttttaaaaatattaacctcctacagtgacctaattttattaacttttttgctattttctgtatctttgcttattgtggggtaggtttgctcaagcttgtaatttaatccttcagatgaattcttcatccctcctatatttccaaaagcacttgaaagtacttctttcttttttatgttcttctcttcttatttctaggttgcagcagcttcaccatttatataaagatatgaattataaaagcttttttttaaaaaaaattctgctctctgaatttttaaaatgtttctgcaaaggtcttttatgctttgtttatttgtgctctaccttccatgtcctggcttttttttttcttcttcatatatctggggtccttggtggtccattcatgcttaaactgggtgctaagatgctgcttggatgctctgtgaccatgggctgtttctttgcagtgtgaggttttcaggctgaacaattttgagaggaccctaaaagctcaatactcctgggacattatctaccaaacttatgctctactctcctacctgggagatgcaggcctgactgatgctgttcttaaatttgaatagggaagggggccaagagtcttatcattcagaatttagatttttcacttaatctcaatttttggcatagcactctccaccatcagctgtgtgtttctttcgtatacattcatgagagattaaacctttggttttataccattctacggaatattatgtgatttggcttctagagatgggaatgtaaagtgtgttataacccttgtaacagaaatactgtccacataggagcaagtattttcaagcaaaattacaacagactcaatccaccaactgtgaagataattttcatgaacagttcagcattgtttactttcaagtacttacaccacaacatgctagaaaagttgctaaattaacataaaataatatcaggaaattttgggactataaaatgcaggggagatcaagtcacaaaaatgtcagattcttgaaaaattatcctaaaaattaggattattcccttgtaattctgtttttatgatctctgtgtgtctgcctcatctaggtactcaattcctataacttcaatggtttgaaagattcacacttggttccttactgctaaatccttttatatctccctcctagatattgttttttttttaatctccaaggcaatatcaactcttcctctctctcattacgtccgtcttaatgaggaaatgtttctgtgctctcttttggtattagatttactaatatgcttaaagcagaaaaaatccaccagtactcacaaccagaggacaaaaatctctctcctcttcgagacaggagaatactcaacccaggcccactgcagcatcctttcccagcaaggttaggtatattttataatcacctgaattctatttcttggaatgtgttcaatcagaggggtgtgcaaatcttaacctatctttcttcctgaagtctctcctctaggattaggttcctgatgcagttaaataatatatatcatggcttctggtattctttcaggccatttaaagtgttctttaagaaaggaattcaaatgctgcatggagataaacaactcatgaatgtattacagggaactgattgggaaataggaagagtgctctctctccctctctctctctctctgtctctctcacacacacacacagctgcctttagcagttaaattatgacaaaatgcactttagtagctcccagttgccatgagagtgtaaaagaagacaaatgatctctaaggtaaaagggtccaagtcaaataaaatcttacagattaaagtcaacacatttacattcaaatgaaatggtatccaggactagctctgaaagtacaggtgttccatactctctatgaccagccttaaccaaacaaactgtattcagagcatcacagttcaatacttccagccaaactcttatttggttctgccagttacagctttcgcttacaattgggtaagtaaatgtttgaaatatcaaagaaattcacatagaaaaggcaaagggtatttgagagaggcacttctgtttgtacctaggctggtgggtgagggctaggaatcagagtttatgccttttcatggagtgacttgaaagagaactgaggccctgacgctagatgcttcatagacgttagggtctgtggtggttttctgtcagcagcacaaatatgaataacttattattctgcacacttatttttttctttcttcttctctcacctctcattctttctccccgtcttttccatctatctctactcaatgcctcgtcttctgtgatagaaccacaagcacatagtgagaaaagaacatgatttaaaaaaggaaaatcagaagaatcatttaaccccagtgagtctaatttccactatgtaaaatgaggataaccatgacattattttaaggtctaggttgaggatcaaatgtgattatattcgccaactcatcttatactaaacagatgttagttattaatattcttttgagagtctgaaggaaacaaggatccacagacataagaattgcagttaccaacctgatctcattaaggaacatagatgtctacatttaaacacatttttttaagaataatttttaagttggattcacttctaatttatagatagagtttggaaaatgtttggcccaataatattaaatactaaccaaattttgttagtatttcctatattactaatataggaatatagtatagtaatatagtaatattggaaatatagtaatataggtgatagtaatataggaaataacatgaagatgaattttaattaccaattctttcctttaattcatcaaaaagatgttaattataatagctaccacttctcaagtgcttactgtgttccaagctctgttctgatttatgagtattatctcattaaatcatataataactctatgaggtatcatctccactttactgataaagaaactgaagaaaagcaatagagccagggttagaacaaaagcatcagatcctggagtctggattcatgataaatagactagaagacctctccatttgactgtgcatgatacactgaggtcatcgttaatcagagaaagttggattaaaagcactcttaagagaggatctagtctatcctcccctcaagtggagaaattaaggccttctacaacatccctaaagactgtcactcagactttgccgggctgacatgttcaaaattcagctgccattctacttggtcagcctcagccatctctgggtagtatcaaaacaagatatataggtttcctggcaactgaaacagtaaccttggcctaacagccccagtccccaaattttatttctctcaatacgcaaatacatatctttccttccttttgcaaataccttcctcttgcctttcacaagataaaaaaaaaaaaattaaagcttgtttcctaaggccaaaaataagttagcttcagaattggatattcttctatcattttcattttcttaaatttctaccccctccatttcttaaacaagtgaaggttgcatgtgtttttagaaagtaaattaaaatcatgttcctttctctttatctttttggaaaatgtgagcatcctctttaagaaagactatttgtgaagccagggtcaaaggtctttattctaagttcaactctcagctggagaaccgagatcccacttctctgggctacgccaaggcagcagaaggtgagtgacaatgaagtcaagcatcaaggacaagagaggcaccttattccacatgctgtttttctcacaggtaaagtgagaaatcaaatcctctgctctccctgcagcactgtcctctctgaacatgacattaacttccacaaaagaaccttgtggtaaagggggtgattagctagataggccttaacagctgggctccaggagattgaagcgaggtggaggaggggcactctgaggcactgggtcttgtagttctatcaacagcagcagcagcagcagatgaaaagctcctagaggtgggggcaggggagagcccagattgtaaacatctcttgcctgttgcctagaagcagtggcagcaaacaatccaaagactgctcctagattttcaaaatttcctttatatgcagggctctgcttctttttaaaatatgcggccattttataaggtcatgagcacacatgcgacgggtgcatatatcataataatttcctagccaccatgtgtaattgcgtacataaagtggtcaattattgcttaacaaaaccttgttaatgtcagtacattaattccgaggcttttataaaccttttaatgactaccttgtattaggtactcatatttgtgagaatcaacaaaaacaaaaaaaagatgcttctttgtttgtggggaaaacttgataattcctgaatgataggtttctgaaataagctatgatgaaggacaggagtaatgtattataaattggttgaaaatgtgataacagtaatgttataggctgtcttggcagaaatgaactgcaaatatcacacacacacacacacacacacacacgcatggacagagcaagaaaagggcagggtagtaacagtggaagattttaattatcttgccatagcacaggattacatcaagtggaggaagtgaggctggatctggtgcaaagctgatttctaatttaatgtgtacatcacccgaaaagggaggaaagaatgctaggtttagaattaaataatatttagggttcaaaggagagtataggaagccgtgattaaatctcattaagcatatgatttaatcccaaatagaagctagaggtgtttagagacaagaaggaagtgtaggaagacaaaataaaatacagcatataatcattaattcagaaaaagacaagccactgaattaagttcagggtaaatagcagggaagtggtttttataaacacggtatcacccaaaacaccattcccactaataagtgataaatttgtttagcattttacaagaccaaagtagaaaagtaaagcttctagaaagatgtagcacagaaaagcctcccccttcctttatcaggatccacaatttttaaaggaatagaaaatcaaatcctcaatacttgaaagggaactctaaaaaggacccaggggagaaaaagaggtaccgaaattaccaaattggagggcaaacttcttttatactgtaaaagcatacaacctagccaggcatccatagggccattaagcggatgagtgggaaggcagggacggatgaggctgcagtagtcgaaagcctgaatgaattctctgcctgcgtattttccaatgaagctgaaggtcacgtcccggaaactggatacattttcttgaggggaaaagtggaatgttaaaaggattttatgatcacacaagagtagatagttgagcaattagaactattaaaagttgacagggcacaagacccagattaagtacgtcatagaaatcttaaagaagtggaaaggaaacaggaaatgccttcagcagcatttcttgatagcttgttcagaaggagactgaagaatcagggctggtagctgttctaggactagttgtttaaaagaaatctttgggatctttagaaatctagccagcaataatctgagtcatggttgaaaagcagatagtgctgaccatcagaccatcattttgcttttatagaaatacagaatttggtgaacagttaacataagcttgataattcaaaaataattgacattttcacagaaatagagcatttttgagctattctgcacaggtgaaaatggagttcacttactgcttctaaatttcttacgttatttattagagacagtgcctctagaatttgtctgcattaagtgaaatagtggaagagtaaacaaaaataaaacgaaactgcccctaaatgcaagggaatgtgtactgtgaaatggaaaggaaagatttttggaaattattgtcctgatgattacttttattatcactgccatcatcaagctgcaattatgaaacacatactgcatccaacatgctagcaagacagaaggctgttagaggagtcactctctcctgtctcaaggtctggatttcacactgattcagctcaggccttttcatcactgtcttaccaactatcatgtcagaacatcatttttaaaaacaaaaattaaaaacactccactttctgaggatgcgcttagaataagcaactgctccttccaccaacctctagctacatttctatgaacaaataaaaacaatgtaaatagtcacaagattgtggagttaaaatctaagggacaaacattattacttaatgttttttaaccacttagaaactacagtttcttttccttttgccattcctccctctctatctcccttccttctttgcttcttacaaatgtctattgaatttcctagaccaaactgtaagatttaacaataaaaatatgcaaacacgttattactgccctgaagtaatccccaatctaatggcaatgacaacaatgtgattgaggctaaaatagtgtaaagcccagggtgtccagaactactgaaggaagtatataacacagccatggtcaagtcaaggagtgaatggggcatagaagaaaacagatgttaaccaagtgaagaagtgaggacaggtatttcaaataaaaggagtatacttaccagagtttagaggtggaacaatgaagtaaacttcaaaatgacttgaccagattatttctctaatttttaatttttatactcttttctgccaaaccctaccacactaactgaactgcattttcttatattttcttaaaaacaaaagagcaaaagcaggaaatgaaacacagtgaataaaagctgggtgatttagaaaaaggatatactaagagtgttcgtaaatttcagaaatatatgcatttttgtttatgttttcaattaatgacccggggtggggggagtcatataatgcaaaagtgaaatttctgttgcttacaaaaaaaataagataaaataaataagggtagtgaagaaaggtggcaacactacatgactgaatatattaggttctgtggacctggaaagaacatgtgtagctcatgcaggaaagtgggaaatcatattgctagggctagccataatcatatttcataaagatcacagtatataatatgaaccagagtacaagcatagagataattatatgaagctcatcatgaaaataatactgtctaatctttttcttatcaagccatgtcattagaaaccagtgaaattattcttgcagatgttctaaaaatcactcgaatcacctctatttctaaagctgtattgcaactcaagacttgaatgtgcatccaatgttcctcttcctatgcctactgcagagtcctagctgggaagctggttctgctggctttcactttcttctttacttaccttcttcacctgaatccacgagtcactgtactaactcatgttcctcagtctcagtgaacatcaccaagcagtactcccagaaaatggaaaacgcatctttagtatccccagctatttttttttaacctcctccacatttttgcttaatatttctctattttccctgctacagtgcatcaaactctgatatttgggggaaatacctctaataataatttatgcatagtatgtggtgtggcaaatttacctgagttatttgctattatgctgtcactaattataggagaaaaatctttagtcctcagagagaggaattttagaaacactggggcagaggagacagatctgcctaaagaaaaggtgcgaacaaggaaggggatgctatgaagtctatagggactctgtaatatattagaaatactgaacatctggtacctgattggccacaatgctggagtacagactgcggcacgctggccactgtttacattttagttgctggatcacaggatgtccacagttgtaaataataatacataaaagtgacatttcatctacctgattctgcaagtaggctctctactgaaaggaaaagttctttttgtatcccacctataattatttctatacttaacctatgtaattgcacagccagaagttggttataccaaaatactaaattttattaaatgatatttattgaatgattcattgattgaccatttgcaagtaaaataagatctaagtgttgcttacattctcagaggcaatagaagaatatagttatcaattgagcaatacatatatgtaattagtaacagagctgatttcagcaaattagagttctgggccaagaactgcctttgacttgctatctgacctttggcaaatcaattaagattcatgtctatcggctttccacacctctaaaaatagaaataagaatttcttcttctccaacaattgctcaaatgtaagagataaacattaaaaataacttcgagataagtactatataaatagtattactttaaatcagtgatacatataccagagccctataaactcttgtgagacacatgaaaatttctggaaacaatacggtagtctctccttatccacagtttcactttctatagtttcagttacttgtggtcaaccttggtctgaaaacattacgagatattttgagagagacgctattcacataactttgattgcactatgttgttataattgttctagtttattattaattattgttaatctcttaatgtgcctaatttataaattagtttatcataggtatgtatgtataggaaaaacatacggttagatattatcctcagtttcagggatcacctggggggtcttgaaacatgtcccctgcagatggggtagcgcactactgtactctaataaattaattaaaaagagtctttcttggaatgaatgaagtctaaatccaaactactaaagtgaaaatatttgagatattgatacaaattttggcatggtttctaaaataaaagatcctagtatgagagaaaagttgtcacttattgtcaacatctctgttatctctcccttgtttgcaaccctggctgtcactgctgctgctaaggccaaatccagagtgatgcctcactatatgtatactggtttcttcaaaatatagttttcaaaatatagtttttcatcaagcatataatcgttccgcgatctctttccaatttcatgtacactttctttctacatagagatactggatatttaactatagttttgtcaagcaacaataatttatttttagaaattgaacaatatttatatatcacataaaggaagtgatttgttcaaaggttaaatctaggtaaataaaaaattatttatatatatttcaaaactattttttcaaattttcaaaattgttttcaaaacagtattttaaaaaatatataaattgttcataatttttagcatctggctatagatagatagtctatcttcaacttatagttccaaatgtcaattgttatgaaaactctgagactgaggaaaaataagctccaatttctagtagaaaaataaatcagcaatttttttttttaaattgctaggaatagtctagaagagatgaaaaaaatggtctggagttgattttaagccttttaatgtgagtgaaaattgattttaggtccattcacacacacacacacataaagatttgtgttgtgtgttatactatgttaaacctgattttaatttgtatgtgatattgttgttagaacagctttggaattaaatatacaccgctgatgtagtatagttaaatctgtatagaatatatagtgaactgtatttagatttaacatctatgagtactttgagcaagactccataggactcactttgtaaactctaaatctaaagttacatcacatttttcagactacgtaacatttttgtctttttagatgtctgaagtatttaaaaatataccttcacatgagaagtttaattttcacatatgtccagtctcagaaagaccccagattaataaaggaaggttaaggaggggtctaagaggtaatgttttagtcccttcagctgctataacaaaataccatatgggaggcccaggcaggagtattgcttgaaactaagagtttgagatcagcctgggcaacataaggagatcctgtctctacaaaaataaaaaattaaaacaattagccaggtgtgttggtgcatgcctgtagtcctagttattcaggaggctgaggtaggaggattgcttgagccctggagtttaaggttacggtgagcttaacccattaattttgcagataaaaatgctgaagttcaaagagacttaattaaattaataaattacccttggtcactcatttagtccctaacagtcagtattatgacaaagttttctgatgttgtgaccatttaaggtcatagtttatacaaaacagccacatagtgtttacttctttttctgaaattctttgctttgcatcatttgaaattgtaaaggtaactttaattttaaaggacgtgttttatccctttaaaacttaaaaatatcttttttaataaatgtggcttcctttaaagcaatttaaggcactcatggttgtaaaaatatatattatatataaagctatgtctgtaaaaaggttttgatcttgtgttctcattccattttgttgatttgttgaattttcaggggcactttaaagattttatgccttagcatgcctgtgcgtaaattcatgtctgacaattgtacatataaatggttccaaaatatcttagtgttacacatagccatacatataccattataacggtatatttagcttgttaagaaatgatattgattatgataatgtattttagtttatgttttatatgagcagtaatttaaaaagtttatcacatttaggaagcaatggggcatagtgggagggaagagctttggagtcttaaacacgtggggaatcaatcccccatcagcatctgactgacaatcaaattgttcagcctttctgagactcagtttccttatccgaaagttgaatttaaacctacctagaggtattagaaatcttatgtaaagcacccatattattgaaggtcacaaaagacatttgtaataaagcttattttttaatacaaagctaatttttaaattttaaaatatttaactgacaaatgaaaattgtatatattcaaggggtataacattatgattttatatagatatatattgtgtcatgattaccacagtcaaattaacacatccatcaccgcccatcattacttggtgatatggtttggctctgtgtccccactcaaatcccatctcgcatggtaatcctcacatgttgagagagggacgtgtaatccccatgtgtcgagggaggtaggtgcagtttcccccatgctgttctcatgacagtgagtgagtctcatgagatctgacgggtttataagtgtttgacagttcctgcttcacacactcacactctcttctgccaccttgtgaagacagtgcctgcttccccttctgccatgattgcaagtttcctgaggcctccccagccatgcagaactgtgaatcaattaaacctcctttgtttctacattacccactcttgggtactatctttatagcagtgtgaaaacagactaatacatttggtgtgtgtgtgtgtgtttgtgtgtgtgtgtgtgtgtgtgtgtgtgtagtaaggatacttaaaatctgctcttttctaaaatttgaagtaaacatattacaatattattaactctagttaccatatggtacattagatccccagaacttacacgtcttataactgaaaggttgtagtatttgactaacatctccccattacccacttccacacacccagatgctggaaaccaacactttactgtttctatgagtttgacttttttagattctacgtatgaatgacatcatacagtgtttttctttctgtgtgtagattatttaacttaggatagtgtcctacaggttcatcagtgctattgcaaatggcaagatttccttatttttatgattgaataatatttcaaggtatgtatataccacattttctttacacattcaaccactgatagacacttaggttgtttctatatcttggctactgtgaatagtgctgcaataaatatgggggtgaagataattttccagataccaatttcatttcctatggttgtacagtgtacacagaagtgggattgatgaatcatactatagttctatgttgattttttttgaggaaactccatactgttttacataatgtctataccaattcacattcccatcaacagtacactagaattttctctacatcctcaccaacactgatctcttatcttttttataatagtcatcctaacagatatgagatatctcgttgtttcaatgtgcatgtcctgatgattagtgatcttgagtacctttccatttagccacagccatttttatgtctttgaagaaatgtctattcagatcctttgcccattttttgttttgttttgtttttgttttttgttttttgagactgagtcttgctctgtcacccaggcctgagggcagagatgtgatcccagctcactgcaacctctgcctcccagggttatgtgattctcctgcctcagcctcctgagtagctgggattacaggtatgtgccaccatgcccgtctaattttcatatttttagtagaggcagggtttcaccattttggccaggctggtcttgaactcctgacctcaagtgatgcacctgcctcggcctcccaaagtgcttggattacaggtgtgaaccactgtgtctggcccctttgccaatttttaagttggattattattattttttgctactgagttgtgtagttctttaaatattttggatattaacctttaccccatatacagcttgtaaatattttcttccattccataagctgtctctttgttgattgattcctttgctgtgcagtagctttttagtttgatgtaatcgcatttgtctctttttgcttttcttgccatggtttggggattatagcaaaaaaaaaattgtcaaaactaatgtcaaaatgcttttactctatgtcttcttttagaatttttatgatttcagattttacacttaatcatttaattcattttgagtgaatttttctatatggtataagacaaacattttattctttttcatattcagttgcaatgaatattcagttttcccagcaccatttattgaagagacaatcacttccccattgtgtattcttggcactcttgtcaaagattagttgactatatatacataggcttatttatgggatctcttttctgttccattggtctatgtgtcagtttttatgccattactatactgttttgattactattgttgtaacatataatttaatatcaaggagtgtgataccttaagtgttgttattttttttcaagattgctttggctatttgggatcttttgtgatgttatatacattttagaattttttttgtatttatatcaaaattttgataggaattgaacttcatcagtagatcgcttttggcagcatggactttttaacaatagtaattattttagtgcatgaacacagatttctttccatttgtttatatcttcttcttcaattgtttcatcaatactctataaattttagtgtacagatctttaacatccttggttagcttacttcctaagcaatttattctttcgatgctattataaacatgatggttttcttaacttcttttttggatagttcattgttattatgtagaaacactgcagatttttgtatcttgatttcagatcctgtaacgttactggatttgttcattagttctaatcatttcattccttagggctttctgcatacaagattatgtcatctgcaaacagaaataatttaacctcttcctttcctatttgataccttttattttttctcttatctaattgtcctggctaggacttccagtactatgttgagcagaaatgtcaatagttggtactcttttccttccttccttccttccctttgtttctctttctctctttctttcttttccttccttcctccctccctccctccttttctttctctttctttcttttcttttttctcttctttttctttatttcttcctttctttcttttctttctttcttttctttcttcttttgtctttttcttttcttttctttcttctctcctctcctctcctctcctttcctttcctttccttcctcctctcctctcctctcctctcctcctttccttttcttttctattcttttctcttcttataggcagggtctcactctgtcacccaggctggagtgcagtggcaaaatcatagctcactgcaaccttaactcctgggctcatgtgatattcctacctcagccttccaagtatatgagactatgggcatttgccaccacacccagataatttttaatatttttttttgtagagatattgtctcactatgttgcccagcctgggctcaaactcctggcctcaagcaatccttctgccttgagttcccaaattgctgggattacagccatgagccaatgtgcacagccaaaaaattatactctcatctttttcctgatcttagaggaaaagctttcaactattcactcttgagtattttagatgtgggcttgtgttatagggcctttactgtgttgagatacattccctctatacctaatttgttgagaagcttctttttaatcttgaaaggatattgaactttgttgaacattttatcttttactgagataatcatatggttttggcctttcgttctgttaatgtggagaatgacatttttggatttccatatgttgaaccatgcttacatcccaggaataaatcccacttgattatggggtatatactccttttaatgtggcactggattagatttgctagtattttgttgaggattgttgcatcaatgttcatcagggatattggtctctaattttttttcttgcggtgtccttatctgtctttggtgtaaggataatgctggtcccatgaaaggagtttgaaggtgttacctccacttcaaatttttggaagagtttgaaaaggattgacattaattcttctttaaatttttagtataattcactcatgaattatacttctggtcctgagcttttcattgatgaaagactttttattattgatttgacttcctgacttgttactggtcttttcttattttctatgtcattgtgattcagcctacgtaaattgtatgtttctaggaatttgtatcttttttctaggttatccactttttcagcatagaattcttcatagtaatctcatgatcatttgtatttctttggtatcaattgtaatgtcttctttagtttacaattttatttatttgagttccctctctatttttgttagtctagctaaaggtttgtccattttgataactttttcaaaaaaatgaactcttcaatttattgatctttctactgcctttctattctctgtaaaatttattactactgagattttttattttcttccttctgctgactttgggcttagtttgttcttctttttctaattccttcaagtgtgaagttagattatttgagatctttcacttttttgttgttttttttgtgtgtgtccagtttgatcatttaagttgtaatttttttacatttcaatattttggggggaacaggtggtgtttggtaagatctacctttttcttaatggaagcatttatcactataaacttactcttcagaactatttttttgctgcatcccataagttttggtatgttgcattttcattttcatttgcctcaatatacttttaaattttccttttgatatcttcttttactcattcatttttcacgagtgtgtttttacctttccacctatttgcaaattttccaaaattcctcctggtattgattgctagttttataccactgttttcagaaaagatactcgatatgatttttgtcttattaaatatgttaagacttgtggcatgatatatgatctatcctggagaatgttctgtgtgcacttgagaagaatgtgtattctgctgctgttggatggaatgttctttgtgtgtctgttaggtcaatttggtttgtagtattagttaagattactgcttctttggccaggtgcggtggttcacacctgtaatcccagcactttgggaggccaaggtgtgcggatcacgaggtcaggagatcgagaccatcctggctaacacggtgaaaccccgactctactaaaaatacaaaaaaattagccaggcgtggtggcaggcacctgtagtcccagctactcgggaggctgaggcaggagaatggcatgaacctgggagacggaggctgcagtgagccaagatcatgccactgcattccagcctgaatgatggagcgagactctgtctcaaaaaaaaaaaaaaaagaatactgcttctttattgattttctttttggatgatctatccattgttgaaggtaagatattgaagtcccttactattattgtattatggcctatttctctcttcagatctattaatattaatatttgctttacatatttaaggtactccaatgttaggtgaatatatatatacatatatatgtgtgtgtgtatatatacatatatatatatgtgtgtgtatatatatacacacatatatgtgtatatatatatatatacatatatatatatatatatacaccccttgtagcatttcttataagttaggtctcatcaaaatgaactcctcagcttttatttgtctgagaatgtgtttatttctccttcatttctgaaggacatttttgccaagtatagcattcttggttggtaggatttcttctattagccctttgaatatatcatcccactgtactctcagcttgctgtttcttctgggaagtctgttagtgccttatgggagtttcattatatgtgattaatctatttttccttgcttctttcaagattctctctttgtctttgacttttggcaatttgattataatgtgtctctgattgtttttctttgggttgatcttgtttggggagattaatgaatctggatttctatatatctttacaaggttttaaattttttcattaagtatttagtttcttgccactttctctcttttcttcctggaacttccataatctatatattcatgtgctttatattgtcccataggcttcttatgttcttttcactcttttaattctatttttcattcctttaacctgtcttcaacttcgttaattttttcttctgcatgatcaagtctgctactggaggtctctattgaatttttcagtcttatcattgtattcttctgttataagatttctggttggttcttttttatgggtttttttaaattaaacttttctttttgctcatgcattattttcccaattttgtttagctgtttatgtttttgttgtgcctcattaagcttctttaagataatacttttgagttattttataggcaattggtagataatcatttctttggggtcactgatttgagctttattagtttcgtttagtagtgtcatgtttgcctaattcttcattatccacatagccctgcttggtgtctgtgcattggaaggagcaaacacctcttactgactttacagactagtttcagtatgtaacaccttcttctgttgggtccccgggcttaggattgcctctaggatagtggtcacatggagttggagctaggtcatctagctgctgctctgtctgtcatgaagaccacagtttgaaagcctgttgacaaggactcaagtagacattgatcctatctggtccacaggtggactagactgactccagaaccttggtcagtagagctaccactaggagaaatgttcatttcatggtcctgttactaggttcacatagatagatatggcttcctccaggtccctgggaaggctcccactgggtcaatggtgggtcctagatcaggcagtacctaccctggaccatggttgagacaggctagaactgagtcacagggctgcttcaaggttcacagccaatatcaatgttgccttgccttcttgtggggacatggatggggatatctcctggtgggtccctggataggcaaaactgctctcagacaacagatacaaagggttggagctgagttacagggatattttagggttgatagtagagactaaggttactgggtctgtcatctgaggcacacgtgggcatgtctcctcatacgtaaattggcagcaagacaaaggccaaatggggtggtaactgaacccaaaggagatggtttcatttacctgtatggaactgaggcccaggtcagcacacctgccacctgggcataagcctgttctctcaaaatgaccctcttaggacttgggccctaccagggttttataacctcctatgtgaatctcagcactcctacagagatgcttttgtctataaatgactatgataatattgttactgtgaagggaaaggagtgagggagtctcttattctgccatcttgctctgagataatttattttagcttatttttaaattaaagtttacataaagaatttataagcaatgctttaatttcagagaactccaattaacctataattttctccgatttttgcttgcctaattgctaactgttaggataatagttttcagtatcatcttatttcatagctctataccccaggaaagaataattctcagtgaaattctgttctcctttgagaagagtaggaactttcagaaagaggatatactatgtattagtctattttgtgttgatataacaatatatcacaaactgtgtaatttagaagaacagaagtttatttctcacagttccgggggctggaaagtccaagatcaaggcattgacaggtttggtgtctggtaagggattggtctttgtttccaagatggtgccttgaacactgcatccttcagaggagaagaacactgttcctcacatggcagaagtatagaagaggctgaactcactctctcaagttttttctatagtagcattaattcattcattaggatacagcactcatgaattaaacacctcatagcaggtctcaattctcaacactgtggcattggggattaactttcagcatgtgttttggaggggacaaaagcattaaaatcatagcatagtatatatttcatatttaaggttaaccaactcctttcacgtgcacacacaaccagattggaaataattccaaaactcttaaatttataaagtttcttaaaaatatagttagtcatccaaactttaatatcaatgcaaacaatacatgttgctgagaatacaggtattagctatttatatttccggagaagactgaacaactgacaaaggaagatacagtagctatctccaactatttgaatggctgtcatgctgcatcagccagggttgctagttgcaagcaacagaaatggactttgaataattgaaacagaaaagcaaattatgaaggttttggatagctcacaaaagccacaaaatctggcaaggatgcagaaccaagcttggaaaggcttagtagtagccaggattttatcccaaatcatcccacaaaaccagtccaatgagcacacactactaccaccccagtggacatctgatctctcagctcgtgctgccctcatcctggggctgaactctgaatactatcactgctctattgtactgctatccctagaaacacaaccctacaacctctctctccactgtttcctgctacagtgcatagtctgtggtgtgtcttttcttgggtgaccagcaccagatttaaagttcagagccaccacatctgtttggttgagctatgaaagactgagaataaatatttctgtctgtgcctctccccaaccccctaaaaacctcacaattcagtgaattctctaaacacaggaagagttcaaatgttgaacagccaagaaaatatacaaaatatccactacataagtggaagagaaagcagagtttatctgagttgttacaacagaaaggtgaactagaaagttaaatgtaagagggttgcagatttgaaaataagaaattttctgcagaatacacttattaaataataaaataattgctctagaaagttgcaaactccttgcttctactggactttaagtgaatgctgtatgaccataagaaaagagtactgtagaaaaaaaactgcagcttaactcaaaatgtctattattctatctttctgttgaggtagggatttttgcctcagattatgttttctatgggtttccaccacattctaaattatggtcagattgcaaatatatctgggtgcccagaatagccagagcgccccaccttcttgtgcatactcagtcagcttagcaaacacccagctgatcccaggcagctgaagaaatcacagtttttaaagtctgctatgatataggaatgattaggaagctgattctatggatgtgaaggtcattgtttttacaaacctcatatatatttatgtggcatatatacacatatatagatctccatctctctataatgcacatacataatatatgacatgatatgtatgacatgtgagatatatatgtacatataatatttcctatttaaaagcaaaagtgatagtaaggtagatctgcaagcaggtagtatatattaaaaataataacaatacaacaaatggatcacctattgacatatatacaaaaaagtgcaatcagacccctgatttatagatgttactgacatctgctagcatttgtaattacttatgcttctgaaatttattaacaataataatggcgctgttgatgttaataacatagttgtactattatctggtactctttcaagcgtcaagtacacacataccttgaagatattgcaatttagtttcacattttcacaataaagttaatattgcaagaaaatgaattgcatgaatattttggttacctaatgcatataaaatttttgtttatattagtctgaaacatatgcaatagcattatatgttaaataatgatatagatatatcttaatttaaaaacactatttcttaaaaaaatctaacaatcatccgagccttcagggtgtcataatatttttgctgttgggtggtcttgccaccacgtttatggttgcagactgatcagggtggtggttgcttaaggttggggtggctgtggcaattttataaaataagaccagactgaagtttgttacattgattacttcttcctttcatgaaagatttcagtgtagcttgcaaagagctgtttgatactattttacccacagtagatctgctttccaaattagagtcaactctctcaaacactgacttgccttctgagctaactttatgtaatattctaaatcctttgctataatttcaacaatgttcacagcatcctaaccatgagaatattccttcccaagaaaccatttcttttttgttcataacaagcaacccttcctacattgaagttttattatgagattgtagtgaaccagtcacatatttaggctctgcttctaattttagttatcttgctagtttcatgccatctgccgttacttcccccactaaagtcttgaacccctcaaggtaatccatgagtataaaaatcgcttcttccaaaatcttgttaatgttgatattttgaattcctataatgaatcagaaatgttcattgtttacattttaaaaattttggaaggtacatactaggtatatatatttatggggcacatgagacgttttaatacaggcatacaatgtgtaataatgacatcagggtaaatggggtatcaatacctcaaacatttatcctttgtgttacaaacaaattatacacttttagttatttttgaaatgtacaattaaattgttattgactatagctgccctattgggcaataaaatactaggtcttattcatagtttacaactatttttttgtactcattagtaatccccactttctcactaaaaacccccatcactatcagcctctggtaaccatccttctactctctatctccgtgatttcagttcttttcaattttaattcccacaaataaataagaacatgcaaaatttgtctttctgtgcctggcttagtttacttagcataatgactgccagttccatccatgttgttgcaaatgacacactctcattcgtgtttttggctgattagtacaccattgcatatatgtaccacattgtttaatccattcatctgttaacatacacttaggttgcttccaaatcttggctataaggaatagttctgcagtacacatgagagtgcagatatctctttgatatattgatttctgttcctttgcatgtatacctagtagttggattgctggatttatggtagctctatttttagttatttgaggaatatccagactgttctccatagtggttgtaataatttacatttccaccaatagtgtgcaagtgttatcttttctccccatccatgccagcatttgttattgcctgtcttttgggtaaaaaccatttaaacaaatatcattgtagttttgatttgcatttttctgatattaaatgatgctgagcatcttttcatatatctgtttgtcatttgtatgcctttatttaagaaatgtctattaagatcttttgtccattttaaaatcaggttattatattttttcctatagagttgtttgagctccttatatattatggttattagtcccttatcatatgggtagtttgcaaatattttctcccattatgtggattcactcttcactttgttgattcctttgctgtgcaaaaactttttaactcgatatgatcccatttgtccacttttctttagttgtctgtgcttgtcgggtattactcaagaaatctttgcctagttcaatatcctggagagtttcaccaatgtatttttgtaatagtttcatagtttaaggtcttaaatttaagtctttcattcattttagtttgatttttgtgtatggcaagagatagggttctagtttcattcttctgcatatgaatatccagttttcccagcaccatttattgaagatactgtcctttctccaatgtatggtttggcacctttgtcaaaatgagttcattgtagacatttggattttttttttctggaatctctattctattctgttgacctgtgtgtctgtttttaggtcagtactatgccgttttggttactatagctctatagtataatttgaagtcaggtaatgtgattatttcaactttgttctttttgcttagcatagctttagctattctgggtgctttgtggttccttatacattttgagattgatttttttttctatttctgtgaacaatagcatctgtatttttatagggattgtactgaatttgtagattgctttggatagtatggacattttaacaatattgattcttccaatccatgaacatggaatatctttttcattttttggtgtccccttcaatttcatacttcaatgttttatagttttcattgctggaatctttaacttttttagttaagtttattcctaggtatattattttatttgtagctattgtaaatgggattagtctcttaaattctttttcagattgttcagtgttgacatatagaagtgttagtgatttttatatgttgatttttgtatccagcaactttactaaatttgtttatcatttttaatagttttattgtggagtctaggtttttccaaatatgaaatcatatcatctgtaaacaaggataatttgacagctttctttctagtttggatgattttattttattttcttgtctgattactgtagctaggacttcaagtactatgttgaataacagtggtaagagcagcatccttgtcatgttcctgatcttagaggaaagtctttctgctgctccccgcaccctgcccccaattcagtatgattctacctgtgggcctgtaatatatggcttttatttattttattttattttatttttttgagatggagtcttgctctgtcacccaggctggagtgcagtggcacaatctcggctcactgcaagctccgcctcccaggttcacgccattaccctgcctcagcctcctgagcagccaggaacacagctgcgtgccaccaaacccagctaattttttgtattttttagtagagatggggtttcaccatgttagccaggatggtctcgatctcctgacctcgtgatccacccgccttggcctcccaaagtgctgggattacaggtgtgagccactgtgcccggcccatatggcttttattatgttgaagtagattctttctataccaagttttttcaggggttcatcatgaagggatgttgaattttatcaaatgcttttaagcttcaagaaaaatgattatatagtttgtgtctttcattctgttgctatggtgtatcacattgatgggtttgtttatgttgaaccttcttgcactcctgggataaatcccacttggtcatggtgaataaaatttttaatgtgttgttgaacttggtttgctagtattttgttgaggatttctatattaatattcattagggatattggcctgtagctttctttatttgatgtgtctttttctggttttggtatctggctaatattggccttatagaaaaagtttggaagtactccctcctcctctattctctggaatagtttgagtaggactggtactagttcttcctatatgtttggtagaaattggcaatgaagccatcgggtcctgggcttttccttgctgggagactttttattatgactttgatctggttacttgttattagtgtgtctgggttatgaatttcttcacaattcaatcttggtaggttgcttgtgtctaggaatttatccattttctctagattttcaaatttattggcatatagttgttcatagtagccagtaatgatcctttgaatttctgtggtatcagttttaatgtctccttttttacctctgattttatttatttgggtcctctctcttttttcattagtctggctaaaggtttgtcactttgtttatgttttccaaaaaaccaactttttgtttcattgatcttttgcattgttttcttcatttcaatttcatttatttctgctctgatctttttttttcttctactaattttggatttggtttgctcctatttttctagttttttaagatgtattattaggttatttatttgaagcttttcttcatttttgatgtaggcacttatagctataaagttccctgttagtactgttttgctgtgactcataagttttggcatattgtttcttcattatcatttgtttcagtaaatatttcaatttccttcttaatttcttcattgaccactggtcattcaggagcatattgcttaattttcatgtgtttgtatggtttccaaaattcctcttgttcttgatttctagttttattctattgtagtcagagaagatgcttgatattatttcagggtttttaaaaaaatgttttaagcttgttttgtgacctaaaatatggtctgtccttgagaataatacatgtgctgagaaaaagaatttgtattctgcagctgttagatgaaatctttggtaaatatctattaggtcaattaggtctatctacagtgcagataaagtacaattttttaattgattttctgtctagaagacctctccagtgctgaaaatggggtgttgaaatctccagttatcattgtaatgttatctatttctctctttggcactaataatatttgatttatgtatctgggtgctccagggttgggtgcatatatatttacaagtgtttcatctccttgctcaattcaccctttatcgttatataatgacctttttgtctcttcttatagtttttgtcttgaaatctattttttctcttcttttttggtttccattggcatggaatatccttttccatccctttattttaagtccatgtgtgtcttcattggtgaagcatgtatcttgtagccaacagatcactgagtcttgctttttattcaatcagccgctctatgtctttttactgagaattttagttcatttacattcaatgttattattgattaatatgaacttacttctgccattttgctatttgttttctggctttgtggccttctcttccttcttcccatccttctctttgtcctttttgtgaagatgattttctctggtggtatgatttaatttcttggtttttcttttttgtttattggtcgtatgtttttgatttgagattacaatgaggcttgcaaatataactcattattttaagctcataacaaatttaaactgcttgcataaacaaactaacaagcaaaaagaaaactaataaaaattctacacttcaactttgccccctactttttaactttttgtttgtatttatcttatcgtattgtctatgtcttgaaaagttggcatagttcttatttttgagtggttcatcttttagtctttctacttaagatatgagtagtttatctaccgcagagtattataatagtctgtgtttttctgtgtacttgctatttattaccagtgagttttgtaccttcaaatgatttctttttttctgattgaagtactccctttagcatttcttgcaggacacatctagtgtgagtgaaattcctcagcttttgtttgtctgggaaattcttcatttctccttaatgtttgaaggatattttcaccagatatattattctaggataaaagattttttctttcagcactttaagtatgtcacacccctctttcctggcctgtaaggtttccattgaatagtctgctaccagacacattggagctccattgtgttatttgtttcttttttcttgctgcttttataatcctttaatggtttatctttgggagtttgattattaaatgccttgtggtgatcttctttatgttaaatctgtttggtgttctgtaacattcttatatttgaattttgaaattttctctaggtttgggaagttccgtgatattatcttttcgaataaactttatacccctatccatttctctactttcttctttaaggccaataactcttagatttgcccttttgaggctatattccagatcttgtaagtgtgcttcattgttttttattatttttcattttatctcctctgagtgtgtattttcaaatagcctgtcttcaaactcagaaattctttcttctgcttgatcagttctgccactaagagactccaatgcattctttagtatgtcacttgcatatttcagctccagaatttttgcttgattctttttaattatttcaatcatctctttattaaatttctttgatagaattctgatttccttgtctgtattatgttgaatttctttaagtttcctcaaaacagctattttggattgtctgtctgaaagatcacatatttctctttctccagaattggtcccttgtgccttatttaatttgtttggtaggtgacagtttcctgaatggtgttgatgcttatgattgttcatcaatgtctgggaattgaagagttaggtatttattttagtctgtgccgtctgggcatgtttctacctgtcctccttgggaaggccttccaggtattttaaaggacttgggtgttgtgatgtaagctgtttctgcattagggacaccccaagcccagtaacactgtgattcttgcatacttgtagaagtactacattggcagccttggataaaatctggaggaatcttgtggattaccagagagagagactcattctcactttttctcccaaaccaatgaagtctctctctgtgtgctgagccatgcagagctgggggaggggtgacatgagcatcctgtggccaccgccactggggctgtgctggatcagaactgaagccagcacagcactgggtctcaccaaaagcccactgtaaccactacctggctattgtttatggtcacgtaaggccctagggcttcacaatcagcaggtggcaaagccagccaagtttttgtcctgcccttcagggtggcaagttcctccagaccctgggcaggtccagagatactgtccaggagccatggagtggaatcaaaatacttagaaatctacctgatattctattctactgcagctgagctggtgctcaagccacatgacacagatctggccactcttctcttccttttccagaggcagaggagcttctccccatggctaccatcactactggcccatagggagtactgccactcttgtggcaaacttctctttatttttccctcctctctccttaagcagagtaaagtcagttttgttgctgtgaactgtgctgcctgaggttgggggaggggtggtgcaagcactccctcaatctctatggctggtgtctcactgtcacattccccccaagtacattggctctgagcccagcacagcctttggacttgcctaggaattgtagtcgtgtggcctacactgcatttcaagtttgtgtgtactccagcacacgttagcccatggtggtgaggcttgctgaaactgaggttccgactgctaggatttgctaggattggcaattcctctctggcgagggctggtttaaatgctccgtctgtgggcagggattggctgagttcggccagttttgctttctactctgacagggcagcactgagttgaatgcaaggtctcacaatcactgcactctctctccccataagcacacagatcctctctctgtgccatgcagttgctgccaggggatgggtgttaggaggtgttagatgtttaagactattttttctaccatcttcagtgcagcaacatgaagttaaagccagatactgtgagtgctcacctgatttttggttctaatgaaagtgcttttcctgtgtagatagttgttaaatttgttgttcctgtgctgggtggtgtggggggtgataggtggaagcttctatttggccatcctgctttgtctcactcccacaaatggcatttagtatggtgactcttttccataaggttttcaatttactttgcccacattcatcacaagaatcattatggcaactatagccttataaaatgtatttcttaaataacagaacatgaaagtctaaattattccttgatccatgggctacaaaatggatattgtcaatcactagtaaatattgtgaatctttctttttttttttttttctgagcagtaggcctcaatcgtgagcttaaatatttagcaaactctgctgtaatcagatgtgccatcattcaggctttgttgttctatttatagagcacaagaagagtagaattagcataatgtttaagggccctaaaattttcagaatgataaacaaacactggcttcaacttgaagtcaccagctgcatgaactcctaactagagagtcagcctgtccttaaagctctgaagccaggcactgactttcctctctagctatgaacgtcctagattggtcttttcctccaataaaacactgttttgtctacataaaaaaaaaaatctattgtttagcatatccaccttcatcaattatcttagctagatcttctggataatttgctgcagcttctacgtcagcacttgctgctccactttgtactttcacgttatgaggatggcttctttccttaaccttcatgaaccaacattttttagcctcaaacttttcttcttcagcttcctcacctctctctgccttcacagaattgaagagagttagggccttgctctggattaggcttttgtttaagggaatgttttggatggtttgattgtccatccagatcactcacactttcttcatatcagcaataaggtcgtttcactttcttaccatttgtgtgtttcctggagtagcacttttaatttctttcaagaacttttactttgaattcacaatttggctgtttggtacaagaggcctagctttcagcctatcttgacttttcacaagccttcttcactaagcttaatcatttataacttttaatttaagaaggaatagatgtgtgactcttcctttcactcgaccacttagaaaccactgtaggtttattaataggcctaacttcaatattgttgtttcttagtaaatgggaaggcccaagtaggggagagatgtggaggaaaggctacttggtgaagaggcagaacacagaaaacatctgtcaactaaatttgccatcttatgtgaacacagtccatgctgctccaaaataattataatagtcacatcaaatatcagtgatcacagatcaccatatcagatataacaataatgaaaagtttgaaatgttacaacaattaccaaaatgtgacagagatatgaggtgagtacatgccattgaaaacaaaaaagataccaatagacttgcttaatgcagagttgccacaaaccttcaatttgtagtaaatgcagtatctgtgaagtataataaggtgaagcacaataagatgaggcatgcctctatatcatctaatttagtcatctccagaacaaaatgagtttgttgtcttcactaacagatgaagatactgagctttgaagctgttccatatgttgaccaaccctgcagtgctggctgtgctagaaccagggatggaaccaaggcccatctgactctaatatccctgctgttagtgactttctccctgctcactgacattctggcgtcttccctgaaaactatgtcctagcctttctgctcttgtttctgggccaccattagctgctctatttcttcgtgtataattttaatgtgttcaaagcatttacactgtccacatgcttatacccacagagtaagtaaacatctagtcttagagctattatttaggtttttgcacaaatttctcccaatggaaaacagtgcagcacacctccctataatgctggaaaggcagctaggctctagattctcatagtcagatatccgttatatgcagcataatccacacatgatgcagatgcaacatttaggaggcttctggtgtcaaagtggaacctcaggaatccctcagggaaggcttcagggaactctaaaatgtttagtgaaagaagacagaacgtttagcagtagcacacaactttgtaaatactagttacaattatggttgtttaatcctgtcaaacggcaaaggctccagagtgtacagcaaaggctactcataaggcatcatctccttccacccagtgttcaagtctccactatcatacccatgaaatatgggttttcaccttatttgaacgtttgcaggagtaaagaactcagtttggtctcatgttgatataatagttttttgttgctgttgccctaggtttttcaggactagatatctcaatttatcctctcactagggagcttcaaaaaagaaaaccacatacttgtattatggggactattttttcatatccaggtttctgaaagctgaataaataatcagaaggatgacttctaaacttagaataatagaaaataaaattacatattattataaaatttttcccttgagtcatggaaaaagcctcatgaattatccctgtccaattatagagagaacatttctaataattggaatgtacggagtctttctcttcttctctgtaaaaatgctgaataaattcaatccaatttctcaaataaccagtatttatcagccaccaaaaccattacctcatgccagacaaaattttaccaaggtgacaaagaatgtgctagtgaggaggggtattaacacattggaaactcagtagtggttgtcttttgcaggctgggactaatagaaggagatactgttataaaactgggctatctactagtactaggaatgataggacctaaattatcagagactaggcagcagtgcttagcttcagaagtaaagcaaatggaattactttaaatagctgcaagttcaaaagcgtagaactgggggtgggagcagggtggtggtgtatggagttgatccttaagaatctactgaggtgggtctaaaacatgatttttctagaacaagatggaccgaccatcaacaagagtactgtttaatatatattcaaaagagatcgagaatgaatgagcagaagactcccatcagctgttccaatggaaaatcacgacctctcagtttccagacttatactagctctaagaccttgaacatatcaactaaaggagaaacaagatcttcatgaggaaggatcctgaaacaccacatgtattagtctgttttcacactgctgataaagacataccagggctgggaagaaaaagaggttttaatggattcagagttccacatggctggggaggcctcacaatcatggcagaaggtgaaaggcatgtctcacatggttgcagacaagagaagagggcttgtgcagggaaactcccatttttaaaaccatcagatctcgtgagacttattcaccatcatgagagcagcataggaaagacctgcccccatgattcaattacctcccactaggtccctccgacaacacatgggaaatcaaaatgagagttgagtggggacacagccaaaccatatcattccacaactggctcctcccaaatctcatgtcctcacatttcaaaaccaatcatgccttcccaacagtcccccaaagtcttggctcatttcagcattaactcagaagtccacagtccgaagtctcatctgagacaaggcaagtccctttcacttatgagcctgtaaaatcacaagcaagttagttacttcctagatacaatgggagtacaggcattgggtaaataaagccattccaaacgggagaaattggccaaaacaaaggggctacaatccccaagcaagtccaaaatccaacagggtcgtcacatgttaaagctccaaaatgatctcctttgactccatgtctcacatcgaggtcacactgatgcaagaggtgggctcccatggtcttcggcagctccacccttgtgactttgcagggcattgccccccatctggctgctttcacagggtggtattgcctgtggcttttccaggtgcatggtgcaagttgtcggtggatctaccatgctggggtctggaggatgggagccctcttctcacagctccactaggtggtgccccagtagggactgtatgtgggacctttgaccccacatttcccttcttcactgccctagtagaggttctccattagagctctgaccctgcagcaaactttggcttggggatgcaagcatttccataaagcctctgaaatctaggtggaggtttccaaaccttgattcttgacttccatgcaccctcagctcaacaccacatggaagctaccaaggcttggggcttgtgccctctcaaaccatggcctgagctgtaccttggccccttttagtcacaactggagtggctgggatgcagggcaccaagtcccaaggctggctgcacacagcagattggccctgggcccagcctatgaaaccattttgtcttaggcctctgggtctgtgatgggaggggctgccttgaagacctctgacatgtcctggaggtattttcctcttcattgtcttggtgattaacatttggctccttgttacttgtgcaaatttctgccgccagcttgaatttatccttagaaaatgggattttcttttccatcacattgtcaggcagcaattttccaaacttttatgctctgtttctcttttaaaatggaatgcctttaacagcacccaagttacctcttgactgctttgcttcttagaaatttctttttctatatatcctaaattgtatctctcaagttcagagttgcacaaatctctagggcaggggcaaaatgccaccagtctctttgctaaaacataacaagagtcacctttgctccagttcccaacatttcctcatgtctagctgagaccacttcagcgtggatttcattgtccatatcattatcagcattttggtcaaagccattcagcaagtctctagtgtgttccaaattttcccacatttttctgtcttctgagccctccaaactgttccaacctctgcctgttacacagttccaaagtcgcttccacattttcaggtatcttttcagcagtgccccactctgctggtaccaatttactgtattagtccattttcatgctgctggtaaagatatacctgagactgggaaaaaaagaggttttaatggacttacagttccacgtgactggggaggcctcacaatcatggcggaaggtgaaaggcacatctcacatggtgatagacaagagcagaaggcttgtgcagagaatcttcccttttataaaccatcagatctcatgagactaattcactgtcataagaacagcatgggaaagacctgcccccatgattcaattacctcccactgggtccctcccacaacatgtgagaattcaagatgagatttgggagggaacacagccaaaccatatcaccataggatactgaatactgaagtatttggaagtgttttcttctttctttcttaaaaggacttacagtcgtttactcaagtaaccatacacagggaaaagagcccgagcatggttcatgaatgggatggtatgtaggtataaaccaaaaatggattgctcttgcactatagcttctactcaagagtaaacttgaaatggccacgagagactatcctcccaaaggacggattttttgggctatacatctattcatctacttcaaacagagtagtggtaagaaaagttgctttgaatggtaaggaaagttccagtctcatgggcagtagtgaatgacttagcttgctggtcagggacatgaaatgagcaagattccaagaccacagaaaggcattcatggaaagaagcaagtgacgggacatggataaaagcacaatgtgttaggatctctgtgtcacatattaatatttataagagatatccactgaagaagaaacaagaaataacagagctacacgaagatttagtcagcagatgtcacccagtctctctcattgggcactccagtaaataaaggaagcatggtggaagagatggaggccatgcatgggtataaaagcacaggcttcttctcacaaaggctgacctagctactgatgcttataaatacccaacctgccagtaacaaaatgcaatgctgaattagccatataatatactttcttaaggagactgatcagaaacctggtggcaagttgatcacattagggcctttacatgctagaaagggcaatgtttcatcatgacctttactgacatgtatttggacatgagtttgtctttctggcctagtgtgtcatgctatcaccctccaaagactcacagagtatctcagaaattgacaggggatcccttataatacagtgaaacagagaactcattctatggcaaaagaagcatggcaataggcaaatgactataagttcatgggttctgtcatatataccacatcattgagaacagggatgtccaatcttttggcttccctaggccacattggaagaggaaggattgtcttgggccacagataaaatacactaacactaatgatagctgatggcctaaaaaaaaattgcaaaaaaattctctaatgttttaagagagcttatgaatttgtgttgggccacattcaaagccatcctaggccacatgcagcccatgggctgcgggtcagacaagcttgatcaagaagctgccatcctgatagagtgctagaatggtctcctgaaggcctagcagaggcacaaggatggggtagtattctttgagctgtgatatataccttaaaccaagcccttatattgtgtcatttacccaatacatagaatgtatgggtagaggaaacaaggagtggaagtagaagtggtcctgcttactatccattccacttacccacttggggaatttgtgcttcctgtctcttcaacttttggctctgtagatctagaattcttggttctaagaggggaaatgcttccatcaaagggcccttactgagctccactgaactttaggtgtagttaccatcttaatattttgggctgttcatgccagtaaactggtaagaaaataaaaattaatacctctgccagaaagaattgatcctgatcatcttgaggaagtaggactgacattacataataataacaggaaggaatatatttgatgctcaggtcatccactgaagcatcttttgatgatcccatgcccagttatgatctgaaaaggtaaccagagctcagaaccctcagtgctgaaggtcaaacgaccaggcacaccacatagaccaacatgatgaggaagatgatgagtatcaatcttggattcaggacaaactttgcagtgagaatgatagttttccttctttttattctataagttttcccagaaattgtgactaaccagaaaatctgaagaagctgtgcctggatttagtaaacttaattaggaagcaagtggatctgagtgtttggtggattacagtaaatgttcttggtgacacacttcaatagccactgctcccatcccacagctgctgtgagtgttggctaataacaactcgcagctctcagggaatactctattcagggaatagtgtttggtaaaacaggagctaagatatcctctatctatgttccacatgagtgagggcagatcttggccaatgattgactgatattgatttaataaattagctttgtcaatttgcacaagtcaggctgaggtcttgcattgaaatgtcattcatcaggactatggcccccaaacctgcaggagcctgctagttttcttcctttagtactattctcctcaagttcatcttgtatattatgtgacatggatctctctaagctgcatttttaccatgtcacttttctctttaggaacctataattttttttgtggtgatctgaattatgtacaccgaaactttatacgttgaagtcctaatcacacagtaccttagaatgtgactgtattgggaggtatgcccactaaagagataattaagattaaacaaggtcatatgagtgggccctgatccaatataactaggatccttctaagaagaggaagagataccagagatgagcctgtacagaaggaagccatctgaaagccaaggaaaggaaaaaccaaacctgccaacaccttaatcttagacttttagctttcataagtgtgagaataaattactattgtttaagccccctcagtctgtggtatcttgttatggcagccctagcaaaataatgtagttatttaatgcccaccacattaagactgcttattattacaggtcagtttaataaatattaattgagtatagtcactgtgtcaaagactaaagacacaaaaatcaataagaaatggtacttaccttcaaattctcatagtttgccaggtgaacaaatgaactaattacatcttagaagagaaccatactttgtcaatatttgtattacctcagctcatagaaaacaattatctctgaagaaattaggaaaggcctcaaaagggggatgacaattgaacctggtctgaaaaaatgtaagaataaaagtttatcttaagtagtagacagtgttgagaggtctttacataaaaagattagcatgaacctgggtacaaatgaaaggggatgcatagagtttcctgaattactggagcaatagcgtgctctttcttatagaggcaacctgattgtgctgcatgaaagttatttgtgaggtgtgagatgagtaacttcttactaataatattagcatgctaaggtttgtgaatgattcactcattgaaataaaaaggattcaaagctctctctcaaataatgtcagtacctaatggagttctgatatcttttgtatagtagactttggccttgcccaaagtgaagccaagcctttgtccctggttcttaaaagataacctccaaaccattggaatttcctgagtgataggagtatctttatttttcttgatgggccccttagaccacacttggtagattatgctaatgaggtaactcatggtagtctccttggatcacatgatatcagcccaacctctagagaagggggagtaaagactgagctcaatcatgtggcagcttattcaatcactcattgctaaattatgaagctcgaataaaatttctggactcacaggtgagctttccaagttggtaatactctctgtatattatcacaggtcagtgctgggagggtagtgcattctgttcaataaaaactttgcatttgaaatcctcccagactcttccctattagtctcctccactggctggctctagtgtgtatcctatccttgtaataagccataactgtgaatgtaataagatcaaatgagttctgtgagtctttaaagcaaattttcaaatctgagggtattttaagaaaacccctgaacatcagttggtgtcagaattaaggctgttcttgtgtggaatcttgcttctagttttgtagttgaactctaattccttgcagttggtgtcagaagttgtgggcagacttggccatctggaggcttatacctttaacttcacagtatggctaactgtgtgtactttcttgttgagaatagaaaagagtaaatcagggtgtaccaactgataattctgcataactctgggtcatgcatgaaaatgccatccatcctgattgtcctgctgaagaaggatgtgtatgggtaaatgtggtagaagatggggttaccaaagtaggcattgtctaaatcagtaatttttttatattatagtattcaaaagggacagtcacatactctagttacaatctataatctagaaaaaactctattggtttactgcaaatacagtatttgagagagtcctattgttctttctagctattaggttttagcttcttgtttagtaaatgactctcagttttttttaatgtgtggaatcagaataaagtaaggcataattcggacaattatgaagtttaaatggaaaatgcacaacatagaaaagtgatttgtaaatcttaaaatgtcactgatgttagtaaataagagaggttttattccttttttcccatcaaacagtcagagttctccagagaaacagaatcaataggatatatacagatatatggaaagacatttattatgagggattggcttacacaattatggaggctgagaactcccacgatgttccatctgcaagatgaaggcccaagaaagccaatggtatatttccaagtccaagcctgaaggcttgaaagccaggagggccaatggtgtaagtcttagtctgagtccgaaggcccacgaatgcctatgactaaaggttggagaaaatgtctgttccagctcaagcaagagagcagattcaacttgcctccactcttttgctcaattcaggtcctcagtggattgaatgatgcccacctgcactggtgaatgcagaacttccttactcagtcaactgattcaaatgctaaaatatcttctggaaaccatcacagacatagccagaaataatgaattattagctatgtggccatcccttaccccagtcatgctgacagaaaattaacaatcacaagttatctgactcaaacacttatttagcctcttcatacttagttttcttgtctgtaaaactatgagaccacttccacccctctgagttcatcctaaaagagatacttttattataatctttcacttagatttcaaaattctgatttttttaaaataacttttttcaaagactaatattcctaatagaaaggaacaatgatgacacaaaattgatcatgaggtttatagctgtcttgtttgccaaaacaaatataattctgaccaaaaatatgctcaatggtgggagatatatgttgcctaaggagggaaaagtaatattaaacatttgacaagcaagaactttccaattaactattagtgaaaatgttaattaacaaattatatttatataataattatataatttcacacatcattggttgtattttaaacaaatggaagtaatgacactgatagaacttcagttctgtttccttaatttcttcatgggagccaaattgttgcattttcaggggaatacaggttgtgtttagagtctgcaactgatgatcagttattctgagaacaatataaattcatattttcacttagcaattcttgcatttattgtaactagttactcttttgtgagtcttttgctagtctctaccaagatacctattctctatgcatggtacagaagcagctgaagttggaactgaatggactatatcagcatgataaactgtaagaagagatactacactggaaggctgcctctctaaacgtccaataccttgtcactgtgtatgattctggaagtttgataatcatagagaagcctcggttttactctactaaggattaagtaccccaccagagcagcaggattgggatttttggaaatacctgaaaaagcaggaaatgcagtatttctagttcatctgggtctatacaccgtatacaaaataaaagtgcccaacttcaacaatttcagaattaaatgactgaaacagattgtttaaattatagctaactattaccagagagattatgaaactgcgaacatgataattaatcagtgaatttaaaactctcaacatttgtctagaccaaattcctttttaagaaaacctcatcgactaatttcaacattttctgttttttttttttctttctagtattatcttctgatatatactgaattgtaaaactatcaaaatgtgggcagcagaaggagaaaggtgaaaaagtcaaagacccagagaatgaatgatctagattgctcctgtgcaaatgaagattatattatttttgtgctttcattttccatatgtagacgaacattgatatatttcttatagatttatatttttatcattcacttaatttaaaaattgtgttttatgcattttcttaatgtttttacaaatacatacttgccaactatttttcagaaaacatcaggcagttatagccagtctgccaatcctatgacctagaaaatttctgcttttttagcttgaagtttcaaagaaaaaaagattaaaatagaaagtgaattttcaaactggtatgaatactaatctgagatgacctgtctctccttttttctttctagactattaatgcctcaccaaaaaaaaaaaaaaaaaaaaaaaaaaaaaatttcggtcctttattgtttattgaatctcagctaattaccagacactatactatgctctgagaataaaaagttggaataaacagcatgtcagatctcaaagaactcaagtctagggagtaggcaaaaccatataaacacctaattgtatagacctagaacagtctggtaagtggtaaaatgcaaacatgttcaatgtgctgggggatcccagaagggggcaaatttagatggcaaagaggcatcaggaattgattcacaaagaggttgttgtcagggttggtccttggaaaacatattgtgaatattcagttgtgggtgggaggggaaaacattccaggtataagaacttgcataagcaaaagggcaaagacatggatctaaagatgtgcatgtctggggatgttgaagaaacaggacatttatgtgggacagagaaagcaggcgagcaaggcagatggaatgaggcaagacaagcctggaaaagcaagagatttggtccacaattatgattcatttttatttcttactgtatgtttccacattttggagcagttgaaaaattctaggtaaagaggaaaacctagtttaaaattctttaaactaaccctcacttgttcaatggtgttttaagaagtctagaaagacagatactaaattttccataggtcttctttagtaatgatgtggaaaagcatgatatacttgcagcctggctgctgctaaaaatgactaagtcatttataaaatcttatcaatgtttgttttgatatggcttctccatttccgatgttacctaacacacatttccatcttcataatccaagccattcttgtttcaaatactataactaagacaactttgtaaagaatttcctgatatgtaaatctctttcctttctatctacagctactaaaactgtaaaaaaaaaaaaaaatcttcctcatgtgtgtcttatatcagaaacttgcttcacacacacacacacacacacacaaaataccacaccatattttttaagttttaaaatctctttatagttttattactcatgtatttatctgtctcaccactaagctgtaagctctgtgaagacctgggtcttttcttatactgaagtctgctccaaggttcctagaacactactgaacagacacggcactcagaatgtgtgctgactgactcttgcatccttgcccatttttcctggcttttttttttttgcttattttaacaggtgaatacagacaaagataagtagatttaatataaaagtttgttcatgtacctttgctttttgctttgttgttgttttgttgtttcatctatgagtaaacatacttaaaaatagaggctgaaagagatgtgcagttaagagtataaaaactgtaaaattctgagtttctattcctctgtctggataaagtcaaataacattactttacttatttatgtacatactaacttgaagttcacataaaggaacaaagtatcagtcttcacagtctcacagagacttgaaaacttaaaggaattcccaacaacattcagcaaatttgccgtgcttggcctggtttggaatgttactaagtgctttaccctttccaagtgctttgcaataatttataaatcacttttcaaaaaatcctgagggggagggaaaaagtattatggctattttttttaaaaaaaaatagcaaaatataaaagaaaaaaggaagaaagagaaggaaacttccattctgagtgctcactaccttctttcattttcatttctctggctttagattcccacatggttcatgactttccagaataccagggcatattgacatacaaaccatgaacaaggaaggaaaaatcacaaacttgtctcccattgctcagagtggcacaggttttaaagtggcacacccatcataggtttctctattctgtttcttctccctaaatcgcaggagcttagaggcttgggttcccaggactatggagtctactaatctggcctctttctactctccaaattgagacctctcacctctttttattttctggaaaaatagtactgttctattttgtttgtcctgctataacaaaatacctgagactgagaatttactaggagcaaaaatttatttcttaccattctagaggcttagttcaagaccaaggagttggcagttggtatctgatgggggccttcctgcttactcctctcatggtggaaggcagaagagagtgaacccacgccctcaagctcatttataaaggccttcatcccatccatgagggctttgccctcaggaattaatcactttctaaaggccccatctcttaatactaccacattggcaattgtttcaacatatgaattttgggggacacattcagttcatagcagtgttctttcctaggtgaacctcctttggcttctggctgaagctgtgggtgctgtcacctgctcccccacactaacttggcagaatggtgggtgcagtttctgcaggtttgtattctcccctagcttcactcttctgccttctatttagattcctctggtagctgatttcctagcctgctctctcctgattaaatcttccaggattctcacatctatttgctcctctgctcttgttctcatggaacactggctttctgaaaagctcacataggacttcactccaggcctcacatatccatgaaacaaatttttgtgtgggaggttcctgtggtcttttacaaacatgtaaaatatgaaaaccctatatggtgatttcttttcctgtttaacttgctcttctttatctgaggttatccctccatctcaactcatggtttacttactgacccaatgtctttcctcccattttagaacaaaaataattataggtttgagataggtatcaggtttttctgtaataaagagaaggaatcatttgttgctaactaatcccagtgagaatttggggggacggggaaggaaagcttctcaggaaactaaagagcctggtgaaattagaaaggaatcacttcctacccttagtgtcagggatttaacaggaattatctcttctttccttttctcccttatagacaattgctgtgaggataagaaaaaggctgcttttatgcatgagcttaagtctggattaaggaatgaatcacaactgctattttctagagcctcttgtcactgggaaaggccaggtcataccatttggcttctattttattaatcaatgaacagcttaagaaagtagcacaacttgcagctcagattggcactttgtcttcatttttcccccttattaaacaatatccttgttgagccacctgtaatttcagaatttactcatgtatatgtattcattcaacaacattcaacagcaaacacattgttgagtactatggtgactgagttcgtgaattagtggtcttaattcttcactcccctgtagtataatgtacattctcattcttttcatggcttcatggtcagaggagtgtacttttatgccccttgtctttagacttgtccatgggtctttttttaatgatgggatatagcatacatgctttaagtaaggccttgaattgtccttgttcttttctcattgccatgacaagaatagctgctatccccttatccaatgggcctcagtatatgatacatggtacagagatgccccagccaactcacacatttgcagactgaagcagtaccctcccagctgatccacagatgtgtgaatgaaaaataaatacttattattaaaaccattgagtttgggcttgtttattatgcactgtagacatcattttcacaaagctgagtaatataggcatttagataaggatatgagacctaaaaccaaatacagagtttttaacttttaaaatagacttactatttagactcacagtttattaataaaaatatatgtataaacaaatacattattgcaataaaataaagtttgcaaagaagtatgaagaagcatatgggagtatatagttgaaaatacctcattctgtcttgagaggtcaagagaaagttgtccatggaagaaacaaggttgaaacatttggatctgggggagagggacagtgagaacatttcaggcgggagagtacaaacaggaaacagcacagctggttaaatcagacattaaccatgttaataccatataatgttaaatcagacattaacattatatcatgaaaatgatggacaatcaaaggggccatatcacatatagagtaagaagaaatcttgagcacttacctgtaaagggtgctgaaacagcacaggagtttagaagaaatagagagccagttaacacaaagaagagagtccttgtatagctgccaaaatataaattgatcttattgctgccaatgtggtcaggaatctcaagttgggggaaaaatccttgaagcattgaccttattgaccttggctgtattaaatacatggtgaacaactgtttgaggattatcagtttgaaggactgccaaatcatttgacaactaggaactccaagtcttgatccacaacattttcatcttgtggatgagaaaactaagattcagaagaccaaaatgtactcaaattcaaaaacctaaaaccagaaaccaggtctgatttatcactcctgacttctttctactatactttttcctgccttaaatttaccaaagcctacggagaatggggagatctgcacaggtagaagagtcagaattgaggtttaagaatatatatcactataataataaagaattaagagttaggagaacagagaagttccacatgcatagaaacatccatgataccatgtcgttttcgacaagaatgtgaatgtttagggttttacagaatgccaccatacaaggtaagctttagttttggaaaagtcacttatggtaaattgactaaacagatggggtagaaattaataagagcagctcctcagaaacacatctagaagaagctacaactggcctaacatcttgcttattaccaacagagctgttgggagtaaaataccttctaaagccaagcacacaatgaagaaaactgaacaaaataaactgacacaattcagcaatattatcttctgggaaaatctggaagatgtaaaggcactactctgtgcttttcttctcttaataacatctaatatcttctataagattaaatattttggcgaaaaaaccagaatcctcttttacagcttgatagaattgtatctattcttacagatgatttcagatcccttcaaatatcccttggaaggacagaataggttattcctaagccatagaattcccagtagtacatattatagcaagggacactgaatgagcaaccaattagcattaactgagcacaagtgtgcccaagacggagcatgtgttgttcacttcacattctcctgaggcagatgtcatgtctttctcacacgtgttcagtaggactggtgcagattctgagctctcatctctaaatgaaaattgaaccatcagtatgtgcaggcttgacaaaacaacaacaacaacaacaaaaacagggctagttcagtagttcagtctaagggaaaggacctgagctttgagtgaatttaatgaaaacgtaaaattatgaagaactgttatttagaatattgacataaaaagtggcctcttaagagaagataaaggtgaaagcatttattggtgtaaaaataaagtggagaagagcaggagcatttaaataacatattttgttccaaagatccagagatatctctgagactaaatacctgccatgagtgagactggtgaactgtagctggcacagtggctcgcacctataatcctagcactttgggaggctgaggcagcaggagcacttgagcccaggagtttgagaacagcctgggcaacatagtgagacctagtcttaacagaaaacgttaaaattaggtggacataatggtgcctgcctgtacttggtacagctacttggtaactgaggcaggatgattgagcccaagagttcgaggttacaatgagctttgattgcaccactgcactccagcctgggttatacagaccaggtccttgtctcaaaaacaaaacaaaactagtgaacctcaatagacagttttttgcccatatttcaaattgtctgctaagtacgactacttcactatatccaagctactggataaacctatttatccctgaaacaaccacagaatagatgtacttccttttggaagtacaaaaggaagatattcttccttttgtccttaagttcaggcctcagtgttctgctctaattagtttaactctcctcaactccctgtttcctccagctttatctgatccttctggtaacaagacccacatgtttacctctacagtgccaacctcattctgatactgtgcatcactctctaatcattccactctcaggtaaagttcagtttattctacgaataccaaaatgggtgaattctcctgtccccacagcagccccatgaatgattttcttagaaagtgctcatattcctactccatgtacataacactacctcttttggctttccttctacttccttatttcttttctgtctctttgatctcatttttccccctcaagattattactctccatctctgctcttaaatttctttttcttctttttatactttcttccttaacagtctaattaatttaattctatgcagttgacacttagattaatatcttcagattcgacttctcttttaaatttttgcctcatatttctaattgtctgctaaatacaactacttggctattctacttacacctaaaatccaatgagccaaaatggaaactactgttttttcatgcagacccagtcaccactgtttctgtccaaggtgtgaacatttttcctggatttgaaacttcagcactctcaatgattgttttatttctcttgctccatgtaccccacattctgatccaaccactttcttagtacttttgaatctacatttttaatatttccttcattcaccttcttatctccaatctcattgcctatgtcccagttcaggtcctcattacttttctcttgagttattatgagagcatcttaactgaagtccttttattgcaccaattcatttaaaatatggcaaaaatatttctaaacaaagaactgctctgatattgtcattcatttcttcctctttcctcatatctgtcaatgtggctgttttatattcctcggcctaacatttaaagcatccaaatctccatgacctcactcccaagcttatttcacactaattctttttatagaaccataaattaagctaaacttaatcactggattgttatttgctaggatataatgttggaagttagatcttattgttattattattatgtcgtttctgttattattatgttgatccttctggcaaatatatttatatttatcatctttatatatttaaattatagtaatttggcaagctccagctcattttcttccttctttataaatgcctcccacaactggaaataattcccaccccaaaattcaatagtgtttttctatgcctctgtgtctcgtatattttgactaagagcatctctcctactagaccataaactcctaagggtaaatctatgtcgatttaacattgcatttatcagacaaaatactccagtgccaataacatacaattaagcaagtttgtatgtttacttaatgtgcaaattaataatcatagctaaccttttttgaagggtagattctcagtgttgcacagaggtatgtgctattttgttcttcaattttttgactagaaaaaagcactgaaattcaaagtggttaagtaatttgtctaaggtcagagtaaatgtcctgaccagactctcaaatttatagttctaacacagacctctccctgagttccactcccatatatccaattgctttctgtacatttccatttgagtgtttaatactcttcctttgtgacaactttcatacctatcccttatagttcattgtcttcagtttgggtctagcttagcatgccctcatatcatatcaaggctactgaatttgtttaatgacttgctcctttaacccatacttttttaagaattcaatttgtcctacatttatctttctaaatcacttcctgtaatactgtcactatcctcctctaaaattttcagtgtcttcctaccgactataaaaaataagccccatcttctctgtctggcaaccaataaaacccactaattggtctcaacctatgtctccagtaaattgctgttattactccctgacatgtagcctctacacccaaacaaattaatctcttcattgcatttgaatataccatgtgtatctgtgtcccttttcagaaattacgtgcaaggtttggcttcattgaaatacattccttattcctatccacttattaaagtctaaagtatccgtacttttatctttcaaactagcactctttttgctggggagaaagaagaggggaaggatgattactcagagactgctcaaggtaagctggcatgtacagttaacctacttaatacccacatactttcaacatctatatcaaatctcacctctcctaaaattttcagactcatggcctttagttttagtgatcattttttcttttagagtgctgttgtatcatagcaaatcatataaaagtcaacatcctaagacaaagagctgaatcctgtctcctctacttaataactatgtgatcatgcaaaggcctcttaaattcttggcaagttttatttgtaaatggaattatttctctaatttctttttattcctatagtaggataatacatctacatcctttcccttgtaactttgtagtatctatcactgtggatgaaatataatttcacttctcatggatgttggtctaagctatgtgacttggtttaattaataagaggttgataaacatgacattatcagaggctttaaatgtgcaaccatgatttagtttgtcttttttgtgcttctataagtcactctgaggttgacaaacctgaggaagtcatcacttctttatcctgtgccttggaataaagacatatgaaatgaaaccactccaactctaagcttggagtcaagtacgacccattcaaagtcaaacagacaagattaggaaaccaatgcgaacctacagaccaaagactagaagaaaaaaggttagtagtagttataaaccactaatatttgacattcttatatagcccttttccagaacaagctgactgatatgactatctcacatatttttgtgagacaaatgatataagtaagtgaaggtgatttcagaaattacaaaatgcaatacaaatgttatttgattattgctactcagtattatgaatttgtgtccatttcttgtttccttatctaaattgtaaatatgagagagataaactattatatgagaaatataatcattagataattagataagaaataattatgtttcttatatttgccaaagtgccctacatggtgccttatacaaagtgggtactgaagaaatattagcgttgctgctgttaacatgcctcccaagtatattttgtttatatctttgtttttgttcttttagttcttcagttttggacattttcatgggtggtataagatattaagagggtggattatcaaatcaaactactgatttcagaaagtgcctcaaactcttattatctatctagtcttgggcaaactgcttaaaccctccaagcattaacttatttatttataagaataatattattactgataatacattcatcaattaaaattaattacaataatcatttggcaatgattgtcacatcataaaataacccagtaaatagcagcttttattatattttttatattttaaatgttcctttctcctctccagaaatttctaaacaaacttctcagaccatcttatcattctctagacaaatatatttcttctagacagacagaaacacacacacagacatgcatacgcatgtgtgcctgagcgcgcacacacacacacacacacacacccctattgcagggttttccataaataggtggggattagggaacaggaaaaagtgatcttaaaaactctgtgtttcatctctgctttctgatcatctacttgatgtttccaatgccccccaaacaacctctattcctattcacctaactaatgctgaaccaatcttcaaatttctacttagaggacactccccctggagaaactttcccagactcctcaaggctaagctgaacatccctcttataaagagccttcataaattcatgattgagggcacttaaaactgcttttcgacttgtccatttttaaaactatactataagttatttgaaggcatagattgtgtttgtcgctttcactagaacctggcacagtcttggcacatattaatcacttaaaggtataagataaaagaataaaaaagaaagaaagggaaagaataaagggagagagagcgagatagcatagactgtgttcatcactttcaccaggacctagcacagtcttggcacatattaagcacttaaagatataagatgaaagaataaaaaagaagaaagaaaaaaagggaataagggggaaaaatagagagagaagggaggaaagaaagaaaaaggttacttttgtttctttgcttttcagaagagaatgttaaaagagcaagacaattactataacatcataaaaactcattttccacataaatctacattttgtttgaaatcacatgtcaatgtgttctcttccattcatcagagtaataggctatttaaaaacaccaactcatcataaaacctatttgagacaaaatggaatgaatagagtaaggtggatttctattcttttcctccttattctccttcttcttgctcattttagaaaaaggctcttattcactaaaaaccctttagcaagaaacaaatacagaatatttatctcatctacttttgaaaattaacagcaagaaatttaagtaatcatttatttaaaatatttatttgtgatttatatttctggataggaattagagataaaaagtctagatctggttaataaggggtaaataaaaaagaagataaaagtggagaaattgattaaaaagtagacaatacaaaggaaagacggaatacaagaagctttagagtaatgtttcttcatagcacttctgttttaatcctaaattctaaatatccccctctgggcattaggagaagaaaggtctacctgattctaaagtattctctaatactgaggaagaggactggaatgatatccctctggagtttgacaaaaatctaactgaaattaaaatacggttatcaaaccagcaattcaccatctttacttaaaggaataataaatcagatgttaatcaataacataaagtaacagtttccattgttcttaatttaagtagacaagtattagatacagcttttctgtgctgccttttattttcaaatagctaccttcaaaaattattcaaagagttcaaagaagaaaaagtggcagagttggataaacagaccaaaaaaaaaaaaaaaaaacagagaagagccagtcaactcagcaactttaattgtccatgtggattataacagtggacttgtctaagttagaactatccagtgcactggccataaagtacagagaaaattactagtgttgttatgttgttgtatattaatttctgctatatagatagactcagttctcttcccatacttgtctagtatatgcctgacaaacagaagtctctcaagaaatgttagtgaatgaataaaaacaagattgcataaataatctccttatttatcatcagggccagggctattgctgagtccccaatttatacccaaagttgattcctctgaaacaatgacacttaatgtagacagcctcccaaagaaggggagacagttcctgtctgttatgtgactgtaagccacttgtccaaaccaattctgcagcaacaagtgccaagtagatggggaagatgtacagatggctgcctgcatgcatcacgggattgggctgccaccacagcccattgttatatttattgctgacaaagtaattaactggctgactccttctttttaaattggtcatcctcaatggacagctgcactggggggttgtactaatcatgcctttgacaggagcgagctacacagccccactgcagcagctagagcctttgtgaggtcatccctttgctgctggacagaaacccatgcttcactctccctaggatcttttaacaggcttcctcactcctggaaaatacatagcattttttttctgagtgcttctttttccgaagtataatacaatgggaaaaaagtcattttttagtttgttttccatgtgataatttctttttttgttcaagtaataatttcttaaatacaaactgaaaacttgcctttaataataattgtggaagaagattgcactaatctcagtagatattacccaaattaccaaattataaggaagctagaggtcatgtgaaggcatcaaaagctgtttcaactcacttctctgtccagcaaccaagtatttatttttatttcaatagcataaagaatgatctttattttttctacagtaaaatgaatattagatgcttgcagaatattttacatcacagaatgttaaagatatttttataatgagaatgcctaatgtatcaagcacaggcttatttgttagtaatacaataccagattcacggcataggcaaaattcttcctaggggtctcatgtttgtcttttcttacctgtgaaatgaaagccattgttctttcctgcccatacttcttcctgacctaagtaacttcaactctgttctttatgatttattctataaaatcgggggactggacatagagaatttctaataatctgtgactatctggatattgaggcaaataaaaatcataatgtattactcaaattaataaaaactgtgaatatacaatgtaaagggcatgtattaattacaaatacaactaaatcttgatttgtttttattatcacaaatatcagtgtccgtggtttgagtttgcttatgaaaaaatcctttacatattcctttctgtgctttgctaattttccattctgtattccaaggcagaacaacagattgcaacaaaatcgggttaaacattgatcttccgccctgacattgcattaacttttgtaataaacatcttcactgtgtcaaccagcactgtgtttacatattgaacccagcagccaattgtcttacttcttttagatgcttttgaattccagaaggaatcttatctggaagactagaatcatgcatctgtcatgcctttcaattttgtatttcagattaactgctccttttcctccacattcttaaggccttctaagaaatttccttcccaattcacttggtaagtgcctgctcaggctgttattctataatgaattcatgtcttttctcctatttttcctgtgccgcccttgttatctggagtcaggattctgagctctgacttccctccttgtcatgttgcctgaggagaattgcagacagaccctcagacctcaaatagtctagattttgaagaccctgctttggctgagatgaggccagcattggagtagaagtaagcactgatatatatattttttacttacaatctctgaaaattaactatttctgttcaggttcagggactgactgaaagtatgagctaataggtgtgcctatccattactgatcacatattctctatttttgaatgttatgaagaatacacatttaagaattggttttcatatctgcagatgctgcttgcttcactgaagctacaggtagaagctgactaccaaaggagaaggctgaggagaaattgctccatgagataaggcaagacatttatccctgaatgctgtctctccaaatgcacagaaacatgtcataaagtgtgggactagggtctctaaaggacatgtaatacctcatttctggagatatggtctaacatgaaagggtcataatcgatggtcaagtcacaaaatttatttctagagtcattttactaaatatggagagatctgcaaaaattgtatgcctggggaaaatcccaatcagaccaactgacccagaccaatcaatgacaactcagagtagtaatgaaaaattcatttagactaactcccataatttgctaagaggcactgtactaagtatataacacaatatctcattgtgtgatccttataatagctctatgaggtacatgtcattcttcctattttttagacagaaaagtctctgataaataacttgtccaaagtcacgtatttaccacatttaccagagttataacccaaatcggtctgactctaaatgctcttagccattcagtcctactgcaaaataagcacaccagtggagagcaatagagaatgggaacgcagtcacaatgggagcctgtcattggatctcatgtatgcagaggttccttcttccaggagagctttgcccttgtcctcatgaacttttatgtcaatacattcaatgcactgtattggatttctagattgggagctaaaaaaagaacagatttctaaatatcagctatcttattttaccagcttgccttaaaccagttacagaatatctctatttataattatttttacctaaaaataggaataaaactactcttcaatatgtgatttttaaaaaggatgataaaatcaaaggaatttagaataatccttgcacatagtgggcacttagaaacttttgcttccttattgactcccttctccttacatttcaatcttgttccatgtctcatggcctcttcagagcagagactatgtagtatttaccttcatatcttcagacaaaatgcttagcatatagtcggtggtcagttactggaaatgatttaaagacattgagaattacttcctttgaaattttaagaggtgtggtaaaactttggtttcagaatatatctttattgattttttaaatatgtatttttcttatatattatggtcaacctcttgggatctttagaaaagaacattttccagtttttttgaatctcgggccaagagaattagaacactccataaaattacacaggtatatctgataaaggccatactctatttttccatataagtataaaactgttgtataaaaaattaccttctggccaggtgtagtggctcacacctgtaatttcagcactttgggaggccaaggcatgcagatcacttgaggccaggagttcaaggccagcctggccaacatggcgaaacccccctctactaaaatacaaatattagctgggcctggtggcacgtgcctgtaatcctagctactgtggaggctgaggtgggagaattgcttgaacccaggaggcggaggttgaagtgagccaagatcatgccactgcactctagcctgggcaacagagcaagactctgtctcaaatatataaataaataaattaccttgtaaaatattatcctcttccctcaaatatatacagtaaaagatgtctgtctaatattataatatattttgtttagcaaaaatacattagtcagttatttatcttaaatttcctttatcctcctgagtctaacatgtttatttttatactggactttggtctatccatttcacatatgggtcaactatttcctatacagatagtttagttatctgttagctgcatagcaacctaatcccaaaatagtgttttaacatttcttcaccatcgctgagttgtctggactcagctgaatggttgttctgcttcctatgatgtcagcgagggctatagtcatgtgaggtcatacgtggcctacaacatccaagatggctgcctcctataactggcaacggatgtaagctgttggttgagaaatgctagtaagcaggtctcctaagttttcctccacatgacctctccatgtggctggtttctgagaaggagtacccaaagagtgaacatttcaagagaaggaagcagaagctaaaggtcccttaaggcctcctttctgtgcattcagttgctcaaaggccagcccagattcaaaggaggagaaataaacactcctgttgatctgatgtgcattaaagagaagaaattagtgagtcatttttaaagactgatcattaaatatagttaccctgttatattttttcataaatgatttccttctccattctacccctataaatttttctctatatgtgagaatttaaaatctgtggtttctttctatgtactaatctacacatagttgtgtttattatttgtctttgatgaatatattatatgatactgaaagcctgatatcctattaaacatttaaataaatatttcacattttagaattctgagctctaactccttctttatcctcagcattagaattagacaaaagcactcagatgtaaaatataccaaatgaggcagtgggggaggtaggtggtaaaatagtttttttgttagtcttctttttctctttttgttcatatattttgagctctcaaaatggctgtaaaatgctttattacattgctaatatatgcttaatttaaaaaaatccaaactctaccaaatttagctaaatgaaataattatatgctgtattggtgtgtaagaggtggggagaaggagcacattctaaacttccttgctcttttctaaatttgtctgtgagagagcaccgattaagagtcagaatttctaactccagtgtggacttcaatggagtaactattaaacaagatgcataacaagggttaccatgataatcaggtgaagttattaaatagaaaagaacatatttctgtcttttataagaagaaagacatcatttccatagagaaatgaaggaactctgaagcctggaaacccttgggaggggagcacatgtattattctagattagaactaaacattccagcatgaaggatgacctcatatggcctccctgtcgaaaggtatgtaaaaacaaatgttataactatgaatttgacattaaccatggggaaatttaagacaaatggaagttatacattattgatgaatctctttgggaaacttgttgaagttatatggcaatttttcattcactaatcagacaataaggttattgggtcatgaatggtaggtagacttagcaaatagtattcctattgtgtaagttcttcttgtgccttttcttgttattaggtaaattatacctggatattctttaaatgggaaattgtctgtgttcgtgtaattgaagcaacatcacatctgttaatagagagtagaaggtataatcagaattttgttacaagtggaaaagaaggaaattaatattctttttgtttttagacatgcaacctatgtattaagtaagacattgttgatggtaagtacgtactgctcggcattgatttcttacttgctgcaaggaggtagacccaaggggaactcaaatatggaagacaggaaataagaagtcaatatagtgaaaggcaagaacttgatttgatgaaactcatcattaaatgatgaaactgatcactcaacatatgctattactagagctttttagtagagatatgttactattggtgtgagccaatataaatttgcattgtaataaagagcactggatctgaaatgagactagcaaatcacttactatctcagtgtttctttgaatgtctataagataggggtaaaaaccgaatataaggtaaggtacatgagaaaaattgtcatgatatttaggagttttagtaataattatataaacattaatatttctgggtaagtttcacaaaagagaaaatcttctaagaagctaaaaggggtaagctttcctataaaggaacgaggagagaattatagcaaaatttcatcagaaatcatgcaagcaagaagaaagtaaagtaaaatatttgaattgtttaaaaaaaacccacaccaacctaaacttctgtatccagtaaaattaacctcccaaagtgaaaaagaaataactttctcagacaaacaaaaactgaggtactccattttcagtagacttccactacaagatgttaaaagatgttcttcagaaggaaagcgatacaatatagaatctcaaatttacataaagaaaggaagaaaatcacgttagtccataaaacaagtcttaacaaattgaatacaatagggattatatcaaatatcttttctgagcaaaatggtataaacctggaaatcaacaaccaaaaaaaaaaaaaaaaccctcagaaactttacaaatacatggaaattaaacaacatgggtctacaccaccaatgggtcaataaaaatgttaaaagaaaaattaaaatttttcgagacaaacgaatggaagtggatcatatcaaaacctatgggacacagcaaaagcagttctaagatgcaagtttatagcaaaaaacacctacatcagaaaaaaataaagccttctaataaaaaacctaccaatgcacctcaaggaactagaaaaacaagaacaaacaaacccccaaactggtagaagaaaggaaagaataatactcagagcacaaataaatgaaatagagacttaaaaaaaaatttaaaagaacaatgaacaaagagtaggtttttcaaaaacataaacaaaatggatgaactatcagttagattaacttagaaaaaggagagaagactcaaataaaaggattaaaaaggagacattacaactgataccatagaaaaacaaagaatcatgaaattattatgaatgactatatgtcaacaaatttaataacatataaaagtggataaattcctgtacacatacaagctactgggattaaattataaagtagaatatctgaacagatcgataatgagtgaggaaattgaatgagtaataaaaaatctccatcagagaaaactctagaacatgatggcttcactgccaaattccatcaaacttttaaagaactaataccaattctccccaaactattccaaaaaataggagtgaatacttcaaaactcaatttatgagctcagcattaccctgattccaaaactgaaataggacacaacagaaaaaaaaataccacagactcatatccctgatgaacagagatgcaaaaattctcattaaaaagatcatttactatgatggagtgggattcatcccagggatgcaagttaataagtataatccaccacattaacagaaaaaagacaaagaacatataataattacaatagaaacaaacatttgacaaaattcaatatcccttcatgttaaaaactctcaacaaatatctatctatatctacatatagaaagtatgtattaaatacctcaacaaaattaaggccatatatgccaaacttacagctaatatcataccaaatgaggaagagatgaaaaagttttcctccatgatcaggaggatctttttctgctgtgataagctaaaatttctattatttatttaattcttctgatgcattttactcagtccagtccagtgatgagaatgtttattctacattgcttggaacatctggatagctacatacatgaattaaagtacagtgcacttaatacaaatgttctacaaaaataagacatttcatttattaaaatttcacagagaggcatacaagactacaacaattactgaggtgaaagtctacagtttttaagaagtcagatgggctgggcacataggcttacgcctataatcccagcactttgggaggctgaggtgagtggattccttgagcttaggagttcaagatgagcctgagcaaatggtgaaacactgtctttaccaaaaatacaaaaacaattagctgggcttggtggtgcacctgtggtcctagctactcaggaggctgaggtgagaggatcatttgagcccagggaggcagaggttgcagtgagccgagatcatgccacaaaactccaacctgagtgacagagtgagacccaagcttaaaaagaaaaaaaaagtcagatggttgtctaactccaggctttgtatattctggttcaggggttatggagaaacatggccaatgtgagaaacaacagcaactgtaagcccttggcaacacactaagaatatggttccccttaatacagagtccatggatatagaagctgcagccagtacactttatttctgttagtcatactctgtataattgatttgtaatctttttgggggcaggataactgtgcaggaattttaacaaacttgactgatctactgataaggagaaggtcagccttatccccacaagtaagcccacacacactggtactgccagttaactgaggagaaacttgtctctatgccaagtatcccctgctgagtaatcccttccactgccccagcatctgagatgaggatgtggatattcagctgagtaggacaaggatgcccactttcactactgctattcagcataataccgtaagtcttagccagagcaactagatgaaagaaacaaaaagaaggcatccaaattgcaaagaagggttcaaattgtttttgtaaaattcatatggaaccacaaaggccctgaataaccgaaacagtcctaagcaaaaacaacaaagctggatgcattatattaccagacttcaaaatatactacaaagctatagtaaacaaaacagcatggtactgtcataaaaacagacacatagactaatggaaccaaatagcctacccagaaataaattaacacatccacagccaactaattttctacaaaggtaccaagaacatacattgagggaaagatggtctcttcaataaatggtgctgggaaaattgaatatctacatgtggaagactatgactagtccactacctctcaacatatacaaaatcaactcaatataaattagacttaaatgtaaaactcaaaactatgaaacagctagaagaaaacatagagaagaagctttatgaaattgggctgggaaagagtcttattttttaataaggctgcaaagtcacaggcaacaaaaataaaaataggcaaatggaattaaatctaactcaaaagcttttgtacagcaaagaaaacattaacacagtaaagagacaacctacagaatgaaagaaaatagacaaaaactttatgtctgtcaagaggttaatatccagaatgtatgagacttaaacaactcaatagaaagagaaaaaataacaataaaaaatgggcaaacaactttaatagatatttttcaaaagaggacatgcaaatagccaactggtatatgaaaaaaatgctcagtgtcattaacacaaagcaaaaccacaatgagataccaccttactccagtcggaatggctattaccaaaaatataaaagaaatcaagtattggctaaaatggggagaaaaggaaacacttacacactcttggtgggattgtaaactagtatagccataatggaaaacagtatgtaggttccgcaataaattaaacatagaattactatatgattcagaaatgccactattgcatatatatccaaaggaaaggaaatcagtacgtcaaaaagatatttgcactctcgtgtttattgcagcactatttacaatagccaacatatggaatcaacccaaaagtttaacaacagatgaatggataaaggaattgtgatatatatatagagagagagaggatataatgttgagtgaaataagccagagactaaatgacagatactgtataatctcactcatacatggaatcttttttaaaaagttgatataaaagcagagtaaaactgtggttactacagactgggaaggggaggaggaataatagaatggtaagaggttgatcaactagtacaaatttttaattaaatagaaaaaaatgaattgggtggttctattgtaaaataggatgactgtagttaacattaaaatattccatattacaaaacacttagaaaagaggcttttgaatattctcatcacagaaaatgcataagatgatggttacactaattgccctgattggatcattatacaacatagatatatatcaaaacatcaaactgtaccctgtaattatatgcaattacaatatgtcaaaataaaaaataaatttttaaaaacatttaaaaagtaaataatagcaacattgtattggataattatatcatgaacaagtgaaagtaatgacagcaatgttgttacaagaaatatattttaaatataaacattcaaataaattaaaagggaagaagaattatatatcatgctaacactaattaatggaaagttggagtagctgtattaatttcagacaaaagcagattttagaatagggaaaattctcagggataaacaagagcactacataatgatagaaaggtcaatactctatgaagacataacaatttttaacatgtatgcacctaacaatagagcatcaaaatacaagagaaaaactgttaaaactgtaaaaagaaacggacaagtccactattatagctggagacttcaaaagccctctttcagtagttgatagattcagcaggcagaaaatcaataaggatatagttgtcctgaacagcactatcgatcagttccgactaattgatatttaaagaacacttccttaaagaaaagcagaaaacacattctcttcaaactcacatggaactttcattaagataggccacattcttggccatgaaatatatcttaactttaaagggataaaaatcatacaaagtatgtcctcagatgacaatgaaattaaaatataaatcaataacaaacaaattttcaaatatctggagattaagcaataacacttctaaaaaacaaatgggtcaaagaagaagtctcaaaatgaataaaatacattttgaactaagtgaaattaaaaatacaaattataatttgtgggatgcagtgaaagtattaagagggaaatttttagttataacactaaatatatatatcagaaaagaaaaactatctaaaatcaataatataagcttccattttaagaagttacaaaaagaatagaaatttagcctaagacaagcacaagaaaagaaaccaataaaaattaaaacagaaatggtcaaaatttgaaaatagaaacaatagataaattcaatacatttaatatttgattttttaaaaataattataaaattaaaaattctagccatgttaatcaagaaaaaaatgaaagaacacacaatttatcagaaataaaagagagagcatccttactagtcacatgaacaatgataggttgacaaaggaatactatgaacaatgctatgcccacgaatttccttgaaagacacaaactatcaaaactcacacaaggggaaacaatgtaaatatttgtatgtttattttaaaaattgagtaaatagtaacctttcaaaaaaaggaaacccagttccagatggttacactggtaaattttactaaacatttaagaaagaaataatgctaatttgttacaatattttcaataaaatagagcactaacattttctaaattatgctatgaggtcaacattatcatatttccaaaaccagataaagacattacaagaaaagaaaactacagatcaatatctgtcattaacttagatgcaaaaatcttcaacaaagcaaattgaatccagcaatttataaaaagaattatataccatagccatttcagtctattttgtgctgctacaacagaataccaaagactctataatttataataaacagacacttattggcatacagttctagagactggaaagttcaataccaagctgctggcttttgatgagggccttcttgctgcattattacatgccaagaggtgagagggtgagagagagagagagagctcctgaagactttttatttaacgcattaaaactcctatgcgggtggatctgttgtggcctaacaacattttaaagactccacctcccaataccattacaccggcaattaaatttcaacatgagttttagaggagacaaacattcaaaccatagcaatagctaagtgggatttattcaaggtatatcaaaaacaatcagtacaacccaccacaacaggtttaagaagaaaaatcatatgatcctgttaattgttgcagagaaagcatttgacaaaatccaacacctaatcaagattaaaaaagaaaaaacaccctcagcaaactggaaatagagggaactcacttaactttataaagaatagctacagaaaaactaacatcatacttactggtaagaaactgaatgcctttctcctgagatcaggaacacaacaaggatatcctttcttgccacttccattcaacattgcagtgaaggtcatagctagtgcaataaaacaagaaaatgaaataaatacatgttagttgagaagaaaaaaataaaactgtctttattcatagaagacatgattgcctgtggaaaagcattctatagaatcaacaaaaaaaaatcttggaattaatacgtaagcattgaaatttcacaagataaaaagtcaatatacgaaagtcaactgataccctacatataaaaatgaacaactgaaattacatatggaaggaggtactaattactaacatcagaaacaaacaggtagatttattttacagattttattataaaatataaaaatactataaagagcttacaacaaattgaaactggaactaaaaatttacaacaatatcaaagaaatgtaagaaccagacaatgtaatagttatttcttcaaagcagcttaagaaagatagtaccatccatgcaaactagtctaaaaaacataagtaaaatttttctaattattttttaaggctaatgaaagcttgatactaaaacttgactagttcattataagaaaggaaaattacaagtcaatatattttataaatataatgcaatgtttgtaaaactacgaacaaataaaattcaaatgtatatactttaaaaactatattacaaaaaacttgaacttattccagaaagcaaggttgctttaatattataaaattaaagtaattcatcacattagcaaaataaaaaggaaaattctatgaagacctcaaaagatgcaggaaaagcattggaaatgattacagaccataattaaattatcttagaaaattatgattagaagagatatctaatcattgtagatgatgtctattgtagaaataatatctacaataaacattatatttaatgctatagtattaaaagttttcatcatgggactgggaataagataagaatgtaccctattaccatttgtattcattatcattttgaaggtttctactagtacaatatggcaaaaaacaaaaaaaaaatgaaaaagaaggaagggacagggagagagatacagagagagaaaaagagagagcaagagaagaggaagaacaaggagaagagagatggaaaagtgacagaaagtggggagaaggaggtaaggaaggaaaaaggaaggaagaaagtacaaaaatggaaaataaagaaataaaacttttatttaaggtttacatgtttttacattaaaaagcccaacgtaaatacagataaattactaaaagcagtacaacttaagcaatgtctttgcacagaggaacagtatttaaaaagcaaaggtatttatatgtaccaccaataagaaataaaactaaaaactcacatttaaaatagcataataaaatatgtaggaaatgacaaaatacataaaagttctaaatatgcaaatcaataaattattgtgagaagcactaaagagacctacaaaaactgagaggttactaatataccaagtgtttagattggaagactcagtattcaatagatttcagttttctgcaaattggcttatgtgtttaatgcaattcctgtaaaaattctagaaagtgttttgttttgtttatatttttgtaaaaatgggcaatcagattttaagactaatggaatgcaaagagtctcaattagccaagctattctaaaaagaacaaaatttgaagacattacataaattaagagagtatggcattggcacttggatagacaattaaatcagggcaaaatagagtccagcagcagattgtcaccactactaacacttgacttagggcaaagatgacacaatgctgtggagaaaggagggcttttccaaaaaataataacgagttaattgcatattcagaagaaaaaatgattcttaacacacaattcactccacactcaaaaatcagttccagatggattatagatcaaaatttacatgagataaaacatagcttctggaagataacataagagaatatcttcataattttgcagcaaagatttcttcaacagaccacaaaatgtactaatcattagaaaaaatatttatgagttggattacattaacatttcatggattacagaaaactaaaaaattatatggaattatgtaaaactatattaaaattttaaaaatcctattttcatcaaagacaatactcttcaaaggcaaacaaataagggaaagaaaatatttgcaatacatataacatatatgtgttatatgtgtgtgtttgtgtgtgtgtgtttatcactcttacaagttaataaaagacaggcaacacaattttaaaaataggcaagacttgaaaagacagctcactaaataaaatattcaaatgactattaaatatctgagttgttgcagcttattaatcaccaggaaaatgcaatttcaattcataatgtgttgatactgttctgtttgttgatgtgggtggtgactataaatgtgttcattttgtacaaaattattaaaatacatttatgatttgtacactgtgtattatacttcaatagaaatgtttatttatacaagggataagtgagtttgggagttagggggatttggctggtagagatggaagaaaaaatgctgatggtatttaccatcatattttccacatgatttccttttctcatctctgtctcttttcttttcatcacataatcacattgtaagtgtttcagtagaagaagtgtggtgatggtgttaggattagggatggaaaaagcaaaattaaggttattctcttctccgttgtattagtctattctcacactgctgtggagaaatacccgagactgggtaatcaatccataaagaaaagaggtttaattgactcacaattccacatggctggggaggcctcgggaaactcacaatcatggtggaagtcacctctttacagggtagcaggagagagaatgagtgccgagtgaagagggaagccccttataaaaccatcagatcttgtgagaactcactcactatcacgagaacgcatggtggaaactgcctccatgattcaattatctccacctggccctgcccttgacatgtggggatgattacaattcaagatgagatttgggtgggaacacagagccaaatcatgtcacccacccatttcatttcctcctgttttaattctgtgttcctttctgcataatgaatatttagcagaaggaaatggaggattgagagtaggagtttcaagtgagaagatcaaactttcctcttattccccccagtcttgataaattagtcctgctgctagattaacactggaagagggtgcttgaggagtcagtcagttatagggttcactgctgtgaaggggaagagtcagaaaataactgatggtgacaataagtagggaaatgaaacaccaatgaataatctaggctgtatctaatggaaacagaatagctgaacagtgaagatcatgggcattagagatagaccagcatttaaattctgttactgtgtgactttaagcaacttacttattttcccaaattctcaattttctcatctgcagtgtgtatgaaataccaatgcctatttcaattaagttgtaatgattaaataaaaatgatgtacaaaaaatgcttatggatacctgatatagtttggctctgtgtccccaccaaaatctcatgtccaattgtaatccccatgtgtcaggggaggggccgggtagaaggtgattagatcataggggcacattttcccgttactgtttcaagtatagtgagttctcaggagatctgatggttttaaagtgtatggcacttcccccttcactctctctgtctcctgccaccacgtgaagaagggccttacttacccttcaacttcagccatgatggtaaattacctaaggcctccaagtgtcatgcttcctgttaagcctgtggaactgtgagtcaattaaacctcttttcttcataaattacccagtttcaggtagttctttatagcagtgtgaaaatggactaatacaatacctgatgcagaataggcactaaaaatatgttaactgggaaaattatgatagtgatagagtgcttcagaatcttgcctcaacagtcttttattttatacctttttaggttaactagccctcagaccaacaatgtcattggttgaagagggctgtccatttcatctgatagagggctctttaggcagcttctatactcattaggttcgtcaaatatgaactgttccagatgactagtaataagacgttttcactgatggcaattgatgtttctcctttccaacacatcaaagtctatcaaaaactgaatcacttgcattctgacatcactccatatgctgcaaaatttcttctactaactttaattttttaggcacctagtattgagcacctattatctatctggcactgcttacactgataatttaaaattaaaagattcatttggtattctctgttaaagcagaaaaacaaaaagatgaacatagtattggaggataagtgttataacagacaaaagcctggaaggttatggaaacacagaaagagaatatccaaactggaataactgacatgggcagaaggatgataaagaaggatgcctggagaatgtgatgggtgagctgagttttaacagatgagcaggaattagctaaattagaaagaggagagaggtcattctaaggaacttgtatagaggcaaagtgatatgagagaatatgttggatttaggaaaatatgaatggttcaacaaggccagctacttgcattttaaatgactgatgcttaggtttgttaagtttaatattttacatgtaacattttatctgtccaattgtggagttaaaactgcatatacttgtattgacccattttcaataagaaagagaattgatagcacatacatgatttatcagaccaattaaattccattgtaaacaggaagaagaatgtttttaaaacttacttttgcgtttgcctagtaatcataatctgatcacctgagatatcctaaaaggctccataagaaatatttatattgtattttaggaaactcaacaattagctcccagcctcagtcttcccaagtgataatatatacaacttttaattttgccccacagaaaaatgatacaacttcttttttttttgagatgaagtctcattctgtcgcccaggccggagtgcagtggcacgatctcagctcactgccacctccgcctcccaggttcaagcgattttcctgcctcagcctcccgagtagctgggactacaggtgcgtgccaccatgcctggctaagtttttatatttttagtagagaaggggctttgccatgttagccaggatggactcgatctcctgacctcatgatccactcacctcggcctcccaaagtgctggaattacaggcgtgagccaccgcacccggccacttctttctgatattatcttgttctgtgactctgaatttaacggatgttcatcaagaatgaaaaggcaacttcattgtgttaaagtctgaatgattttaggtgcaaaaactgtagactacagcctatcttatcatatgcattccaggattaggtaaaacacacccagaaaataataagtcttattctatttaaacaccattcagctggaataattcttgcctgattttaaaatctgagcacccaaatactcactaaaattttagtgagtttacccagataaataactctctttataaatacctgctttttgagatcattttcttcaggactttattttttattaaactcaaaattacgagagaataatcattccacaacatgaaataagaactatgcacaatttattaggaatgataataagtctggctagattttcaaaactacaaatgatatccagagtgattctggtattaacttccaggccattcacattagataaccggtatctcaaaactagtcttgtctgaatgttcatattctgagtctataatctatatatgtgtgtgttccataccaatttgcattaaatggtgcctaatttcagtctctctatcagaaaggctcaaacttcagatttcaccaacagtctttatatggtcctatagttttaggctgatatccatccgatactgaaatttaaggtgtactttctttcaatatgctctgcaaaatgccaaccatggttgcctatttcctggggatgacattccttgtgaattctccgatctgtactttggtgttgtatatgtgttcacataagcacctaaatttttggcagagagaaggcaccagattggcaataaatcacctgaaaatagcttttcagtatgaaaaatgttggactctatgatgcttcttatgtaacattatcaaagatacccatttcactaccatttcatcttagtccaaaccctaccatgtaatagttcaagattttaatgtttagatttttgtgccctataaacagaattcactacacatgtataggctctgaatttactaattgaagataaagtaaataccatatcttacaagaaaattatacaaaccaatactaatttataatttgcagtgtagctcaatgaatctaatacatgattttgtatacttgggcaactttgagaacagtgaatgtgcgtgaaatgttcattgaagactttgatttttaaaaattccattagtaaaacctatgaaccatattgtccttgcctcaatcaacattttgactgtcaaactctctttcctatctgatcacatgcatttctataagtttacagacagagaaaggaaggtgttttctttgttttaataaaaagaaaggaagagatacttttcaacacttcaaatcccatcagcctggtcaaagataatttgcatcgtttacttttattgccctcatcaatagatccaattgtatttctgtttagcccctttattttttgaattcacttttacctttctgatcttatctttacttatttcattcaggattttaagaattactttacctctctatccttataaaacttctaaggacttctaactggcaattgtgtaatatcaaagccaattgtctctagttagacaattttaaatatgtacaatgatagctgttatccataacaaaattttaagattaataacattaaggtctgttaaaatgcaaatgtaacaataatttagttatatgctgtattttttctatgattctgttttttgggggatacatattctatatagcttaaattccttacttatgagcataaaccagagtaaagtaagggagtggatataaatcaagatagctgctcttttacttcagggtaaaaggctgctttcatgtctcctcaggcagggagtaacagctactccatgaaaattgatccacagccatccttctaccctgaccgttaacactaaggtgcgttcagggaaggatcagaacatgtctatattttgctttcgagtcacaaactttgccattttatatctacagaggcaatcagtacaactgtgcagaacttctggaagattggcacaaagcattttaaaaatcactttctagtctatattaaattcttcaagaatacttatgaagaaacaggaagtaactaactttctttaccttttcaagaattggctcgtgagaaaaggtaatatatgaaacttgtagtgttttaaaaatctttgtactctagccaaaaaaacttaatagataaacaaataaattctcctagtaatataatttttactttagggcttctttagctcttaaaacttccttattaacagcaaattttcttcatttttttcttatcttaattttccatgactagtcttcttttttattccaactccaagcttgtagaacaactcagcaaatgtcttggggtgaatgcctgagcccaaggcctctttactcttgtggccaagtctgtctgacagattctggaattactgattgtcaggctgatttctcttcccatctccacacttggtctgtcctgccttgcacagaggcatgcagacaccccagtatacttgtctagactctgctcacacctatggtaatagctactcctcaggccaaggggtgtggtacatgctggacccagtcttgaaaaaagaggtcctgtaagacctagaagcaggcttgggtgatttgagtgtgggattctagagttctgtgtgtcttggcatccggtcataaaatcagtgggcaggtcctgggtgagtgtatcctcttggatccatggactcctgacccattgaatagaggtgaggtcctggaaggccagggtagccccctctaagttcagggctcaaagctgggcctcagttttccaggttaaaagttattattgtggagaagccttctagatacatgtgaggaaatactagatattatataaacagtattattcccagccatgaacaacaccagcagcccatgtttaattaaaaatgtggaattgaaaggtaaatatgttttataatgaaccccaagctaaagaaaacaaaactataataatgaatcaaagaaggaagtgagtagaagctggaaaccatcattctcagcaaactatcacaaggacaaaaaaccaaacaccacatgttctcactcataggtaggaattgaacaatgagaacacttggacacaggaaggggaacatcacacaccggagcctgttgtcgggtcgggggagggggagggatagcattaggagatatacctaatgtaaatgacgagttaatgggtgcagcacaccagcatggcacatgtatacatatgtaactaacctgcacattgtgcacatgtaccctagaacttaaagtataataataaaaaaatttaaaaaatgctttgagaattctaggctagtaatcacttactccatgaatattttataggtacctgttatgtctccaatgctgtactaggtgcaaggaacacatcggtgaaaggaaaggacaacatatctgtcctcatgcagtttatgttcttcattacgtaacagtacatagagagacaaacaataaaaacatatttagaaagttatgtatataattggcatagtaactagaaatatttataaggcaaataaataaaataagcagtgaaagatgagcattgcaggcagggatgagtagtgcaaagtttctgtggtggaaaatggcttttcatgggacaatatgagatgaggttgaagagaagagtattcagcaccttggccaggcccggtggctcaggcctgtaatcccagcactttgggaggctgaggcgggcgtatcacgaggtcaggagatcaagaccatcctagataacacggtgaaacccagtctctaaaaaattagccgggtgtggtggcaggctcctgtagtctacaccagctactcgggaggctgaggcaggagaatggcgtgaacccgggaggcggagcttgcagtgagccgagatggcgccactgcactccagcctgggcaacagagcaacactctgtctcagaaaaaaaaaaaaaaagactattcagcaccttgtagactatgataaggattttaattttattccaggagtaataagaagtccttaaaaggttttcagcgggaaagtttcaaagtttcagatataatgtacattattgagagatggctatattagttagcttgggatgccataacataaaaccatagactgggaggtttaaccagaaacgtattttctcatattctgaaagcttggaattctgagatcagggtgtcaacatggtcagattctggtgaggaggactctcccatgatgcagacggccctctgttcactctcagtgtgttttttcatggcaggtatgagagagagagagagagagagcacaagagcgctttggtgtgttttcttataaaaacactaatctcatcatgaaggctccacctttatgacttcatttaattataattagctctcaaagtctccatctccaactaccaccccattgggaattagggcttcaacatatgaatggcgggggggacacacacattcagtccataccaatcactggttgttgtgtggagagaggtacaagtggcaggaaggagaccagaaagaaggttattgtgttccaagagtaatgacagaaaaaatgttatcacacagcacaatttactcaagagtctaagacaacataaaatgcttttgaatatttccattttatagctgtattttaaaaatcaccttgaacattttgcaattctcaagcattatgtttatgtactatttgtgcaggcaaaaagtggatgtgggaggaaaaggccaagagcaggtcagtcttccttttcagtccctgccggtataacttgtcaggaagcatgacaatattaaatgggtgggaataagagagcagagtggatttaaatccagcctctacgtaaagattttctgggatcctactatcaaccccacctaaaatgtttgctttaggacacagatttcagccaaataacaggccaagctagggtgaaaagaacaggacactaagtcaaatgtgcaagttgttgcaggtctcaaggatcctgatattccttactcttttgctgccaccctacctacccctgctatctttcttccccaccttcctgtatttgctctgaatctgtgtttccctcttcttgctcagctcactgattcaacttcactggaccccagctatttgcaaagcactattgacttttcctgaaattctctcctaggttctcagacacttgtttaaattgttaaattgggtattaattcaactaggggtaaggaggaggggaaaataccacaagctgcctcatttcagcagtcccctgatagctttcccaactccaaaaatcagtttcaaccaagtgtgctactacatgtgcaaaaaagcaatgctacggcagctatctgagagtatgacagtgaaaaaaaaatagactatttccggtcactgagtaaaataattattaacgtgtacaccatagctgctgtagacagttatgtactatggggaatgcagcaacaaatgaactggtgttgcgtttatgcccctatgccctgacaacacggccttattaattccaggaggccctattaacagggtggcaagtggtctgcaaccttgttttctcacccattaaccacagcaccttgaccacaagatggccttttttatgtattattacataatgccagtctgattttcccaaacatagctcacatagcataacaagaaactacttggctttggccaaacaaggcttggctgcctgcagcccaagtgacactccctcctgtcactagagaggtatgatctagttgaggaacaaaaaatgaaataaccactgagcaattccagataatgtaaaaagaatctttgtctattgaattcaactgtgaaaaggacatcccaagcaaactcttattcatactagcttaagcctactctgctactcaagtttcaataatttggactgattcattcctcaagccaagtctccattgtttttctcctgcggaaagtctataaagatgctgcaagtaaagcctgcaagataactgtagagctgaattccattcttccctgggctgctcctccaaacacagccttcattaaccctggataagtaacatggaggcaccaggcttagagagcaaatgtttgaaattagatatgatcactgccaaataaatctatttggcaacttaacccctaatataaaacccactaaaagacagatgatatagttatatatgtaaatagagatacagatacatagatatgcattagctatagtgactactacatgcaaagttctgatgctctatcagtgaataaaagaggtgaggggaaatagtcattaaatgaatatacaatttattatgtgatcactattatgatatgtgctttgaagaagaaattaggtgctttgaaaacttataaagaggttttgacctagtcttggggaccggaattagctgttaggattcagtttcagcactaataataataataattaacttcccctcttttacttagaagtggtctggcctccctgctaggtagtgactcctctagactttacacaggccacagaagaactttgttcatttttgcaagctccacagtccatcttctgaaaaactacatgacacttggtctcaggaggaaagataaccaggaccaaggtcctcatacctaatctctttagtttacctgactcggcaggaccagcgctgccctcccagttatccatcaggatgaggacacttatctctacatggttctatatatgcccttaaatctgacccagttcttcctctcctccccaccactctaaattcttgttttgtggcttctgaaactcatagtctgcttgcagctaactgttatatctttgtcttttttccagtcattcttgttacctttgggctctcactgaaacttggccctccccacggtcacagctgcccctgaagccttctcaagtgatggctcttttctcaaccatactttatgtctttctggttcttgctcttccttgctaatttctatatgctccctgataaatacatagtcatgcacacacatacacacaccgaaaatactcccgtctgaagacactaccagttgacagcaactaacatttacataggttgaatatcccttatctcgtcctagggaccagaagtgtttcctattttagattttttcggattttggaatattcgcatgtacatacctgttgttcactcttaatctgaaaattcgagcatgtcagggctcaaaatgattaccctgttccaggcatcgatctgacttaatattcacaaaacactctgagttacatatgttcctatccttattctactgatgcacttgaggtactgggatattgggtgaaatattcacagtcaaacagctaggaggtattagagtggggatttgtaccctggaagtatggctccagcgttcatcttcttaaagactctgtcatattgcctcccatcacttgctggcctgtgatgcagtgatgatctcagttctgtgtattagtctgtcctcacgctgctgataaagacatacccaagacaaaagaaagaggtttaatggacttatagttccacgtggctgggaaggcctcacaatcatggcagaaggtgaaaggcacatctcacatggtggcagacaagagaagagagcttgtgcagggaaactcccctttttaaaaaccatcagatcttgtaatacttactcactaccatgagaacaacacaggaaagacctgccctatgattcagttacctcccaccaggtccctcccacaacacgtgggaattcaagatgagatctgggtggggacacagccaaaccatatcattccacccctggcccctcccaaatctcatgacctcacatttcaaaaaccaatcatgccttcccaacagtccccaaagtcttaactcatgtctgcattaactcaaaagtccacagtccaaagtatcatctgagacaaggcaagtcccttccacctatgagcctgtaaaattaaaagcaagttagttacttcctagatacaatgggagtataggcattgagtaaatacagccattccaaataggagaaattggccaaaacaaagaggctacaggccccatgaaagtctgaaatctggcaggacagttaaatctttcaaagttccaaaatgatctcctttgactccatgtctcacatccagtttacactgatgcaagagatgagttcccatggtcttgggcagctccacacctgtggtttgttagggtacagcctccctcttggctgctttcatgggctggcattgagtgtctgcagcttttccaggcacacaatgcaactgtcagtggatataccattctggggtctggaggacgatggccctcttctcacagctctactaggcagtacttcagtagggactgtgtgtaggggctccaaccccacatttccctttcacactgtcctagcagaggttctccctgagagccctgccccgtagcaaacttctgcctggacatccaggcatttccgtacatcctctgaaatctaggtggaggttcccaaactccaattcttgacttccatgcactggcaggctcaacaccacatagaagctgcaaaggcttgaggcatggaccctctgaagccacagcctgagctctgtgttggctcctttcaggcatggctggagtgcctgggacacagggcaccaagtccttaggctgcacacagcacaggcaccatgggcccagcccatgaaaccactttttgcctcctaggcctctaggcctgtgatggaaggggttaccttgaagacctctgacatgccctggagacattttccccactgtctttgggattaacattcagttcctcattacttatgcaaatttctgcagccagcttctcctcagaaaatgggattttcttttatattgcattgtcaggctgcaaattttccaaacatttatgctctgcttcccttataaaactgaagcctttaacagcacccaagttacctcttaaatgctttgctgcttagaaatttcttctgccaaataccctaaatcatctctctcaagttgaaaggtccacacatctctagggcaggggcaaaatgccaccagtctctttgctaaaacataataagagtcatctttgctccagttcccaacaagtccctcatttccatctgagaccacctcagccttgatttcattgtccatatcattatcagcattttggtcaaagccagtaaacaagtttctaaggagttccacactttcccacattttcctatcttcttctgagccctccaaactgttccaaactctgcctgttacccagatccaaagttgcctcccccttttggggcatcttttcagcagcaccccactctactggtatcaacttaccatattagtctgttttcatgctgctgataaagacatacccaagactgggcaatttacacacacacacacacacacacacacacacacacacacacacacacacacagaggtttattggagttccacatggctggggagtcctcacaatcatggtggaaggtgaaaggcacatctcacatggtggcagacaagagaacagagcttgtgcaggagaaattcccctttttaaaaaccatccgatcttataagacttattcactgtcacgagaacagctcaggaaagacctgcccccatgattcagttacctcccaccaggtccctcccacaagacgtggaaattcaagatgagatttgggtggggacacagccaaaccatatcactctgagatcattgtttttttcctctgttactagtcctgtgatcaaccttggtgacttcaatagatgggaagaaaatgcaacacttaggcctcatggttccttgatgccattccccattcatgcactctcctggatgtcctcttcatcttgtcattgccaataactgttccatctcccaaatcccactctcaaatatctcaaataacacctttcatcttcccacttatagactccagcacctccactcccatgattgttctgcatgcttcgtttcttcctcactcacttgcattccatgcctgattacaatcatgtccttgcacactccttctctttccttgcccttttctttctcaatccttctttcttgacaggattctaatccaggttgaatttagctcttcacctacctcataattctgtgcagctgaacatgaagtaaagatgaagtcatgataattttaaatttataaaagcaaacttcagcaccacctagtaactaccttttactaaatcagttctctttcctagactataagataactaaattttacttactcttctttctctacaaacctgaaacatcacatacttaatcttgtataagtgataattttgcctcatatgtctgagcaaatagaaatcacagagaccatcctcatccttccaccctcaaacttccaacctacctgcattcatgcacttgtactatgtatctcttcccttcaaaagggatggtattccaagcccatttccaaaatcatttttttatttcacaatataattaactttactatgtagaaatcaagcaatatattataaaatgtaaacaaaagaaaaccaaatgaacctatatccaatgttttgaggttttttttctagcttcagtattgtttttctctcaggatgtatccctgtagttttattttgcttttccccaaagtaattgtgcacctatcaacacaattgtggaaataagtaatagatgtagcatcatcactttcttattgtgttctcatgatgaattcagcatttctcagcatattgagagtttaaattattaatcttatacataatccaaaaacacattcataacatacagcatataatatagagagaacaaactatactctggtgtccagtgtttgtgacaacacaaaccagtagagaaaagcttgaactgttttgcatgtcaccaacacaaaaagatgaaaaaacatttaaatgtaagagcaacttaagcaaacttttatctgcttaccttctagatagcttgatataaacaatataaaataatttatttcaatttcctgtccaattctttttttctgtttatttttggtttttattttttatttcaacaggtttttgtgtatgggtggtgtttggttacatgaataagttctttagtggtgatttagtgcacaccatactcagtgtgcagtcttttatccctcacacccctctcacccttccccccaagcctccaaagtccattgtatcattcttatgcctttgcatcctcatagcttagctcccacttatgagaacatatgatgtttggtattttattccaaaaaccaaacatcacatgttctcactcaaaagtgaagagttagttcacttagaataatagtccgcagttccacccaggttgccacaaatgccattgttttgttcctttttatggctaagcagtattccatggtaaatatgtacacattttctttatccactcattaatggatgggcatgtgggttggttccttatttttgcaattgcgaattgtgctgctgtaaacatatgtgtgcaagtgtctttttcatataatgacttattttcctctgggtagatacctaggagtgggattgtgagatcaaatggtagacctactattagttctttaagaatcaccattctgttttccacagtagttgtactagtttacattctcaccagcagtgtaatcgtgttccctttccaccccatccacaccaacgtctatttttttttatttttttattatcaccattcttgcaggaatgaggtggtatcacattgtggttttgatttgtatttccccgataattagtgacattgagcattttttcatatgtttgttggtcatttgcatgtcttcttttgagaattgtttattcatgtccttagcccactttttgatgggattttatttttcctgctgatttgtttgacctccttgtagattctggacattagtcctttgtcagatgcatagtttgctaagattttctcccagtctgtgggttggttatctgtttactctgctgattatttcttttgctgtgcagcagccttttagtttaattaagtcctatctatttatctttgtggttgcatttgcttttgggtacttggtaaagaagtatttgcctaagccaatgtctagaagggtttttctgatgttatcttctagaatttttatgctttcagatcttggatttaactctttgatctatcttgagttgatttttacataaggtggaagatgaggatccagttttattcttcttcatgtgacttgccaattatcccagcaccatttgttgaatagggtattctttcctcactttatgtttttgtttgctttctcaaagatcagttggctataagtgtttgggtttatttctgggttctctgttctgttccattggtctttgtgcctatttttataccagtaccatgttgtttcggtgactatggccttatagtacagtttgaaatcaggtaacatgatgcctccagatttcttctttttgcttagtcttgttttggctatgtaggctcctttttggttccacatgaattttaggatagttttctctagttctgtgaagaatgatgatggtattttgatgggaattgcattgattttgtagattgcttttggcaacatggtcattttcacaatattgattccacccatccactatgtgttttcattatttgtgtcatctatgatttctttcaacagtgttttgtagtttttcttgcagaggcctatcacctccttggtagggtatattcctaagtattttatttttattttttacagctattgtaaaaggggttgagttcttgatttgattctcagcgtggtcactattggtgtatagcattgctactgatttgtgtacatgaattttgtatcctgaaacttcactgaattcatttatcagttacaggagctttttggatgagtctttagggttttctaggtatacaatcatatcatcagcaaacagtgacagtttggcttcctcgttattgatttggatcccctttctttctttcttttgtctgattgctctacctaggatttccagtattatgttgaatagaagcggtgaaagtggacatcctttccagtgttccagttctcagagggaatgctttcaacttttccccatctagtatgatcttgacggtgggtttttcatagatggcttttattaccttaaagtatgtaccttctgtgccaattttgctgagggtttgaatcataaagggatgtggattttgtcaaatgctttttctatgtctattgagatgatcatgtcatttttgtttttaattctgtttatgtgatgtatcacatttattgacttgcatatgttaaaacatccctggatccctggtgtgaaatccacttgatcatgatggactatctttttgatatgctgtgggattcatttagctagtattttgttgaggatttttgcatctatattcatattcatcagggatattggcctgtggttttatttttgttacgtgcttccctggttttggtattagagtgatactaaattcatagaatgatttaaggagtattccctctttctctgtcttttcgaatagtgtcagtaggattggtaccaattcttctttaaacatctgatagaattcagctgtgaatccatctgatcctagatattttttttggcagttttttaattaccatttccatctgactgctttttattggtttgttcagagtttctatttcttcctggtttaatctaggaggattgtatatttccaggaatttatccatctcctctagattttctagtttgtgtgcataaagttgttcatagtagccttgaatggtcttttgtatttctgcagtattggttgtaatatctctcacttcatttctaattgagcttatttggatcctctctcttcttttcttggttaatctcactaatggtctatcaatttttttaatcttttcaaagaagcagcttttcgtttcatttatcttttgtattgtttttgtttccatttcatttagttctggtcagatcttcgttgtttcttttctttgccgggtttgagattggtttgttcttgtttctctagttccttgagttgtgatgttagattgtctttttgtgctctttcagacttcgtgatgtaggcattcaacgctatgaacttacctcttacaccacttttgctgtatcccagaggttttgataagttgtatcgctattattgttcagttcaaagaattttctaatttccatctggatttcattgttgaccactgatcactcaggagcaggttatttgctttccatgtatttgcatagttttgtgggttccttttaaagttgattttcactgtggtctgagagaatatttgatataattttggttttctaaaatgtattgggacttgttttgtggcctattatatggtctatcttggagaatgttccatgtgctaatgaaaagaatgtatattctgcagcttttgggtagaatgttctgtaaatatctgttaagtccatttgctgtagggtatagtgtaagtccattgtttctttgttgactttctgtcttgatgacctatctagtcctgtcagtggaatagtccccagtgtctatttttcctatctttgtatcaataggtaccccatgtttattttccacttataagtgagaacatgttgtatttgatgttctgttcttgcattaatttgattaggataatggcctccaactgcatccacacatgttgtatttgatgttctgttcctgcattaatttggttaggataatggcctccaactgcatccacattgctgcaaagaacatggtttcattcttttttgtggctgtctagtattccatggtgtatacatgccacattttctttatccaatccacaattgataggcaccttggttgattccatgtctttgctattgtgaatagtgctgcaatgaacatacaaatacatgtgttttaatggtagaatgatttattttcctttggatatatacccagtaatgggattgctgggtcaaatggtagttctattttaagttcttgagaaatcttcaaatttctttccacagtgcctgaactaatttatttttccatcaacagtatatatgcattcccttttctttgtagctttaccaacatctgtcattttttggcctttcaataatggtaattctgactggtgtgagatgagtcaaaatcatcatgatttcgatttgcaattctctgttaattagtgatgctgagcattttttaaaatgtttattgactgcttgtatgtcttcttttgagaactgtctgttcatgttctttgcctaccttttaaagggggtattagtttttgtttgttgcattaagtttcttatagatggtagttattagacctttgttggattcatagtttgtgaatattttctcctattctgtaggttgtctgttcactctgttgatgatagtttcttttgctgtgtagaaacactttagtttaattaagtcccatatgtcaatttttctttttgttgcaattgctctttttaaaataatttcaacttttattttaggttgagggagtacatatgctggtttgttacatggaactacccatgtcttgacatcatcactcacacagggattactttaatcacttcctagcaagcctctttatcctccaattcatgctatagttactgccaatatacatttccctaaacattgcttatgttagtctctgctcaaaaacaatctagatctccctgcttaaaactctatgcaatgtaaatgtctttgcttaatttttaagacatctcagaatacctatccgtgtttcccacaaactcttttgcctaatacagtcagtatcctcatggctatataaaaatctgttgcttctgaacattttcaagtatttttccctcacctaagcagcagttttcaactctgctgccttttaagtttcagcctatccttcaaggctaagacctactctctccatattaacttcccagtctgcgttttttttcatctcccctctatgctcctgcagcactcatggcatattccacatagatcaacacctgtgcacaaaagtattcaaaagctcattcattttatcttggtttttccagtattacctcctaggaggcaggaactgcattttacacagactccaaagcacttgcacagtaatgaacatacaataggaatttattagctagacactcagaaggtttatgaaccctctttttgcctatttatattttctaaaagatattgatcttttatttatttcagtaaaatattacatgcatgtatagtatgaaataggtttatagcctctatttaagagatctttctgggacgctcaaaacaatctaataagcacttagaatgatacttttatttcttctcactttctcttcttttctatacagagaaccttggcaatatcctgaatttagtactaaaagcaaaggataaggaaggtgttatgtggcctctgtataacagagaatgttctatactgaaaacttatgatatactttctaccttagacaaagccagacaggtaagattttctttatcatagtgtctagcacaagctggggaatataactgctcaataaattattgttaagtgattgaatttttgataattcactcaatagaaccttccatttctgaaatatgcacataatatcttcaggaattagatctgagtagcatttcccaaggcaatccctcattctaactttgagaaggaatgtgattaatttgaagctgctattctaatttttcatttttagatttttactattatcttgttttagatttttactactatctggagaaacagcaggccaagagccttgcttccataccaccagcaatttcttttgggtagcaaaacaatttagagctatagaaacagtattagaaaccatgtattccaacccattcactcttcagatgaggaaaacatctctcaggttagatggggaagccaagacagaaatcaagctcttttaaacaagtaactaccttacctacatttaaataaataaggatggcaaaataccatgcaatcttggggctgaatagaacttacagatggttcattattctttgttttagcacttccagtaattggcaaacagctctttctacaatggaatgcctctaaaaattagaaatattctcaaaagagtatttctcagtgaattatgttgaatcaaaattcatcttctcagaacttagtagcaacagccctagttttgaattctcaaacagtaacaacaatccactccctcttccatgggactgaactaaacaatttatacaacccttaagattttctcttcccaagttcctctaaacttccttttttatggcatggcttccctctgttttgacaataatcttattagaatttgttcttgaatcttagaatgctttcaattaaaggcgacagaaaaatcaaactcaagttggcttaaagaataactaaaaactccagggtaatttaggcacagttccatcagagcgctgggtccattttccagtggtttgctctgctccacttttatcggtgttaactttctccccagactgacttccctcctagctgttggatgcctgccagcagtaattagtgctgcatgatgcctcattcagcaagaaaggcaggttgctacccattaactgctgaaaaaaaagaaaacactgagatttacatcaattggccacccctgaaccaatccgtaaaaccaggggaatgccacacactgataagcttaggcctggattaattaaaccaattacagtgcaaaggaagatggaattttcctgattggccttagctgagcatagcttactcttgaagctagggtgaggtcaagttcactcaaaccttattgctggtattaacagagaaggtgtaatggatgttgaggaaaaaaccatagcttccgtccaccatgcgtgtatacctgtatgtaacactcaggataggtctgacaaatgtccgagttcagtgaaatattagaaatcagtcttgtggccatttccctcattttgaaaatgttcttctattaacatagtcttaccttgaattcactttctttttttaagccggtgtaattgttagagtttgtggttactgaagtacctaaagcggttttttaatttcattttatactcctttcgagttgaacttttaaaacctccccgccaaatgtattcttatggaactgatggcaaaaaccaaaacagtacattaattcggctccacaatctccatgttctgttttttatgcattgttctatctactaaaacacttcaaattatgtttctaaaagtcagtacattagctgaccctttgcagactgatgcctcttcacccagattgggtttttaaatgtgaccaagacaaagccagagacaaagccatgagacgtgctgtgagaaaccttcctgcaagctaacatcaaattaataactacatgcagttgttcaaccagctttacatatctgcttacgtccactgtcattcagtcatatttctacccttgttcccaaggacatacgagtgatttcgtcaaaatccctacctaaacacaaatattgcaacctcccaaccccctaaaatctcccctgctactcaacctacagaaaattaaatgaggctaatttggcaggaatgcttttagtgcactcagactggatcttagaggttgtctcattattttctaagtgatttcaattccttgttaaagtaatccattctaaaatgctgttaaagatcaacattgctgatctagtagtttccagaatctaccttttaaccctttgagagaattggggtgatatttgcttagatcgcatcttctagcagcactccccttctctgtgatttctgtggattactgccaatcattctatgattacatctgtaagtcctttcgacaccttggaatgtaatttgtctatgactgcaaacttgaattcatttagaatgtctgggtggcttcctatagtctcttctttttactttttctgggacttcaattcattgttaatggtgtttttctagctgttctattttgatgataacttcttcatagtggcaaggacagattcaaaataggaacagagtaattctgcctcctgcctgtatttgttagcctctcatcatctattctaaacagtgggctgatgcactatattctcataattatgattcctagcttttgcagaagtacttttctctgctgggaacactcttactgttctcaaactttctataatctaacttttattcatccatcaagtcttagcaataatctctcttaggagccttcattgatccttcaaagctaaattagatccccctcctatatcttatgataccttatgatagccctttggtggaatttagtagactgtattgtaaatgcctgttagcatggctgcatttcccatttgactataagtggttagaggataaggatctttccttgttctcttctgcagagattttcatagttcttggcaccaaataggtgcttagtattaataattgttcaatgaattaaacctgtaaaggtccttttggttaactttgagcattttttaatttcttatattttcttccaagatttattttactgccacatcaagtttccttggtggttgaaagtaaatctagaataataatttcttcacaagtttttttcagtgaaaagcttccttgtttaacctctgaggtattaattttttgggaagcttaaaataatgtttcttatgaaaaaaggaaaaaatcttctaatatacatatatcctggatcagaaaatatgctcatcataaatgtttgaggtgcatggagtatacttcacaaatggaagcgtgaaaataaaagtgagatgactatttttgtagagacaaaatgtaacaaatttcattagaatttttttaaacacaggatttttaaaaaacacatttcagtcattaagacaactttaatattttgaaagcttgaaaaatatattttttctcaaatgcactcagtaaattttacaatctttcgtttttctgtttatcaatggtatttcctactgatacacttttcttacaacaataaatctccttaacttattcaactttataaacacctgttcagtagtttataaaattttaaagctaatggtataacaaactcaaatgatgatattttatatttataagtgcatcctgagatgaataagtaatgaaaacacagtctgctgctactaaaagtgaggggcttaagaagtttagctacaaagagatggaacgcacttgatttcatctggttttaaaatttaagtagatttgatccaggttggttcttaaggaggtcaacagaaaataccctattattttttcttctgttcagcactggatatgcagtaattttcctgatctactgccacagattgaatgcattgttgcattttttttcaaattatcttgtgttatatgacatgcttgctgacagactaggctgaccacagttttcaattaaacttatcagtcaaaggtcatttacaagcaactgcgattgactgagacacagaagtattattttcattgattagggtttaaagagaaaaattgttgccaattggtacagtcgaaagatatagtacaaataatctgtagctacattttagccaagtgcaatgacagattccaagagagaggacttaaaaatgtcatctttagttttttaaagaaaaatattattaatatagttataattcatttgtatgcagccaccaaaagaaaaaatatctgcaatataatacaatataatggtaacaacaatgtaacactaacacatattttatactgcatgttaattgtaatagtcaatatgaactgtcatgtttataataaaatataatatttacataataaatatgagtcatcatattatctactttcagtagaattaagaagattggcttctagtgctgagacaaccattaattatctgtacaatctagggcaaatcatttaaactctctaggtctcaatgatttctatacataagtattaacccctcaaaaaattataatctacaaagtttatagtagaggggccttgagttacttttaatatttcataaggctcttgggaactttgcacttaaccacaataaaaactcataagccccatatggtttctgatacataaaaactagttaataattaataaataatgaaatgaataggagaataaatgaaaaagtaaatgaatgaatgaatgaatgaataaaaattagaacactaggttgatctttactttatatcaactccgttgtctactggttatttcttgctgatctgatttccaattatatatgcttgtgattatttaaacatgaattaggccaggtgcagtggctcatgcctgtaatcccagcactttgtgaggccgaggtgggcagatcatgaggtcaagagtttgagaccaccctgaccaacatggtgaaatcctatctctactaaaaatacaaaaattagctgggcatggtggtgcaccctgtaatcccagctactcaggaggctgaggcaggagaatcacttgaacctgggaggcggaggttgcagtgagctgagatcataccatggcactccagcctgggagataaagtgagactccatctcaaaaaaaaaaaaaaaagtgaattaacagttactttttccatgcaatttgaggagtaaaatttttttaatacccagagcaagtcatgggtattaataaaaatgatgcttggtagcaataatattagaaaatgatagaaaaatggaaatacttctacctatacaagtaccataaatccttttcagtgactctattgcagctatgaggaattctcaagctttttcacagggattgttgtctattactttcatcattttatgtaatatgatcctacctgtgacaatcccttagcctaaaatctcaactaacatattgaaatcaataaaaattttcttacttatatactggttctcactaatttcacctaagctcaattttatttcatttaaaactatatttgcctacacaactcatccattcacaatgattgattccaagggtgagatatattttattccctctagaacaagaggtcctgatcagagggtaaaaggtagaaaggttttttcccccttatccttagagaaaattgttagtccttctccttatgtaaggaagaaagtaaaatacctttttttcattttttgaagtaatgtatgacaacttagtgctatttcctctaacttttccctgaatatgttcctgattccataacaaccgtactcattctttatttttcttatagctgagttgataataggctccaatattgttgttattattggtattcactggcattctctgttatatagccttgactaaaaagccatgaaaacaatttattgtggtaaattatacaactacttgttcacaaagcgagagtattaactgacatttgtctttcctctcctgttaagtctgttcattgctgttgatgatcaattcattattgtttaatacatataatttttatcaaatttaaatggactaggctgaattatgctgctctctggataatagaattttaagtcagcagcatgtttaatatgcatggaaaaccccccataacctctccaataaataaataaacaaataaatgtatggcatatcagcaaacatggcctttacttgacattggaagaaacacacgtgtcatgtgttaaatatatttaaatgtgtgttaatacatttaatgtttgtgttaatacacacatttaaataaatataaatatataaaattaaatataaaaatatattttatattaaaacaaaatataacaattttatattaaaaataaatataaaaatataaaaatatattttaaatataaaaataaatataaaaatatattttaacttaaatatattttaacttaaatatatttttatatttaagtaaaaataaatttcttaaatctaataactatatccttgctctttcaagacagaaggaacttttcaaggtcaaattaaaattcttatttagaaagttaagaaagcactgaaattatttggaccttagactatgtagttaatcttatcaaatcttagtttccatttttttctgccccacaggacagaaggcacagaagacaaagcctatggctcaccaaagtgataaagccagtagggcatacctacataatgctgggaccctaaatggctctatcctgtgtatggggtgtaccagaaataaatccaccccacagcacaagagaaggaaattctttcctatgatttttgtgctgaattcagacaaaatatctcacctgaacattcatagccaaagaacactcctcatgctgatttgtacactgaatccacattgacttagtggcctaacaaacctaaatccaacaatctatttaaagtggccccaaatagtagtttcttcagggatctcagataaacctaggcaaattatgtttgagggaatacacattccatccaggcttcaaaggatttctacagataaagtcccaagaaacatgaatttacagtcaaaatttaaaaaataatacccacaataaatcacttgatagagtccaacagaaacaacagatgacagaaagactttaaaaaataaaaactagaaagaatgaggaagggacaatattagagatggtatcttaggtcagttttcccagaagcagaccctgaggcaaggattcatgaacaaatgatttagaaaggcaatagtctctatagagatcagcaaggtagcatggaaagcagaaaaggggagagaagaaagccatgccagggtgcagtctcagataaagccctgcaaatatagctttggcctgatcttgcaggagaacgctggagtaagttaacctcagagttgcccaaggcaaagaagctaacttgctatactcctacttctgtgagccactggtcaagggctgtgtggaaggagtaaattctcagggacttctagatttctgtatatgtggataaaagacctccacagaaaaagtaacattctcaaagaagaggcatggttgcaatttgcctgataatagtcaaaattgctttcatacttgtttattttttcttggttccctttaattttggcctggtctcataaactcttctatgtgcataaaaataatgttaaaattttacccttcttatagttgtcctcagtgagacacttgttatggtaaactaatccaacattgtttgtaattgaaagttttacctttattctcaacttttatcatcttttctttgaagttttctcttgtattttatcttttgttggataatgtttcttctaatccattctgaaggtctctgtcttttgtcagtgagtttaatacatttacatttattgcgattgttactaggactcatttctttcttaatatttgatttttattgtatattttctgtgtattagtttaatttgcctttcacactttccattcaatttcatacaagaagttccttcttcttgtatgaaagttaatattgtgttttatttattgtttggttaccagtaaaacaatgatgaatatctacattactttttttcttctacccatttcttagtttatccatatccatatcacctctctctttcttgtctcttattttcttctcccctgccaccacgtttgcatttttaactctgagctttatggatcttttatagattttaggtttgttttagcaacaggaaaatttactatgctgttttcttacctgtacatttcatgtatttcatagatttttctagtttcaacttaccattatacttcctgaaagtattttcaaaagagtcatttgcttgatgaaatttctgagttcttgtttgcctgagaatatgtaagtatgtttcctttgcatgtaaattattgttagttgcatataatatttcagatttaaagtccttttattattactcttgaaaaatgttattctcctctattatgaatataacattaacaataattgcattagtgtttcatttcttgttttttttgtaaatactctgttctttattagaaaactttagtaatctcttttttgtgtttgatgttttaaaattcactttaatatgtttgtattgtctttttaaatcatctaaaaggtttggcactatgaaactttgcaatatttttcttttttaattcttacaaatgttaggccactatttctccaaatacttcctctctttcattttttaaaaatatagtttcctggaaaaccttcaatgtggaggttaacaattatatatccatccttcctctctccaaaattttgttttttcttctctttttctttatctctttcttgtgatgttttaaaattttcctctaatttcaaattcattagtttgttacccaattgtatttattctattttaatttatctactgagttctatttttttcaaaatgtattattctgctcatcttttccattattctccctcatctctttgagaatatttaattcttacttatatttattttaagattttatttatatttattttgaatttctgttccacaattctcttttatctggtataaggtgaaggaatccacctccagtctgagattttctaattttgcaatctgggcagaatcactctctttgctcaccgccccacagtaagcaattacgtactttgaggactcttcttttctcctcactagtcctgatagggaggatagagaagagaaaatcatcaggatccacccaaaatatctgggaacctgttgttattcaccctccaacccagctaggttggattgcctttctgctgtttcctcaccatttgtcactgatgctgggttggtgctgctgttttttctccttactgtaggaaataattctcgcagggcaatgtgaagaaaggcagaaattacaacttaaaagttcttctttaagttcctgctgtttttgcagccagttcttttcgtatctaaattgttcttccctccatatatattagcttatgtctttctaagagtaatcagtattttattttctgtttctcagaatcaaccagactagcatttgtgtcacatatacagaattatattaaggggaagaagacagccatactcattaatttgtcaaaaactgagagaggtttttcaagtgatcttattttacccttataactaagatcaacattattgctatatctccttcaacactgtttttggctgttacaaactaattcatttccacagaattctatgtacctagctcagtgccatgggcaaaagtgtttgcaagaattcctaccttctgttttgctggggaggccaattttcaaaaatctattactaaatttgcacacatgtaatactctgtggaataatacacttgtccaagttgtaaataaaaaaatcctaaatgtaatgataaaattcttcaatatgacttatataggcagtaagtagataagaaataattaaggggcccaactaatgcattctatgaataaataggggtagacaagtaagacacagcatcatgagactttcagtgcctttatttcatacaaatgctgtgaagtggttcatagtctgacaacgtcttctttgagggtgaaggacgctttgaactgctttctagttctccagagtctatttataaattacacttaaataggtttaaaattacttatctctctggtaggtttttaattccagatgaagtattccaacagaaaaaaatcatgtcagatttatttttacatgtttacaaacagccatttttaaatccactctgaaacttttaccttgatcaccccaatatgacagcacagttgtatctattgacattgaccagtattaaattgaagaactcctgtaaattacctctccattcagatctatatgtataaaatgcagtttttctcctcttacatgcaacactatttttttaacttctcaatattttgaaaccatctatttgtccatgaaaaaaaaaattcttcaaggattaattgaacaaacaatttggtgaagacttctgtgaaattatcacaagagatagatcataataggtggttgtaacaagaaaaaaactcctaagaaaaggttttcagaggactctaagggtcaaaaatctcccatgggctttgcaaacagcagccccagttgcaaatccgggacctggctttaggtacatgaagctcagctcaggttgtcgctggcacaaagggtcagctctaaatgaaattctaagtaagtgaattccatctcagtgtacacagtggtatcttttttttttccctcccccctcccccctccccaccacagtccccagagtgtgatattccccttcctgtatccatgtgatctcattgttcaattcccacctatgagtgagaatatgcggtgtttggttttttgttcttgcgatagtttactgagaatgatggtttccaatttcatccatgtccctacaaaggacatgaaatcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagtatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatgtccatttctctgatggccagtgatgatgagcattttttcatgtgttttttggctgcatgaatgtcttcttttgagaagtgtctgttcatgtccttcgcccactttttgatggggttgtttgtttttttcttgtaaatttgtttgagttcattgtagattccggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgctttggacatgaagtccttgccaacgcctatgtcctgaatggtaatgcctaggttttcttctagagtttttatggttttaggtctaatgtttaaatctttaatccatcttgaattgatttttgtataaggtgtaaggaagggatccagtttcagctttctacatacggctagccagttttcccagcaccatttatgaaatagggaatcctttccccattgcttgtttttctcaggtttgtcaaagatcagatagttgtaggtatgcggcgttatttctgagggctctgttcgttccattgatctatatctctgttttggtaccagtactatgctgttttggttactgtagccttgtagtatagtttgaagtcaggtagtgtgatgcctccagctttgttcttttggcttaggattgacttggcgatgcgggctcttttttggttccatatgaaatttaaagtagttttttccaattctgtgaagaaagtcattggtagcttgatggggatggcattgaatctgcaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctttttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagatcttccaaccctatgttgaataggagcggtgagagagggcatccctgtcttgtgccagttttcaaagggaatgcttccagtttttgcccattcagtatgatattggctgtgggtttgtcatagatagctcttattattttgagatacgtcccatcagtacctaatttactgagagtttttagcatgaagggttgttgaattttgtcaaaggctttttctgcatctattaagataatcatgtggtttttgtctttggctctgtttatatgttggattacatttattgatttgcgtatattgaaccagccttgcatcccagggatgaagcccacttgatcatggtggataagctttttgatgtgctgctggattcggtttgccagtattttattgaggatttttgcatcagtgttcatcaaggatattggtctaaaattctcttttttggttgtgtctctgcccggctttggtatcagaatgatgctggcctcataaaatgagttagggaggattccctctttttctacttattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagttcctggattcattgattttttgaagggttttttgtgtctctatttccttcagttctgccctgattttagttatttcttgccttctgctagcttttgaatgtgtttgctcttgcttttctagttcttttaattgtgatgttagggtgtcaattttggatctttcctgctttctcttgtgggcatttagtgctataaatttccctctagacactgctttgaatgcgtcccagagattctggtatgttgtgtctttgttctcgtaagtttcaaagaacatctttatttgtgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgtttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgccttttgttgttttccattggcttggtagatcttcctccatccttttattttgagcctatgtgtgtctctgcacgtgagatgggtttcctgaatatagcacactgatgggtcttgactctttatccaacttgccagtctgtgtcttttgattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagcgcttccttcaggagcttttttagggcaggcctggtggtgacaaaatcggtcagcatttgcttgtctgtaaagtattttatttctccttcgcttatgaagcttagtttggctggatatgaaattctgggttgaaaattcttttttttaagaatgttgaatattggcccccactctcttctggcttgtagggtttctgccaagagatccgctgttagtctgatgggcttccctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacacagtcccatatttcttggaggctttgcccatttctttttattcttttttctctgaacttcccttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaaatcattctccatccagctttgttccattgctggtgaggaactgcgttcctttggaggaggagaggcgctctgcgttttagagtttccagtttttctgttctgttttttccccatctttgtggttttatctacttttggtctttgatgatggtaatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcgggttctcagacctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctcagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcgtggtgcgctgttttttaagccggtctgaaaagcgcaatatttgggtgggagtgacccgattttccaggtgcgtccgtcacccctttctttgactcggaaagggaactccctgaccccttgcgcttcccaagtgaggcaatgcctcaccctgctttggctcgcgcacggtgcgcgcacccactgtctggcactccctagtgagatgaacccggtacctcagatggaaatgcagaaatcacccgtcttctgcatcgctcatcctgggagctgtagaccggagctgttcctattcggccatcttggctcctccccccacagtggtatctttctccttcaccttgctccccttgaattctccctcagacattcaaggtttaaagcttcccccttcactgccgacacaaactcattttatcatgtattcattcagtgaacaatttgtaagaccaaataccagatgctagagttatcaagcatataaggcagaagatatatccttaataattcacagtctaatggagagaaaggtacaaaataaatgcaatttaatgtgatgaacacaataattagggttaaatactctgcataaacacaatcaaagaagtaagttatcaacttcatttagatagctcaaggaaggttttgaattgaaaaagacatttgaaccaggtctagaaacattaggtgtgggagacaggagtaagggaaagggcacttcatgagaattaactggatatgcaaaagcagaaaaaacttatagcaaattgatttacagtgaggtgtgaaattgctaggctaaaaggcagaatattaggtctgaggaataaatccctaaaacataaatttttagaacctaaaaaattaggaatatcatttgattttgcagggagaccctccaagaaacccagaaaaatgatagttattctgcttactcttaaatataaaaaatatattttaacttaaaaaatatttaattgttatagatacataatagttatacatatttatggggtacatgtagtattttgatgtaagcatacaatgtgtaatgatcaaatctgggtaactggtatatccatcacctcaagcatttatcatttctttgtgttaaaaacattccaagtccactagtttagttatctttaaatatgcaataaattattgttacctatagttgccctcttatcctactgaacacttgaccactagaggtcccccgacttgacagcattcattattttttgtcttttaataaaagccattttaaccagtgtgagataatatttcattgtagtttcgatttttatctgatgactgatgatgttgaacattttttcatatacctgttcaccatttcctgacatgtttatcatgaaaaacggttcaacgagaaaaagaaaaccatttgtgtctcattttgagaaacgtctattcagaacttttgctcattttttaatcatattatttgtttttatcattattgatttgtttgagtttcttatatattctggttattaattctttgtcagatgagtagtttgcaaatattttctcccactctgtaagttgtctctttgcatattgaacatttcctttgctgtgtagaagctttttagcttgatgtgatcccatttgtccatttttgcctgggttgcctgtactattgaggtcttactcaagaaatcattgcccagaccaatgtcccagagtcctttctcaacgttttcaactttacagcctgattttttatctaactatttatctattgatgtatttatttatctatcatctatctatataatctgtcttataataaacacacacacacacacacacacacacactcaaatacacatagtaaatataatataacctaaaatggacaatataggatatatcaattctacaatgctaaaaagagtgtttggtaagaacatttgtttgctgtcatactgatagcaaaatgtctaatcagattgcttctctatgtttatccttagccaaatgtttgaacacccaattattcataagtgttttctcataccatgtctgtgctactgttaaatttttgaccaattaccttcacatgttccagtttattttttgtggtaacttttttctttgctttttttctgctagaaacacagggcttttggtataatttggctagtccctttctttctacctgcaaccatatattactatcccttctgaagactataacctgtatgaagttcatattgaagcaccattattgggtggttcactgtagaccttaaaaaacatagagaaaaagtccaattacaaagagtttagtttaaaagcaagtgagtcacttcttattcacactacaacacttagaggtttatattgatcctcatatgctttgacagaaattttaccaacctgtatgttaggcagaaaatccaaaagactatccattttcgtctggaaattaaattgattatgcatctacatgaaaaaggtaaattcaggtcatatcgctgagagaagcaacaaaatgttgtaaaagtctacacacatcaaaacaattaaaatgtttaaaattaccaagtaaatgaaatctattttattgaatcactgaacttccaaatcatggatgccatggctctgtcttcaggtaagccagcatcccagctgtatgtgctaatattgtttttaagtcagccatttcacaatcttgaatcactttaattgatgtttaattgccatgtttaaaaacctttgccgtagaagacatgagaagtctatttttaggcaggaaatagaaatttctaggtcctcatgaaacatttaaaattataattttacacaaatccctacccactggataataagttaggataataggggatgagctatatatccccttttacttttctgtgaaaactgttttgtttttaaaacttaaaaattccaagttaatattctactattgcaccaaaagaatacagttgacagtccttcattcacattcccagccttccagtggccactaaagaagaaaccttcatctagtctacatcaccaagagagaacagtgacagctaacactgctccagcctctaccaccttcttgacgtggcacagccatagaacacaggaagtcctcttagcttctaatgaaattggaaacatgggaacatgccctataatgaatggtctatatccaagagaatacactatattaaagtgtagtagaaattcaatatttataaactataaacttccattatttaaaacaagtgtttgaaatagtaccagttccaagcttcgttttcttcttcaagtattatatttatgatacaaaaatggattttctattagtctaaccatttttaaaattctcaaattgagtatttttctccagctctaatacttttcagatgcttctttgatgtcatttacagggagttgaggttttttaagtgtattatgaccttccaggctttctggtttcataagaacctggtgtctgggatactatcaaaaataatctgtcctcatttgaattaccctaacattttagctacaaatcaacaggcttcttgagggtagagataatgcatccctagcacttagcctgaagtctctgaaacagtacactttaatagatctgtacctctttaaagtattatacttatttatatttataccatttctgtgactaggtatgttttccaactacatttatcattttgtgttattacaaacgtgacatagttaaaacagaaatgatgaaaatacagaaaaccacaaagaaataatcacttgtaattactgcctatattatagatatatattgtatatttcccacattagcaagccaatttaccaattattatttattggttaattagcatttcatcatatggctgtccatacttatttatacatactatatataacaatgtggtggcaaggaaggtgtatattattgcctatgatcttataggcaagataaacaatgcttcttagtaggtgttcatttagtgtaagtcctttataaaaatcattacattactgattttaaattaaaaagggaataagccagtggatttatttattggtataacaaaactttgtaaattttataccgatattttctttcaccaaaagttcaattcaaatccaggcatggtgtctcacgcctgtaatcccagcactttggaaggccaaggcaggcggatcacctgagatcaagagttcaagaacagcctggccaaaatagcaaaaccctgtctgtactaaaaatacaaaaaaattagccaggtgtggtggcatgtgcctgtagtcccagctactggggaggctgaggcaggggaatcgcttgaactcaggcagcagaggttggcagtgagccgagatcttgccactgcactccagcctgagcaacagagtgagactccatctcaaaaaaaaaaaagttcgattcaaaattattccattataaactatctgattatattatccagaatttttcaactcatatcgaaatgcaaatttttaaatatttttcccaaatagagtcttaatagggttaaaggttgatagtctcacaataatacactattccacaatgtagagcacttagcagtatccataacaaccattattattttaaaaatattttaatagtaatattctttgaaatagttgatgatttattgtgacagaatgaggagaacctaagaaagactatttatcgataaatgaatttctaaccatgctgacggaaaagcagctttatattttacttttgaaagaaggtgatggttgtatctgaagaaaaaagagatacaagctactatttctaggctatccagttaaaggaaagcactatgtcaagcatttgaagtaaaagaatgttgtcttcagaacccaaacagttgtgtctcagaatacaaaggaatgtaatacatatattggtctatcagtcagaaaacaaaacactgtaaaaaattaaaatcatttcaaattagt

SEQ ID NO: 101 - DNA, 146289 bp, Homo sapiens
ataagaatagagaaaattctgcaaagttcacattggttgaagtccagtggtaaataatgtatctactctaggtaagcaaaaactttttttttacattagataactaccagagtcattaggaagctgaataaacaaatgccaaactaagttttcagatatgactgaaaaccacactgagctatgaataaaactgctgctctataatcggaaacctatctgcaaaacttgacagccaccaccccatgatcaggaaacaaccaccaaattgggtattcaggatagcatttgccagcagaaccagaagaatgacctgtacctcacttctttcgttcaaatcttatgcaagtgcatttgaatggtgaacatgaatcatatttagtcccctaacttagagattcaaggaattagtgttctgttttccagctcttccatgcagaaagacacactagaaataaattaaaaaataataaaacatcagtacatcagatcattcacaccatgtggatgcctcctcaacaaggcatagtaaaagccagaggggattttcacctaggaataatgcagatgacattagttgggaggatctagtcaggagcatacccatgatactccttccccaagagtagtaaaggaatatgggaaagaacaagaacaaaacacacacacccctctaaagtagaagggaccaggggtagagatgaggtttgtaccattcaacttggtattctatcaccagaacatacaagggctatgctaccttattaagaatcctggccataccaaatggaaaacctgcagtaaaatgttttctgatctggcttataatttatgtggcaaacttgtccctactggaagtacactctcctagagtataaaagcattctacattcctaccaacaatgtaggtctggccctggtgacattatatacctggaatataataaatatgaatgctaatacatattagcgtagcacatacactaaaattagaatgacacagagattagcatggctcttctgcaaggatgacgcacaaattcgtgaagtgccctatgaagagggtaggagagacagtcttgagtccctgaggccatacatgtcccatttcctgtcagcagttctatagtatggagagataatctttgcactttgaggagggacagtgcagcaacggggtgactttacatttaactcaatgctgcatgatcacagtggagagtaaagtcatgctgggtttagccagtgtctgcacatggagggagcatgtggatcataccgagccagaggggaattgcctatactaacagttaaaacttgagttatttggcaagcctcaccactgtgggccaaagtgctccgggattttaggtaagcttgcaagaaggtctaagacccaaggactgcaattcctaggcaactcttggtgctaggctgggatcagagctacctccaacatggtaacatctgagacacaagggcacctgcctgagctttggcagagcccagagatagaagaggaagcagagcatgaagtcagggtccccttctagagcttttgagagagattgatggaccaagacagacatcaaaagagggctggcttcagccaaaacgatgaagccagaagacaaaaatatccaatgtctggagatgttttccagggtagaaagtgggaaggggtctaacaatactcacttcagggccctagggcatcaagatagggatgtaaaatctttgggaagaattgtggaaagagaatcccagtagctgctccctccagagagatcccactccagctcagtgtggacaatgaggagacatcaaaagagccacagaggagctgggggcatctgaatcccagagaccatgttgtgagcccctctatacttgtctcctggcccagaaggatagcagctgcaataaggggctctctctgctttacagtgtgtttgcccctaggcaaaaggggttggggcctcctgcagcctctgctcttcctccaggaagtaggaaccttggaggtgggctggcagcatccctccagagctaagctgcttctgcacaaagcagtccccagtgactgcagtcccggccttacaccctgggcatagagaagcaccttcatatctctcacctggaagcaccactgttgccaggcaatgaagtcccaaccttctgtatctcctgctgcagctggaccagctccttgtcatggtcatggtccttgatgctgatgctggtgtctgtagcctggcctaggaaaggccagtgggagttcatgtgaggatgtagagttcatatgaggggggtttcaagcctccaggccccagggctatgtgttttgtaagaaaggcactggtcccagctcttacccacacagggaaccgtctgagtctccaagtactcctatttccttcttgaggcaactctagtgcttccacaagacaccacagtccacagatttggccccctgggctctctggttggtaaaagaggagggaaaattgggcctgctctcaataaagaaaattcatcaagcctgcagttttggaggaccgaagtagacaacctttagaatgtagattgttacctagctgtctcctgctaagcagggtaagttcctggagaaaagaaaacatcaccagctactctcatgaagagttgaaaaagacctgtttgtgtggcaggagcctggcctgaggtttaatcctgtttcaaccacataacaattcacagtaggtctgttgaagggcggctcaagagttcagctgcaaccctgtttagctgtttagcataatcaacaacttcttgagttcctcattttccttggaagctgctgctatctgcttctcaaagtttctcaccactgtctagaacaactcacttcttttctaccaaatggaagacaggtgagagaagaaaatagttaaaaaactaacccaagcatgctaactccgtttttccatgcttttactctctggtctctctccttcctacacacgagcatccccatattacctgctttgagttttgccaattttacctgtgggctggctcctacgtgacacttcaggttgttgagaatgtcagcctgtaggtgggaaaagaggagagggaagatgaatggtgaggcgcttgctcctggaaaagcctccctcaaccctcctgatactcacttccctggcaactcctgcatcatctgctgtttcccgcatttgctgcccccactcctcgagcttctgcagctccctgtccttcttcttcggctcatagtcacactgcaccttctggctgattaactagtcttgcaaacacttcacctggtggagtagaggggagcattaaacaggaaaggcacatgcaggacccacagagccgccagcaaggggaaataaatcagaccctatgcatggaaaaaaagaacaagaccttccacaaacaagtgaggcagtcacagccatgggaggcaggccatccatccctgccctttaaagccaaggcctgctactctaactgttgccaagctgggcccaggccacaccacagccccttggtctgttcctgggcctgtacagcagcaatcattgctcacatgtttgcatctgggcctggagtagggcgggaaaggaaagccattctcccaagatagtggttcttaaacattattgggcatcagtatcacctggagggcttgttaaatcacacattacagagctcacagtttccgattcagcaggtctgaagcaggccctggaatctccatttctaacaagtacccaggtgatgctgatgtgctgatgcagagaccacaatttgagaactgctgctctaagccttaccctggctacttttagccttcccaacctcactcttctagagtttgagcaccctttaatggcaggaaatgactctgggcacttaccttctttacatgcccattttatcatcctaaactttcggggagtgataagacagatgcccaccacccgcagagacccctctgtagcatggttaagaatgcataggatctgtaacagagagctgggttcaagtcttgactcttctacttacaggttaacaccacagcaagttactaactgctgaacctctgctacctcatccatgagatggggataaaatcctgcctcctaggtaatacataccaagtgctttatctagtgccaagcatcagtgtatgcctaatcattgtgagtttattgttagaagaatcttttcaggcagatttatttgcctcagtcttctctttatttaatctatccaacagtcccatcatgtgtgtctcagccctcaagccctacctttaatacttgactccttctgctttcattgctcaaattatagtccccataatctctctcctaaactattgcaagtctcctaaattttttttaaaccccctctttgccaaattcacttaccactctagcatcccaagcctcttcctaaagcacagctagcatcatgacataactctgctctgaaaaccttcaaggacttctcaatatggtcagtctttccttactatgagcaaataagtggggaagcactggttagagggagtgtctctctgccctctccagccagatctgctgataatcctactttgttttaggagcagatgttaaaaggccctttcctccttctgatgccctaatatgcattttctctccttccctaaattttcatagtactttgtattgtatcagtattataacagtgttccttaaattatagagctgcatgtcattctttagcctgggaggtctctaaagccaggaacctggttgcattcctctttatatcccctagaactcaaacaccatgatattaattcacttatttaataaacagtgattctaaaactacttcagaaaatattttaacatatttgagattcagagtgttttctccttgtcgtaaaaaccatcctccagcttgttttttatgctcccttgttttcatttggtgcttttcatgttctgcagtcaccttctagaagtctgaacaaaatcgcaaagaatgggcattctggttcctgtgcagctctcaaaatagagttcattttaccagccctggaccacaggggagcctgcctccctgaagaacgagtcccaggcctggcaacattcaccacaaactgaccgaagagcctttgggccttgagtgaatatcagtggtagcctggcagtacgttccatgaacctgtggtagtggtggccacagggtaaggctcttctgcctgtgaaaaggggaggaaagagtaggaaggactgtcttgtggtttgagggccagctcaaccacagtagaatagaacactgggcagatttctaaggttgttttactccagtccctggctctcacatggcatctctggatctacttggaccctgggggaactcaccaccctgaacggaagggctcaagcctgactagctttgccccctgctgattgtagagctctagggccttgagtgaacataggcagtagcctgggagtggttacagtgaaccttgagcgagtcgagtccctgcacagtcccagtggtggtggccatagggtattgcatcatcccacctgcagctccaaatgtctcagcacagagagactccatctgagagaaaataagggaaaagaacaagagtctctgcctggtactcagataattcttccagatcttatccaagaccatcaaagcggtacctctatgagtctgcaggaactacagtgttactgggcctgaggtacccattaatgcagatctggcttagatcacaacactcaagaccttttaaatacctggaaatccttcccaagatggacaagtgcaaacaagcccagactgtgaagactacaataaatacctcactctccaatgcccagacacagaagaacattcccaagtatcaggactacccaagaaaacatgacctcaccaaatgaaccaaatagggtactagggagcaatcctggagaaacagagatatgtgaccttcaaagaattcaaaacagaggtaggtcaccttcagagaattcaaaatagccatcttgaggagactcaaagaaattcaagataacatagagaaggaattcagaattctatcagataaatttaatgaagagactgaaataattaaaaataatcaagcagaaattctggagctgaaaaatacaagtggcttactggagaatacatcagagtcttttaatagcagaactgataaagcagaagaaagaatcagagagcttgaaaacaggctacttgaaaatacacagtcggggagacaaacaaaacaaataaaaaaacaatgatgcctacctacaggatccagaaaatagactcaaaaggacaaaatctacgagttattggctttagagaggatatagagaaagagacaggtatagaatatttattcaaaagtataacagagaacctcccaaacctaaaaataccaatatccaagtataagaagatcatagaacaccaagcagatttaacccaaagaagattcattcaaggcatttaataatcaaactcccaaaggtcaaggataaagaaataatcctaacagaagcaagagaaagtaaacaaataatataaaatgtagctccaatacatctggcagcagacttttccatggaaatctcataggccagcagaaagtagtgtgtcatatttaaaattattaagaaaaaaaaattttaccatagaatagtatatatggtgaaaatattctttaaacatgaagaataaataaaatccttcccaaacaaaaattgagggatttcatgaccaccaggcctgtcctacacaaaatgctaaagggagtttttcaatcagaaagaaaaggatgttaatgagcaataggaaatcagctgaagatacaaaactcactggtaatggtaaatgcacagaaaaatacagaatattataacacgtaactgtggtgtgtgaagtacttttatcttaagtagaaagacgaaatgatgagccaaacaaaataactacaacaacctcaaaggacatagatgtattaaaaaaattaaacagaaacaagaaaagttaaaaagtggaaggatgaagttaaagcatatagttattagttgtccttttgcttcttagtttgtttatgcaagcagttttgggttgtaagatagtatttgcaagtctcatggtaatctcaaatcaaaaaacataccacatatccacaaaaaataaagagcaagaaattaaatcataccaccaaagaaaatcaccttgactaaaaggaagacaggagagaagaaaaaaaggaagagaagaacacaaaacaagaaacgacacattggcaaaagtaggtcagtccttatttatcaattataacaatgaatgtaaattaactaaagtctccaatcaaaagacaccaaatggttgaatagagagaaaaataagagccattgatctgtttcctacaataatcacaccttcgcctaaaaagacacacataagctgaaaataaagcaactgaaaaagctactccatgccaatggaaaccaaagaagatcaagaattgctatacttatatcagaaaaaaatagatttcaagacaaaactgtaagaagggaacaagcagtcctttgtaaaatgataaagagttcaatccagcaagaggatattgtaactatattgtaatatataactgtaaatatatataattgtaaatatgtatgcacccaacactgcagtacccagatatacaaagtatattagaacgaatgagagcgatagatctcaatacaataatagctggagacttcaataccactctttgagcactgggcagatcttccagatgaaaatcaacaaagaaacattggaccgaatctgcactatacaccaaatggacctaatagagatttacagaacatttcatccaatggctgcagaatacacattcttttcctcagcacatggaccattctcaaggacaagtcgtatgttaggtcacaaaacaagtcttaaaacattcaaaaaaattgaaattatatcaagcatcttctctgaccacagtggaataaaactagaagtcactaacaagaggaatttgggaaactataaaaacacatggaaattaaacaatatgctcctgaataacccagggggtcaatgaaggaaattgaaaaatttattcaaacaaatgacaacagaaacacaacatactaaaacgtacgggatacagcaaaagcagtactaagcaggaagtttataattataagcacttagatcaaaaacaaagaaaaacttgaaataaaaaacctaacaatgtgtcttaaataactagaaaagcaagagcaaaccaaccaaaaattagtaccaaagaagtaataaagatcagaacagaagtaaataaaattgaaataaagaaaacaatacaaaagatcaacaaaacaaaaagttggtttttgaaaagttaaataaaattgacaaacctttagccagactaagtaaaaaaagagaaaatacccaagtaaaatcagagatgaaaaagacaacattgcaaccaatacaacagaaattcaaagggtcattacttaccactatgagcaactatatgtgaaactggaaaatctaaaagaaatggataaattcctaaacacatacaacctatgaagattaaacaatgaggaaatccaaagctggaatgaaccaataacaagtaatgagattgaagccatactaaaaattatcccagcaaagaaaagcctggaaccccaatggcttcactgccatccatttgaagaagaatgaatactaatcctactcaaactattctgaaaaatagaagaagaacacttcccaactcattccataaggccagcattaccctgattgataccaaaatcagtcaaagacatatcaagaaaagaaaaccacaggccagtatccccaatgaacactgaggtagaaatcttcaacaaaatactagcaaaccaaattcaacaatacgttaaaaagaccatgcgtcatgatgaagtggtatttatcccagggatgcaaggatagtttaacataggcaaatcaatcagtgtgatacatcatatcaacagaatgaatgacaaaaaataaataatcctttgaattgatgttgtaaaaggatttgataaaattcaacatcccttcatgataaaaagtataaacaaactgggtataaaaggaacacacctcgacataataaaagccatatctgacagactccacagctaatatacaaaatgggggaaaactgtaaacttttcctcaaagatgtggaacatgacaaggatgctcactcttgccactattatttaacatactactagaagtcctcgctggagcaatcagacaagagaaagaaataaggggcctccaaattggaaaggaagaaatcaaattatccttctttgtggatgatataatcttatatttggaaaaaactaaagacttaagaagagaattattggaattgataaccaaattcaataaggtagcaggagaaaaaaatctacatacaaaaattagtagtatttctatataccaacagcaaacagtttgaaaaagtaatcaggaaggtaatcccatttatgatagtcacaaataaaattaaatacctaggaattaaccaaagaaatgaaaggtctctacaatgaaaactataaaacattgatgcaagaaattgaagaggacacacccacaaaaaaagatattcgtgtttatggattggaaaaatcaatgttataaaaatgttcatacttcccaaagcaatctacagattcaatgcaatccttatcaaaataccaatgacattcttcacagaaatagaaaaaacaatcctaaagtttatatagaaccacaaaagacccagtatagccacagctatcctaagcaaaaagaacaaaattaaacaaatttacaaggaaaagacagccccattaaaaagtaggcaaaggacatgaacagacacttcccaacagaagacactcatgcagccaacaaacataaaaagaagctcaacgtcactgatccttagagtaatgcaagtcaaaaccacaatgagatatcatctcatgccagtcagaatggcaattaaaaagtcaagaaacaacagatgctgacagggttgtggagaaaagggaacacttttacactgttgatggcaatgtaaatcagctcaatattgtggaagagagtgtggtgattcctcaaggatctagaagaagaaatgccatttgactcagcaatcccattactgggtatatacccaaaggaatataagtcatcctattataaagatacatgcatgagcatgttcattgcagcattattcacaatagcaaagacatggaaacaacccaaatgcccatcaaagatagactggataaagaaaatgtggtatatatacaccatgaaatactatgcactcataaaaaggaatgagatcatgtcctttgcagggacatggatggagctggaagctgttatcctcagcaaactaacacaggaacagaaaactaaacactgcatgttctcccttataagtggaagctgaacgatgagaatatatggacacatagtagggggaaacaacactaactgggacctatgtagggggccagggggaggaagagcatcaggaaaaatagctaatgggtgcttggcttaatacctaggtgatgggttgatttgtgcagcaaatcacatggcacacgtttacctatgtaaaaaaccctgcacatcctgcacatgtaccccagaacttaaaataaaagttgaagaaaaaaaagagagaatccaacagaaaaaaaaagatgctgtccaggatgtgaagaaaagggaaccctcatacagagttggtgtgaatgtaaattggtgccaccgctatggagaacaatttggaagttcctcaaaacactaaaaattaagctatcatatgatccagcaatcccactgataggtattctattagtccattctcacactgctataaagaacttcctgagactgggtaatttataaaggaaagaggtttaattaattcacagatccttatggctggggaggcctcaggaaacttacaattatcatggaaaatgaaggggaggcaggaaccttcttcacaaggtggcaggagagagaatgtgtgcaggaggaactaccgaacagttgtaaaaccatcagatctcatgagaactgctgagtagcattttacatttctataatatatgctatctttctatattacgctacaagtcacagatcaattcttccgaaagtttgctcacattagaaccatcttgagagcttttgaacctccccatcactatcaccaataccgtgttccagttgccccccacattaattaaatcagaatatgtggaggattaggagtcaggcaagtgtagtttatagagattcccaggtgattccaacacacaagcaggtttcagaaccagtagatagattgtaatcatttcccacctccatgcagtgaagaaaatcgctgcccttctctctctcaatctctgaaatgcttcttctgctcttatgctgcactatgattccagaggggctcaaagtggagtcagtaccccagagcaatcctctcccaatcgagtgcagaaagcctggaagaaggggcttcattattaaagaaggggattcatagggccacctaaggccccatcagagataagatcaccaagtctcataaatatagcatcactgccctctcaaccccaatgcatccatctcacctcaaaggggcaaaactattttttggattcagggcaaagcatctcagtgagatcaactggacctgagaaccagaaatggctgagcaggaaaatgtaagtgtccagaagtgggaattaaaatagagaaaagccaaggaaagggatcctatgaggggataggttatcacagaggtaaagcaattgtacccacagagcagaaaattcacgggcctggacaaactcagagtcaaggaaatgtaaactaagtaatggaaaagccccagttactacctgggatcagaaacctttctttcctcatgaggttccatggtgcctactaaagctaggaaagtgttaggagaagaaagatttcccccagctttctgcaaaccagccttaagtccaaaaatgagtggagcctaccccagcattgcttacttcaaactcaattacatttcctgcctgtttcctctaataataaagtttaaaaaaatacttcagggatcaaataatcagattttcttattctactcataaaaagagaaactcttgtcacacagtaaatggcaaagccagaaacaaatccaagtattttaattacaaattaaattttgcactgtgccatgtttcctcaatctctaattcatcttccaccatctctaatctactcatttcccagccagccaagtcagagaatgaattgttacctagtttagccagtctcagaaagccccttttcctaaaacaactctttttagatgccgccttgctttctcgttggatggtctctaaagagagaaagaagaaagaaaaagaaaaactgtgaagaaatgatgtaagatgaaagtgacaagagtggctgttcaatgtcatttcaccttatgaattctgaagattttcaacgtgaaaaccaggctcccaaggccttcgtagttgttcactatttctcaaccttggttacacgttagaaatgcttggggaggttttaaaattctccatgcccagaccaattaaatcagaatctctgaacaggaaacccagacagcagaatttttaaggcttcccgggtgattccaatgtgtagaatcgctgctctaacaagacatgttagctccaccctcagactctaaagctgatcagctggggtataagcttttctgagtaggaaacagctgagtataagcaagggcatttctttgggtgcagcaaggtacaaaataaggttaagcagccacccagcagcgaataaagttacactttaatttcgaaataaagcctctaattttattgagtcaagcttcattttatcttctagcttttttctctttttctgtcccataaaattatagtgataaaacagtaatgttaatgggatcaataccgtttattattaaaggtggatgtcataccttttcttgacagtcctcaatgaacaaccacagctaaaataaacaatgcatgtcctactacctgtctgctaagctggctgttggttcttgctttccacaccccaagagcaacacttccatctatcaggcttaactaaggagtcacctgcatggatgaaatctgggaaggctttataagcgaagtatccatctggttagcattgatctactaccacctgaaacaagtacagcttggatgttattagttggctaggatttggatagtggaaaataattaagaaggtagttcgccgggtggagaaaacacagaggcagaaaaccatatgtatatttggaagtccatagtatcacactggaaccccttaaattcatggctgagcatttctctctgattccaggtaagtacactggactatatttcagatgtgtctttataaatgagttgggagaggccttgtggtctcatgaaagacaacaggatttgaacgaagattcaaatatgactgctgacactaactagtcctatgtccatgggggaagtttttaacctcccttagcttcagcttgctaacctgtaaaacagggataatagtatctaccttatagggttgttttaaagattagcattcttctatgcaagtacctagtatggtgaatgaaaatgagtgctcaataaataattgacaagatgaataataatagcatttgtattcacagcagaagttgtttttggagcggttagacagaaatagcttacatcccaaacttagaacttccactttattcagtttttattgtttttgaaagcttgacatgagcaatatccatagttatgcaattgaagttattataaagtccttttaatttttagttttaagatactgaaatgatatgagaaggcttaactcagtgagaccaatttaatcaaatggtctgatttttacagcaatgggaaaaaagattctataatgaatatggtaggcagaattggagaaatgagtataaaatgaacaaatttgatactgagagatttcttgctaaatatgtggagaaataactcactttttgcagagtatttagtagcaaaataatccaacacaacctagcaaaaaggtgtatagaaacttctttctgctggttgtgtttcagacaagttaccaacaaatgaataaagcgttttattgatcaaagaaagaattaagtagctgtgtggccttaggatgtttcttaacttctctgggcatccagttcctcatcagtaaggttagaataatagttatgataggttgttgttatgtgtgtggaactaatgagttggtggtgcatgtaaagcacttactatagtgtctattgctttcagttgttggctatcatttttatgttgctaggattaaaacaatttaatagaaagatttaaaggtatatcagagaacagtgatgtgctgatttttcaatacctgattctgccacaagattaaaggtttaggtatggtacaagctcttggggtccttgcttatttcatttgtcagctaggaactactgaacttacaaaagcactaacaggagttctgtgttttaatcaagcagattagttatgctaagagataacacttctgttaaccccttctatgactttttctacaaagtttgcttcagaaagttttgtttaaaaagtttttaatttctaacaatgagaaatcctttatagtcataactaaccttgtcgtaaccctgaacaatacttgaggaataagcatgaagttaaggtaaagaagcaaacaagaatctgctagcatagtctgcctatcagggcattcatccttaagcagtgatcccagtggaccttagaaaagccatggcaagtctttctactttatttgcttattatcaaatattccttaagcacttagggttggccaacttgctatgacaagcagtccccaagtttcactggtttcgcactccaagatttcgttcttatacagaaaatccaatcggatattcctaatcagcagcttttgtcctgctgatgactaaatttgagatacttccactagcaactccactatgtcctaggatctcttcagagccctctactagatgctccgcactaacccagacaacaggcaaaatgaagattatttcagaaaattgagtgcctaatacttaacccccttatcgcaaaatacacacacaaccacttctgctcacagtgcgttggcaagaaccagttatatagtcccacctagatgcaagaaaagttgggaaaagtagtcaggtaaccactttccagaaagaactctacactatggaagaggagtgtgattctatgtctctctgctagccatgcctgccataagcacctgggtgatggaggtagatcaagttttaaaatagaaataaaaagtcccctctttatggtgtctacagactagttcattcttactctaataaggaaccccctcctaatggctccatgtgctgaatttcctttcatcatcttgatattagcctcgtccctatctatactgtagaactacattttccagaattcctttccagtatcatttacggttagattctgccaatgaggcattcactaatagaagaaaccatttttctcagcagcagctgtttacaggcagatgagatcattgttggcagcctccttgactttcaatgcttctcccaggaatcacctgctataagcagtcagctgagatcatcagcagaagtttccagtggctccagccttcctcctgagaattacccacttcagtgttccatggaataaagatcattgatagtggctcgactgcaatcttgcactttaaaatttgctgaaaattaatatgccggaccttgctcccatagcccttccaatgttctgaactaacttcttcccaccatttttgtcagaaaatgacaaaacctgaacatactcagtatgaaaaagttcagcaaacttattctgtaattccaaaaaatattttctggtacctgatatatgccaggttctatgcaagatgctaggcaatacagtagcagccaaagagataaacttctgcctttaatgtgcctatttataaactactcagtgagaagcacattataaaacataataaattagtaagctcatactctgacaagagctttgaagcaaaattgtaggatgctatgagagagaacagttctcatagcatagtcatagtgatgacttttttcaaatagagtaaaatatgatttggaatgcatagattcccactatcatgatcaagttagagaagaagaaaatcaacagtaattcaatgctacattactagtcaaaataaatttggcaaaatcattggaaacaaatggtcttaatgtctctgtaatgacatgacaacatgtcacaatgtaatattacatgtgatggcacatcctatgtaataggacaaaaaattaatctggcgcaaagatttgagtcatcaggaaaatggaaaagtaggtggctacaagtacagtttttatacactgaaatattagaatttccacatataatacattggagaggagggaccaagtaacgcagagtaggggactgctctgagtaattctggtgaagaaaagatagtgttcatattgttcatatgcattaattccatttatcagtcaatagctaaaatgcttattcattttatattttataaactaatctagattggaggagataatatttattattggaatgtgagcatagttaatattccattagtaacttggaaagacaagaaataataaatcagcaactttcaggctctatccaaataacaactagaacatataaaatgttcattaaaatctatgtggctctttatatctttgtagccttcagagctgagcctcttaattcacctgttctaatctctgaatataaccaagcagatatcttgttaatttttggccagagttcaaagcttagcatctggccagtctagctgcttgtcctatattatcattgcctggtacctgagactaaacttgttctttatagccaagcttccatcatacatttattcactcaataaatatttattgaacattttgtgtatgttaagccctggagggtgtaactgaggaagatacatatggtccctatcctgaaagagtttgcttgtggtttggggtggagggaggatgggagaatgtgggggaagtgagaagtaccggagaggaactaatcccatgggaggaactagtacaaaggctattaatccaaactcagcaaatttaaaagggtttcccagaagacatcccttctaaccaagacttaaggatgctaaagaagttatcctggcagagaaaataagtgaaataatccagcagaaggaacagtattgagaaaccataggtaagagggaccacaacagatgtcctactgaagcaactaaaaaaagttccatgtggatgggctatgaagtacaatgttaagcaatgtaatggaagaggacaggtaattaagtagtagtagattttacaggacctgatagacaatattagggagtttgaactttaaaagcaatttgaagccattaaaagttataaattagaacagaatcaaatttatatttgagaaatttcaatctgggtgccaaatggacaatgaaaaggaaggggagactggaggagaagccatatagaagattattgccataattcaagcaagaaattgtcacagttaaatctacgacaatgagcccttctctggatttactggctactattacatttcatttatttttgtttttatttttttgatataggagtctcactctgttgcccaaactggagtatagtggtgtaatcacagttcacagtagcctcgacctccaggctcagcctgttgcatttcatttagaactgggcttctgacttaccccttaaagtactttctgtaacatcttactccaatttagtttcaatagctgaatttctcctatatgataccaaatgtcccttaattgattgctaggttgtccctctgtcatgtacattaaccatgtgtttcctaaccatgccatgctatacttagctactgggacaagtatttcttgcttaccagaccttttactaaacaactcctatgtaattaattcctattttctgatagcaggaactctcaatttactgacattcctaagtgaaactgcctgctttccaagtttataccatgttttcctcttttccccataactaagctccaattagaacaatagcaatagcaaggactctaagatacatgaatatatgtctcagaattttgaactaccccaactttatagttctctttttaatttccacttttattttagatactaggggtacatgtgtaggtttgttccatgggtatattgcaccagggtagtgagcacagtatccaatagcagtttttcaacccatacccctcttccttcctttcctctttagtagtttgcagcgtctattgttcccatttttatggtcatgtgtactcaataattagctcccacttataagttagaatatgtggtatttagttttctcttctggaattagttcacttaggataatggtctccggctccatccgtgttgctgcaaaggacgtggttttattcatttatgtagctgcatagcattccatggtacatatgtgccacattttctttatccagtccaccattgatgggcacctaagttggttctgtgtctttgctattgtgaatagtacagtgatgaacataggagaacatgtctttttggtataatgatccattttccgttggttatatatatccagtaatggaaccgctgagccaaatggttgctctgttttaaggtcttttgagaaattgccaaactgctttccacagtggctgaactaatttacattctaaccaacagtgtataagtgttcccttttctctgcagcctcaccaacatctgttgttttttctcttttttgtaatagctattctgactggtgtgagatgatatgacaatgtggttttgatttgcacttctctgattagtaatgctgagcattttttcatatgtttttggccacttgtatgttttcttttaagaagtgtctgttcatgtcctttgcccattttttttacattataaaccagccagtttattattttctagtaagatgcagaacttttaccatgcagactaaaatacctatgtcagcaggaacagtacattttcttcctagaggaagttacatggaaaaccaggttattatcaggttatttagtgagtgtaaaatccaaacaagaggagactaatcttaagacctaaacacatccatgaaggcttggagcatactttcccaccactggaacacctcagcctccagaaatcttgtttgactcttccttccctgtcttggtctagctgagcactgccactggtcagtcacctcctgcagccatatagtcaggccagtttagcctaagagctgtatctctgctaactggtttgcgttgttaccgccactgttactaacagttaaggttctgaaaggggcacgtcaattgctcccatgtacccactacaagacacaataatcctgttaggttgttctctcaaacccactccactcaagtttttcaggtaatatgctctgtaaggttctttccaactccattagcacatacatagattacttataaatttacctaatgtaacctacttctactgaggattgaagttttaaaacttttttttttcctaccttcttgatcagtgattcccaaccatgtgggagttagtgaaaccaattctgtatcaccactgcaaccaatacagagataccaactgatatgtatttttcaaattaatatttttaattgattttttatttcaataggtttttggggaacaggtggtattttgttacatgaataagttctttagtgataatttctgagattttggtgcacccatcacccaagcagtgtacactgtacccagtgggtagtcttttatccctcacccacctcccaccctttcccctaagtccccaaagtccattgtatcattcataggcctttgcgtccccatgcttagctcccaattatgagtgacagcatatgatgtttggttttccattcctgagttccttcacttagaatagtagtctccaattccatccaggttgctgtgaatgccattgtttcattcctttttatggctgagtagcattccatagtgtatatatgccacattttctctaccactcgttgatggatgggcatttgggctgattccatatttttgcaattgcaaattgtgctggtataaacatgcgtgtgaaagcatctttttcacataatgacttcttttcctctgggtagatacctagtagtgggattgctgaatcaaaaggtagatcaacttttagttctttaaggaatctccatactgttttccacagtggttgtactagtttacattcccactagcagtgtaaaagtgttcactttcaccacatccatgccaacatctattatttttagattttttgattatggccattcttgcaggagtgaggtagtataaaattgtggttttgatttgcattttcctattcattagtaatgttgaggattttttccatatgcttgttggccatttgtatatcttttttgaggattgtctattcatatccttagcccactttttgatgggattgtttggtttttttcttgctgatttgtttcagttctttgtagattctggatgttagtcctgtgtccgatgtatagattgtgaagattttctcccattttgtgggttgtctgtttgctgattattttgctgtgcagaagctatttagtttaattaagtcccacctatttatctttgttcttgttgcatttgcttttgggttcttggtcatgaaatctttgacttagagtccatatttttgaaattgcaaatctaagaagcaaatgtctagaagggtttttctgatgttatcttctagaatttttatgatttcatgtcttagatttaagtttttgacccatcttgagttgattttttaataaagtgagagatgaggatccactttcttctacgtgtggcttgccaattattccagcaccatttgtttaatagggtatccttttctcaccttatgtttttgtttgctttgtcaaagatcagttggccataaatatttgactttatttctgggcactctattctgttccacaggtgtatgtgcctattttttatacaagtaccatgctgttttgatgactatggcctcatagtatagtttgtagtcaggtaatgtgatgcctccagatttgttctttttgcttagtcttgctttggctatatggactcttttttggtttcatatgtattttcagtttttttttctagttctgtgaagaatgatggtggtattttgatgggaattgcattgaatctgtagattgcatttggcagtatggttattttcacaatattgattctacccatccatgagcatgagatgtgtttccatttgtttgtgtcatctatgatttctttcagcagtgtttggtagttttccttgtagaggtctttcacctccttggttaggcatattcctaagttacttttttgtgtgtgcatctgttgtaaaaggggttgcgttctttgtttgattctcagcttgcttactgttggtctatagcagagctactgatttgtgtacattaattttgcatcctgaaattttgctgaattcatttaccagttctaggagctttttgatgagtctttaggattttctaggtatacaatcatatgatcagcaaacagtgacaatgtgacttcctctttaccagttaggatgcctttgatttctttctcttgtctgattgctctggcctaatttggctaggactcaaattaatgttattttgttccctatgtaaaaatgtaaaaaacaaaattatgcagtcctcaacttagtagtcaataatagtaagggtcaagttgtcaaaaaaatgtctttcaacagtagaaaagtttgcttgctttttttttttattttactttaagttctgggatacatgtgcagaacatgcaggtttgttacataagtatacatgtgccatggtggtttgctgcacctatcaactcatcatctaggttttaagtcctgcatgcattaggtatttgtcctaatgctctccctccccaaagtttgctttcaaataaaaattttaaaaaagcatttattgcaaacatcatgtaataatgataaaattacagaagaaaatatattcagactgacccacgacattcatatcacaccagaattttgatttactgtttttgtaataaaacagtaaattggatcccaaaaagtaggttaggtccatactggctaaaaactccagtccaagactcaataaatgaggatgaaatatatagtgcgtgcttaacagacattccatatacatcaaccatttttaacatccctcactagggtattgagggaagaagggatgaaatgtggacatgtgaactcacaaaggcagaatattgtttcaattataagaagtcacacatgtgacactttactatgtcttggaaaatagctaagattttatctgtgggaatccacctttgaaaatcacaatgaaaatcaaaaggaaatgatttaatataaaatattcaaatttctcagtataggactttcacagaaaacaaagaaagggacaacaatgaaaatgaattttcttaaaaaacaacatttcctttattttgtgcctgctactcaaacctcaaaaacaaatctgtacataactaggaacacagaaaaggaccagagagaatgtgatactgcaaagtcttaggactaaacttccaccctcatcaagaccttcactacagagttgagggttcccaggtcaactgaacaaagtgagcggtctctgatcatcacccctgcttcaccaaagatggcccaggtcactcactgtgaaacttatcagaatagacctgggcagagattgagcttccctggtagctgccccacttcttctttgttttctcatgccagaaggacttggtgaacttcaaaacctgattggctcactcactccagtctcaagctgcacctcacttctttgcccgttttttaattttttttctttttttttccttttttttttttttttgcttgctgatttatttccttatatattctggatattagaactttgtcagatatatagtttgcaaatattttctctcattctgtaggttgtctgtttactctgtcgatagtttcttttgctgtgcagaagctctttagtttaattaggtcccatttatcattttgtgtttttgttgcaattgcttttggggacttagccaaaagttcttcgccaaggctgatgttgagaagagtgttttctaggttttcccctaggatctttagagtttgaggtcctacatttaaatctttaatacatcctgagtttatttttgtataggatgaaaagtaagggtccagttttattcttctgcacgtgactagccaattatcccaacaccatttattgaataggcagtcctttctccatcgcttgttttttgtcagctttgaggaagaccagatggttgtaggtgcatggctttatttctgagttttctattatattccatcagtctctatatctgtttctgtaacagtatcatgctgttttggttactgtagccttgtagtatatggcttaaatttggatagtgtgatgcctctggctttgttcttttagcttaggattgcttaggctattcaggctcctttctgatatatatgaattttgaaatagatttttctaattctgtgaagagtgacattggtagtttgatatgaatagtattgaatctgtaaattgctctgggcagtatggccattttaatgatattgattcttcctatgcacaagcatggaatgtttctccatttatttgagtcatctctgatttctttcagcagtgtcttgtagttctacttttagagatcttttatctccttctttaactgcattcctaggtatttcattttgtggctattttaaatagcatcatgttcttgacttgatactcagcctggacattattggtgtatagaaatgctactgatttttatacattgatttttatatcctgaaaccttgctaaaatcatgtatcagttctagtagcattttggcagagtccagggttttgtaaatatagacttctcaacaaagagaaagagtttgatttcttcctttcctatatggatgccttttatttctttctcttgcctgattgctctggctgggacttcaagtactgtgttgagtaggcatggtaagagttggcatccttgccttgttccagttctcaagaggattgctactggcttttgcccattcagtataatgttggctgtgggtttgtcatagatagctcttactattttgaggtatgttcctttgatgcctagtctgttgagggtttttatcatgaaggaatgttggattttattgaaagctttttctgcatctgttgagatgatcatatggtttttgaaccagccttgcatcccaggaaaaaagtgtacttgatcttggtggattaacttttgatgtgctgttggattcaatttgctggtatttcgttgaaggtttttatgtctatgttcattagggatattggcctgaaggtttattttcttgttgtgtctctaccagattttggtattaggccgataatggcttcatagaatgagttaggaaggggtccctcctcctctatttttttgggaatagtttcagtaggattggtaccagtttctctttacatgtctggtagaattcagctgtgaatccatctgatacagggtgattttttggttggtagtttttttttattattattactgattccatttcagatcttaatactctgaccttatagttcttagcagaggtctggcttcatagaaatgtgttcagcctgtatttaatagctattttaacctagataggcaaattcatcttttaaatagtattatgagagcaattataaggctacagatgcatttattcattcagtagtagtcattaaaggtcagtcctatggtagaattttagtaacctctagaaaggattaaaaaatgtaatatggcatgtaattctttcttccaaaaagttaacgagctacttgggcagccaaataatatatatactgaacagaaagctaataatatatttaattatctcaaaatgatagatactgatttaatttaatgctttctttgtacaagtttctgtgccaaatgcatggtatgtcctatatttttaaactataataacctgcagagcatgtgttattccaatttttaaaatgaggaaataagactcagggaagttaggtgacctacccaagatcatatagatggtaagcagcaaaagcagattcaaacacaatctgttcttccacagaagatttgctttttactccttgctatgggtgttgtctcttgttacccacaaatcacttttatttccaagcctaaaactcactatgtgcactcaaaataagttctgagaaagaacatggtggtacgaacaaagacaaggatagcagattgctctcaactttcatggtaactccgattaatttattatagccaactgaacactatcttatgaggaattatatgacttgaaacaactataaatgtattctgatgctgcatttaggctcagtgggaaagaatgagaactcgacatggttactggaaatatttaaatatgtttagaataacttgggtatgtgattctactgcttaactaaattttgtaaaatttaacagatcaagaaaattcaatgaaaattataattcacactgaaatatattcaaaatatacaacactcacttgattttgaagattagcacatatgaaaaataatatatctcaataattatgttgattacatgttgaatatcttggacattgaattaagtcaaatatattattcagattaatttcaactctttctttttatactttattaatgcagttggtagaaaattttagattgagtctacatttccattcctttgagtctacatttagattaagtctacatttccattcctgtagccatcagactaaacaatacagaagagcagagggacaggggaatctagggtaagagtgaagtcagtattgatataattgaacatccatatgcttattcttctaggtcggtgtttggtagtcttttttatcatcacccgtaaaatgcctttttagacatttttttctctaatcactcccgccatgaaactttaacaccaaacatacactatatacctacttgggcacttattctactatctaagatgtttttacgcatctgagtattgaacagcttgccctttggggatgatatttttaccactgggaatacatgttttgggtgaattgggaagggttaagtgacgaggcccagtggggtaagaatgtaccttcagataccataagactatggaaaataaagggttatgaattaagaggaagagaagtaagttgaaaaataaagaggtagaggtaccataatgagaatttgatttagggtatgaatctatgattagtacctacaattatccaatatattttgtccatatgtttgaactatgcatttttctagacaaatgttggggcagcacctaatttacattaatgtcaattatagaatgactacatatcataaatgcaagaggtgttttgtatatcactattctctcatagcaatatgtgctgctatatttgagataaaatgaggaagtgaacaaataaagcttccatccttatggacccctctgtgatttttgccttcctcttctttccactacttgcgcacctatactaaaaggtaagagggtaattgaccctaaagaaaaatgtatagcaagaaaaaggtcaataagtattttctataaatgggcatttatgtaaatacagtgtatttccagtaatccatttcacaatgtaatttaatataatctcttttatgggacaaaaatgccaccccttagatattgtcaggtagtaactttcttaaaacatgtagagtaagtttgtgacttgaaacatgttatgagataatgatgtaatgacaagagaggaaaatctgcactgagtcttggagataaagagggatgataattaatttccaggtttttgctattactgtccaagggaacaggtactccagccagcagacaaaataatcaagttttcttgacagatctatccttctagtgtagatgagtatcacagctttataacaattaactggcatcatttaaacttattttattctgactcaagcaaatttctgatttaagtttagcttcacaaataggcccttctaacgcacaatacgcactaactgaccagctgttttcagttttcctactaattggtcgtgattatttttcactgaagacttattagctggcatactaaattttaaataagtccactgcatgtacttatagtatgttataaatctaaacctataaattcctctcactcgtcacctgcttctttatttcctatctacacgaatagcctcattatcgttccatataacctaaacccaaagctgggaagttatctgaaaattcttactctccttgatccttccattacacccatcattatagcctgtcagttcttctatgtaacatttttttcatcactgttgctagtatcttagtccctcataaattctccccaacttctaaaaaattctctctaccactcattgttctttcaaatcaattattgccctgaacaggactgtttctgtcatgactgacatggctaaaatagctaaaccaaaaaaggaaatttattggctcaaaaaaactaaggatggtaagtgctgttctagtcttaggtgcaactagatctacagactcaaagccactattaggtttctctttccattcctcacttctggcttctcagtgtattggccctattctcaaagaatttctttttttttttttttttttttgagatggagtctctctccatcacccaggctggagtgcagtggcatgatctcggctcactgcaacctctgccgcccgggttcaagcaattctcctgcctcagcctcccaagaacctggggttacaggcatgtgccaccacgcccagctaattttcttgtatttttagtagagacagggtttcactttgttggtcaggctgatctcaaactactgacctcaagtgatttacccgcctcggcatcccaaagtgctggaattacagacgtgagccaccgcgcccggcctctcacagaatttctatatgcaatactggatgtgatagataaagagatgcactgagaacattccttttctataaaatacttatactgcccaggagaggggaattcagccacccaatagcctccagctgtgagctcctttagagtctggctcagcttcagggactctgcgcccccgccccaccaccacttgaggtcacagttttcccagagtagcatgcatacagtgactaactgcagtggcccagccactttaggtacatgcaggacactcatgggctctgttcactccagaactccctgccaggttgtctgaggctttgttagacctgtatcacaattcagcttccccctctgcccaatcatgcatatttattcattttataggggttgatccctaataaatatctataccccaatctccaactcagtgtctgcttccaggaaacccagtgagttatatgtccaaagtggctagggcttcacagaactccagctccacaatcccagaatcaatggtcagccttcctcttctagctctgactaaaacatgggttctgattgaccctatttgactcacatttaattccctgaactcattccttgggccatgcagtcaggctgtgtttgatagccccaccaggaccacatggagtgaaggaaaaaagttctccaaaggagagaaaagatggtcccctataatcttccatgcagccaactgagggctccttctaaaatataaatctgaatatgtatgtttgcttaaacatcaactttccccattgcttatgacagaattttactgtaaaacatttgtcataacataagacattttaaaaggcacagattcagcacaacatccctcatttttgtggaatgtattaggaaggctttttgcctcaaatgagggattggtttttgcctaaaaagatatctacaggaatgcagttgttgcctttgggtctcctgcctcagtgtggtagggccagtgaacattttagtatttgtcatggcttttgattcatggttgcaacattgctgccagggctctagccatcatgacctcattgaaggtaggaccaagcaagcaggtaggggtcatatcaaagcttttctaaaaccaccctcaccagctttccaccaacaggttaagaactggaaatgagtcccatgaaaattgctagctgcaagggaattgagaaagtaagactgtcacaggagtcatcaaaggagaagtggttggaatttaatctagataagagacaacatgatgatattagggtattaaggacaatgaaaataattgtagaattgtagtttctaggaggctaaggattctctggagtcagggtaacagatggaggaaagtagaatgataggagttggtgagcagagagtggaaaacttaaaattgtgactgactggagttagtggaagtcattgataataacaggatataggatagaaacataagtttcaggggctaagtggaggggtaaatagagtcaaaaatcaatggaggaaaggatgacaagaaacagacaaggacatatgcctgtcttaacagtttttacaagtgcctatcacagagtagacactggacaaatgaatgataaactgaattatttcccaggcaatatttacctacaattttgatgtctctcctgacaaccagaccctcttgtcaaatagctttctcctctccaatgtcctgcacgtgcctaatctcaacatgctcaaggtcgaatcacaatccctcagttttgagtaccttttcagggtctagtttcaaaatttttagacaaatgcatggatagttaaaatagcaatacaaaatgtgtcactaaaacaagagacaaaatttattgataatacactatgggccagtactgtgagaacgtaccatttgcttgcatagattatctcttttactaatcagaacctatgaagtaggtactgttaccacacccagtttgtgtatgagaaaattaaaacttacagaaattaagtcatttactcaaggatcacagctagtaagtgaagaacccaggacattaactgtgtctgtctgactccatactcttaatgactgtggagctaacaaattaattgcctttttcaaagtttgggggctgggtgcggtggcacatgccagtaatccccacactttaggaggctgaggtgggcagatcacttgagcccaggagttcaagaccagcctgggcaacatagcaaaaccctatatctacaaaaaatacaaaaattagctgggcatgatggcaagcttgtagtcccagctacatgggaggctgaggtgggaggatcacttgagcgtgggagagcaaggctgcagtgagtcaagatcgtgccactgcactccagcctgggtgacacagtgagaccctatctcaaaaaaaaaaaaaagtttgagcctatttcaaaatattgctaaaatatgcattcttattttcttgcaaattattagaccttctttaataaggaattttaattaatcaaggggtggagtaatagagggcagttcagtatttctcattcctgcagcctctgttctctgctgtgaccgaaaggcctttactacaggcctttactggtaaactcataatagttatgtacattaatcatatgaattatctattttgagacagagttttaaataattggacaattttaaaatctggtccatggatcaagcaaatagcgttagtagttttttatgtagtaaacacttttcaagaacaagtttattccatattaaatatgttttcctctaaggttgaagcaactgtgacagggtgcacaaaaggtttcttaaatattatacaaatgaaaacacttcttttgttcctgtatgaaatacagggagaaaagtttgttttcttggcagttgggaatgaggggtagaaggtgctgaatttcttggcagcattccttataaacaatcaatggtccctgaactgctttctgaagaaatgggtatgctgagctgtgtagtgctggactctacagactttttgttggttttgaaaaaaaaaaaaaagatgagaagcaaggaacttgggcagaggattgagaattttaaaaacaaagattgtgtttttttatgtgatgtattacataaattccctctgcagaaaagagttaacatagcaggcctggcttccaacctttaaaagcgctgcttacaagactggtccttggtctttgtctgggaacttggatttcaggaggactcccaccattcccagaactgacagaagtgtctcactatgactagcctgtgcaaacactatggtttacgcttaaaaccctctttccttctgggattccagaattcaggtgccaggcagagggcacctgcatgatcagccccaataaaatgccctgcgcactgagttttttgtttatttgtttgtttgtttgtttgtttgtttttgagacagagtctcgctctgtcacccaggctggagttcagtggtgtgatctcagctcactgcaacctccaatcccccgggttcaagcaatttttctgcctcagcctcccgagtagagtagctgggactacaggtgtgtgccaccatgcctggctaatgtttgtatttttagtagagaccgggtttcaccacattggccaggctggtctggaactcctgacctcgtgatctgccctcctaggcctcccaaagtgctgggattacaggcgtgagccactgcgactgactggcactgagtttctaataagcttccttggttggcaatagccagaaatgtgtcctcagaacttgctggaggaatttagtgcatcctgtgactcctctgggagaggattcttggaagcttatgcctaatttccctaagacttcactccgtgtgcattttctctttgctgattgtgcttttttgccctttgtgtaatgaactagagccacaaatacaattatatgctaaattctatgtcctagcatatccccaaacctcggaatgatctttgggaccttcaatacaacaccttactattacaaaaaatattcactttatcacacatctattgagtttttactgtgcctaagtattttttaagcattgagagtataataacaaataaggtacagcccctattaagaagcctagtgcctagcggaatggttctcattcaaggctgatttttaggaacaattggcagtgtctggagacatttttgattgtcaccactggggcaatgctactagcatcaagtgggtagaagtctgggatgttgcttaacatcctaccatataaactgtctctcctttttattgggagagagttttgagaacacctctctcgaagtaaagtattatttagcctaaagttaatagtgctcaggttgagaaaccttgatctagtggaagaaacatagatataaacaaacaatgttaatacaatgtagaaactattcattatctatttccccttcagtgatcatgctttctgtcctacctttaccacacacttcacaaaattaaggcccccgcaacctgtgccttttcacttgcctttaccatcatgactgcatattttccatgatgaggttaaattccatagtcaattactataatcattacatcatgcagggattcacaatgtttcagcatatgcaaatcaatcaatgtgatatatattatatcaacataatgaaggacagaaaccacatggtgatttcaattgatgctgaaaaaccatttgataaaattcaacatccttcatgataaaagccataaaaatgggtatagaataaacatacctcagcgtaataaatgctatttttgacagacccacagctagtatcatgctgaatggggaaaaactgaaagcctttcctctaagatctgaaatacaacaaggatgcccactctcatgaccattattcaacatagtactaacagtgatcaacagtgttgattaacactgttaaccaacataccaaaatcagtagcatttctatatgtcaacaatgaacaatctgaataagaaatcaaaaaggtaatcccatttacaatagacacacacaaatacgtaggtattcaccaaagaagtgaaagatctctttcatgaaactataaaacacacatgaatgaaattgaagaaaacaccacaaaatgaaaaggtattccatgttcaaggattggaagaatcaatattgattgatttgcatttctctagtgatcagtgttgttgagctttttttcatgtttgttggccacttgtatgtattcttttgagaagtgtctattcttgtcctttgccaactttttaatggggctatttgttttttccctgttgtttaagttccttgtagactctggatattagacctttgtcaaatggatagatgctaaaattttctcctattttgtaggttgttcactctgattattgtttctttttctgtgtagagctttttagtttaattagatctcatctgtcaaattttgcttttgttgcagttgcttttggcattttcatcatcaaatctttgtctatgcctacatcctgaatggtattgcctcaattttcttctagagtttttatagttttgaattttatgtttaagtattttattcatcttgagttgatttttgtaaggaaggggtccagtttcaattttctgcatatggctagccagcactcccagcaccatttattaaacagagtcacttcctcattgcttgtttttgtcaagtttgtcaaagaccagatggttgtaggtgtgcagtcttatttctgagttctctattctgttctgttggtctatgtatctgttctagtaccataccatgcttttttagttactgtaaatttgcagtatagtttgaagtcaggtagcgtgatgcctccagctttgttctctttgcttaggattgtcttggctattcaggctcttttttagttccatatcgatttttacatagttttttttttaattctgtgaagaatgtcaatggtagtttaatgggaatagcactgaatgtataaattgcttagggtagtatggccattttcacaatgttgtttcttcctatccatgagcatggaatgtttctctatttgtttgtgtctgttctgatttctttgagcagtgctttgtagttctccttgaagaggtccttcacttcccttgttagctgtattaatacctaggtattctttttgtggcaattgtgaatgagagttcattcatggtttggctcttggcttgcttgttgttggtgtataggaatactagctatttttgcacattgattttatattctgagatttaggcttatcagcttaagaagcttttggggtaagacaatggggttttctagatataggatcatgtcatctgcaaataaagacaatttgacttcttctctttttttttttttttttttttttttgagacgaagtctcactctgtcacccaggctgtagtgtagtggcgcgatctcagctcattgcaagctctgcctcctgggttcatgccttctcctgcctcagcctcccaagtagctgggactacaggtgcctgccaccatgcccggctaatttttttttttttttgtatttttattagagatggagtttcgctgtgttagccaggatggtctcgatctcctgacctcatgatccacctgccttggcctcccaaagtgctgggattacaggcttcagtcatggcgcccgaccgacttctctttctctctgaatatgctgaatatgctttatttctttctcttgcctgattgccctggccagaatttccaacactgtgttgaataggagtagtgagagtgggcaaccttgccgtatgccagttttcaagggaatgcttccagcttttgcccattcagtatgatattggctgtgggtttgtcatagatggctcttattattttgaggtgtgttccttcaatacctagcttattgagaatttttaacgtgaaggatgttgaattttattgaaggccttttctgcctctactgagataatcatgtggtttttgtctttagttcttttatgtgaagaatcgcatttattgatttgcatatgttgaaccaacttggcatcccaggaatgaagtcaacttggtagtggtgaataagcttttgatgtgctgctggatttagtttcccagtattttattgaggatttttgcatcaatgttcatcaaggatattgccctgaatgttttgttgttgttgttgtatctctgccaggttttggtatcaggatgatgctggccttatttaatgagttagggagaagtcactccttttctgtttttatggaatagtttcaatagaaatggtaccaactttgtacctctggtagaattcagctgcgaattcacctgcttctgggcttttttcggttggtaggctatttgttactgcctcagtttcagaactcattattggtctattcagggaatcagtttcttccaagttcagtcttgggacaatgtatgtgttcaggaatttatttatttcttctaagattttctagtttatgtgcatagaagcgtttatagtattctctgaaggttgtttgtatttctgtggggtcagtggtaatatccgccttatcatttcttgttgtgtttatttgattcttctctcttttcttctttatcagtctagatagtggactattgattttatcaattttttcaaaagccagctcctgaatttattgattttcttttcagaagggtttttttttttttttttttttttttggatttctatctccttcagttcaactctgatcttagttatttcttgtcttctgctagctttggtatttgtttgctcttggttctctagttcttttagttgagatactaggttgttaatttgagatttttctggctttttgatgtgggcatttagtgctataaatttccctcttaacactgctttagctgtatcccagaaattcttgtacattctatctttgttctcattagtttcaaagaacttcttgatttctgccttaatttcattctttacccaagagtcatgcaggaacaggttgttcaatttccacatagttgtatggtttgagtgagtttcttaatcttgagttctaatttaattgttctgtgatctgagagactgttacgatttcgattctttcacattggctgaggagtgttttacttcgattatgtgatcaattttagagtaagtgctgtgtggcaatgagaagaatgtatatactgttgaatttgggtggagagttctatagatatctatcaggcccacttgatccagagctgatttcaggtcctgtataattcacatctattaactgagttgtttccttataactctgctagtctaaaaagaaaaagaaaaaaaaggtgacaagggaaaaactggtagaaggggtaagaagctaaaagcagtgcttagaaatgaagtgtgggaactgacctatggatggattttaataggaatatccctttttccatcaaaatgggtccttggaagccagccaaattattccctatgtggtaaaccagtttatcagactaaggggagcacagaccctcagcatggaatatttcatatgtgtaagagagtctggacttggagcagtggttgatggggtggtaataagggaaatgtggtggaaatgagccagaagagtgaattaacatgcgtatttgagttgaagctgctcctggcaaactataaattatgagagtcatttataagagagtccataattgctagaggaatttctgtgttaatcatcagaagacagatccagtaagaataaacaaaacagtgccagcttaagaaaggttccccctcccttcccaaatcaattattggctattctgttatgattaaggaatgatagaaacttaattagctatttttccatttaagaaaatcatattgctttgattcaagcacacctatgcgagctatccagaaagtctgtagctacaatgcagattttaaataattccaaagctggtccctgtggtttaaataaaatgataatataaaatgtaattttagcttatttaagaactttaattctgctttaatacaaaatatctcttttgctccacagttgctatattagactaaacattttcatagaagaatatcagtgaagattagttgtatttataagaagcatgggcttacctgaatcataccagtataaagaatgacaaacatcatccagatggaaaaactaatcataaattctaaagtgtaatcagttgttagacatgttgattttctcttcttcctagtgcagtaaactattttgtcagtcttatttgctgtaacttgaaagtttaaaatatttattttaaaaatttttgcttatcgaatagtatctcaaagagcagagaaaaccatggtaagtcatagcagtctgagatgatatttattttgaatattcacacagcaaaagtaagcctgagtttgggttttctttttttcctgtttgctatccattgcaatttaattgcctaggttagctactagcctttcaataattttattggccccttttattattcttaacctttctattttcctgagtttaaatttcaaatttctatatttctcttccatctagcttaatgctgtttttacacattcaggtcagtaattccattttagtaagcaccatggggaaattctgagtttaatgagcatcttgccccagtaatttcatattctaaaagaaataagtcatggctacttaaatgactagaaagcaaagataggcatagatgattgtggggagaagtggtatacataaacagccatgagaatttagaaaatagaaatgttaatcctggataaagtaggcatcacagagaaattagtgttcgggatgaatcttgaaggataggtaaggtttgtatatgctgggatagcaaaatgggcagatataattacatgtaaccaagtttagtaactgagagcaatttgtatttttcctctgtttcaagctacagctatctcctacacatggtgtggtttattcaatattgagttttatatccaggaatgccttatggctgatggcacatgcagcaatgaactaccaggagctgttacagcaatactgacacagatatatgtcttcatcttggttgacctctcggatggggacaaattaatatatgacaataaatgacctgtgcagcatgacttctccagaaacaaaagggacataccttgtattttattttaaaaagttattgaaaaatgagaagttactctcttttggtcatagaaatatcttctaaccttttcttagccttctcagtagcatgcagtagtggctggagacagcagcgttagaaagatagacaggaaatgataaacagaaagaaaagataaaatcgctatttttaatgatgttaaggtagcaaacaggttatgtcaacccatagctatgtaaaatagtcctacgaatcttagaatctcagttttttttttgttcccattattcaccaataaaatgtagatgaaaatatttctataattcttcctaaccatgatatgaaacccagaagccctaaaaaatgattaacacacttgactatatgaaactatataactttatataagaatacattatggagaaagttaaaagaccctgtgagctgccagaaaatattttcaacgtatatatggcaaagataagtatcactttatgtagaaaactcttacaaattgatttaaaaaaacatcattaaaaatatgaaactagggctgggagtggtggctctcgcctgtaatcccagcactttgggaggctgaggcaggcggatcacagggtcaagatggagaccattctggccaacaaggtgaaaccccatctctactaaaaatacaaaaaattagctgggtgtggtggcacatgcctgtagtcccagctactcgggatactgaggcaggataatcacttgaacccgggaggcggaggttgtagtgagccgagatcataccactgcacttcaggctgggcaacagagagagattccatcgcaaaaaaaaaaaaaaaaaaaaaaaaaaagaatatgaaactattcccaacgtctctaataattctaactaaaaaaaaaagaaattaattttacctataagacatactaagattaagaagagtaataatatccgagttagtgagtatgaggatatcagcaaagtcatgcattcttatgaaaatgtaaattgctacatttcagtaagctatttagcagtatttctcaaaataaatttgcatattacaatagagtgactatagttaacaataatctattgtatatttttaagcaaaagagtggaattggaatgtttctaacacaaataaatggtaaatgcttaaggtgatagatgcccttttatgcatctatatgcatcaattatgaatatatgtatgcaactacaatgtacccataattaaaaataaaaattaataatgagtgcacattcacttttagccagttattctacttctatgaatttgttatatggtgatgcagaaacatatgaaacacacatgcataatcaccttaatagtgtttgtcattgcaaaaaaattagaaacaacccagacatttgtctctaggaattaagtaaactgccacatatttttacaagcatgtattaattttgtaacctcagaaaaaacttcaagtaggggaaagaaaaggaagaggagaattgcttaaaaaaaaactttaaaaatttgtccttatcataaactacaaaaacttgcgaagtaaaagtttaaaacattgttcattcccaacccaatgtgactcccagattgctactgttaactggtatgtatccttttagaaatatatgtgtatattttttaagcatggccagctctgctcttactaaaccaagatacagttaaatgttagtttttaaatcttataatacaaaagtaagtagttggcaaataatgacatgtcccaaatctacagtgtccaaaatatacttgtaaaaaagaagagtttaatttctgtgctgttgtgacatagtgaaggtcacagacaacacagagtgcagcttctctgagctttagcattttccttccatacttcctggttttcacttcatttattacaactgatttgcttccttgttttaggccaataatgttttttcattgctatcatctcttcttacagctcttgtttattctccacagccctacccttcctctctttgtaaacccaaaagttgaagttgttttaattcaacaaatatttaacagtgattgaagcaattgttataaggagtggttagactcctggcttccccacaattcccacttaaatcgatcagtaactggaatgaatttaattttttcttttcctttgagttgatctactttcattgccttatatgattctccttacttcctctacccctttcttcactgctgcctcgtagactttccctcgcttcctctccccttctctcccttgttactgctcctgcctctcctaccatcaccagcaaacctacttcctctttccataatgtttcagctaaactatgtgttaaaacacaacttgaagattgctctggaaccaaaacacaatgtatgtatcatggtttctagaaaatgtgtttagacttcgtcaagaaaagatcataaatgtaattatgcctcattatcttggctacagcctggcacaggaaaaggaagaacagttactggagggaaaaaagaaaatttttcacttgtagagtttaggcctgtggatattgccttctgaatatgacggcctctttgctttgttcattatcttccattaaattatttgagacattctgttgctttccattataccatcgctatctcattatctgcaactctttgtccatatgcacatttcgcctctttagtaatttacatctaattgttaccctcatctcacatctcccttcagccattcctttggcaatgaaatagcagtaatcacagtcaagatactgactcttcaatttgttgagaaatgcttcaaagttgttttttccatgtttactcatgtggtgattttttattgctttccaacaacatgtgaaggagtgagataaaattaaaatgtcacaacaaatgtatttcagattatgaaatattttaaaaacttacctgttagctcttaatatttgaaagttgaaaaacacaggtttttaatgctatcaaaatcaggccaatatgaagagagacacaattacagacctttaaaatatgaaattaactaagaaacaccacaatcctaactggtttatttgatccttgcctcattttcctctcctctctcctctccagaaatatctttctagtaatatttgactctcttttccaaatcctaaatcctttagtgtggtatccatctacatattcagaatgccctcctgccattttcccaccatgtatgtattccataaacttagtgactttcccgtattacctgagaagggaagtacaggcctcgattcccctctgtatagaatccctccccagtcctttgcatggctatttacttctgccagctatctctcctcagcaccagtcaccaccctgtaaactgcgcctgactgcctaggcaagcataggcactcctttctctgtgcctcttttccttatatacctccacagtggctcttttacaaattttatacagccatatatactattgtaaactttttgttctgtgtatctagctctttactgtattatacttttctgtaatcagaaaccatatgttttaatctctatgccctcatcatccagaatggcatctggcatttagaagtgcccatatcagggaaagttctagcttttgggccactaaagccagctacagctaagttaatcagaaaagaaatgtattaataaaaatattggtaagattataaaatgaaggagaaaaaaagttgaaatgaaggaaaaaatgttaagggcagccagagagaaaggtcgggttacccacaaagggaagcccatcagactaatggcagacctctcagcagaaactctacaagccagaagagagtgggggccaatatgcaacattcataaagaaaagaattttcaacccagaatttcatatccagccaaactaagcttcataagtaaaggagaaataaaatcctttacagacaagcaaatgctgagagattttgtcaccaccaggcctgccctacgagagctcctgaaggaagcactaaacatggaaagtaacaaccggtaccagccactacaaaaacatgccaaattttaaagatcatcaatgctaggaagaaactgcatcaactaacgagcaaaataaccagctaacatcataacgacaggatcaaattcacacataaaactattaaccttaaatgtaaatgggctaaatgctccaattaaaagacacagactggcaaattggataaagagtcaagacccgtcagtgtgctgtattcaggagacccatctcacatgcagagacacatataggctcaaaataaagggatggaggaagatctaccaagcaaatggaaaacaaaaaaaagcaggggttgcattcctagtctctgataaaacagactttaaaccaacaaagatcaaaggagacaaagaaagccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaatgagacaagaagttaacaagggtatccaggacttgaactcagctctgcaccaagcggacctaatagacatctacagaactctccaccccaaatcaacagaatatacactcttctcagcaccacattgcacttattccaaaattgaccacatagttggaagtgaagcactcctcagcaaatgtaaaagaacagaaatcataacaaactgtctctcagaccacagagcaatcaaactagaactcagggttaagaaactcactcaaaactgctcaactacatggaaactgaacaacctgctcctgaatgtctactgggtaaataacaaaatgaaggcagaaataaagatgttctttgaaaccaatgagaacaaagacacaacataccagaatctctgggacacattcaaagcagtgtgtagaaggaaatttatagcactaaaagcccacaagagaaagaaggaaatatctaaaattgataccctaacatcacaattaaaagaactagagaagcaagagcaaacacattcaaaagctagcagaagacaagaaataactaagatcagagcagaaccgaaggagatagagacacaaaaaacccttcaaaaaaatcaatgaatctaggagctggttttttgaaaagattaaaaaaatagacctctagcaagactgataaagaagaaaagagagaagaatcaaatagatgcaataaaaaattataaaggggatatcaccaccgatcccacagaaatacaaactaccatcagagaatactataaacacctctatgcaaataaactagaaaatttagaagaaatggataaattcctggacacatacaccctcccaagactgaaccaggaagaagttgaatccctgaatagaccaataacaggctctgaaattgaggcaataattaatagcctaccaacaaaaaaagtccaggaccagatggattcacaaacaaattctaccagaggtacaaaatgagctggtaccattccttctgaaactattcccatcaatagaaaaagagggaatcctccctaattcattttatgaggccagcatcatcctgataccaaagtctggcagagatgcaacagaaaaagagaattttagacaaatacccctgatgaacatcgatgcaaaaatcctcaataaaatactggcgaactgaatccagcagcacatcacaaagcttatccaccatgatcaagtgggcttcatccctgggatgcaaggctggttcaacatacacaaatcaatacacgtaatccatcatataaacagaaccaaagacaaaaaccacatgattatctcaatagatgcagaaaaggcctttgacaaaattcaacagtccttcatgctaaaaaactctcaataaactaggtattgatgggacgtatctcaaaataataagagctatttatgacaaaccgacaaccaatatcatactgaatggacaaaaactggaagcagtccctttgaaaactgccacaagacagggatgccctctctcaccactcctattcaacatagtgttggaagttctggtcagggcaatcaagcaggagaaagaaataaaaagtattcaattatgaaaagagaaagtcaaattgtctctgttcacagatgacatgattgtatatttagaaaaccccatcatctcagcccaaaatctccttatgctgataagcaacttcagcaaagtctcaggatacaaaatcaatgtgcaaaaatcacaagcattcctatacaccaataacagacaaacagagagccaaatcatgagtgaactcccattcacaattgctacaaagagagtaaaatacctaggaatccaacttacaagggatgtgaaggacctcttcaaggggagctacaaaccacttctcaatgaaataaaagaggacacaaacaaatggaagagcattccatgctcatggataggaagaatcaatctcatgaaaatggccatactgcccatggtaatttatagattcaatgccatccccatcaagctaccaatgactttcttcacagaatttggaaaaactactttaaaattcatatggaaccaaaaaagagcctgcattgccaagacaatcctaagcaaaaagaacaaagctgtaggcatcacgctacctgacttcaaactgcactacaaggctacggtaaccaaaacggcatggtactggtaccaaaacagagatatagaccaatggagcagagcagaggcctcagaaataacaccacacatctacaaccaactgatctttgacaaacctgacaaaaacaagaaatgaggaaaggattccctatttaataaatggtgctgggaaaactggctagccatatgtagaatgctgaaactggatcccttccttacatcttgtacaaaaattaattcaagatggattaaagacttagacctaaaagcataaaaaccctagaagaaaacctgggtaataccattcaggacataggcatgggcaaggatttcatgactaaaacatcaaaagcaacggcaacaaaagccaaaataaacaaatgggatctaattaaactaaagagcttctgcacagcaaaagaaactaccatcagagtgaacaggcaacctacagaatgggagaaaatttttgcaacctactcatctgacaaaggctaatatccagaatctacaaagaacttaaagttacaagaaaaaatccaccccatcaaaaagtgggcgaaggatatgaagagacacttcttgaaagaagacatttatgcagccaacagacacatgaaaaaatgctcatcatcactggccatcagaaaaatgcaaatcaaaaccacaatgagatataccatctcacaccagctagaatggcgatcattaaaaagtcaggaaacagggccgggcgcggtggctcacacctgtgatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccggctgcttgggaggctgaggcaggagaatggtgtgaacccgggaggcggagcttgcagtgagccgagatcccgccactgcactccagcctgggtgacagagcgagactccgtctcaaaaaaaaaaaaaaaaaaaaaaaaaaggtcaggaaacaacaggtgctagagaggatgtggagaaataggaacacttttacactgtcggtgggagtgtaaactagttcaaccattgtggaagacagtgtggcgattccacaaggatctagaactagaaataccatttgacccagtgatcccattactgggtatatacccaaaggattttaaatcatgctgctacaaagacacatgcaaacgtaagtttattgtggcactattcacaatagcaaagacttggaaccaacccaaatatccatctatgatagactggattaagaaaatgtggcacatattcaccatggaatactatgcagccataaaaaaggatgagttcatgtcctttgtagggacaaggatgagttcatgtcctttgtagggacatggatgaagctggaaaccatcattctgagcaaactaccacaaggacagaaaaccaaacaccacatgttctcactcataggtgggaactgaacaataacaacacttggacacaggttggggaacatcacacaccagggcctgtcatggggtggggggctgtgagagggatagcgttaggagaaatacctaatgtaaacgatgagttaatgggtgcagcacaccaacatggcacatgtatacatatgtaacaaacctgcatgttgtgcacatgtaccctagaacttaaagtataataaaaataaatcaataataataaaaaaataaaattctaaagagagaagctccctgatggctaaacctagtttatgaacctataacttgatttacttgtagtgatgatagacaagataaagagaagacataaaatctcaccaatctatacaatggactatcctcccaaataggttgggaaattatacatggagcagccaaaacttcaatgcttgtgagaattacccaaatattatcattttgtcactataatctacaataataaacaggatacatttaaggtgtacttaatagttttgagtctagctttaaggctaatggaatcattcttactacctttgtctacttctaagacatgtaagagaaaaagtttcatctaacaaattgctttacacagctttttaaaataacctaaactatcaaagttttctcaaaagtgagaaagcaaatgtaattagtgtaacaggcaaagactattaagtactgattaggtcaaagagagtaaaaattaggttgcctatagcagaaatgaccatgtcctttatgggagtacaaattatctgtttacatgtctactgatgttttattcaagatgtctgacatacataaaaaattatgacacatgaaaaaagcaggaaagtgatccataaccaagaaaaaaaaaagtgccatcctcaaaaaggacaaaaatatctctcaacctagaattgtacgtacaataagtttcttcttcaaaaattaaggtaaaataaaaatatttttagacagactgaagctgataaaatgtgttgccagcaccactgcactatgagaaataactaaataaagttattcaaactgacgggaaattatcctagatgaaagagtggatattgagaaactaataaaaagcacagaaaagagtaaatgtgtgagataacattaaacagcatttatcaaaatttatttaaaagatgattgaaggttttaagtaaaatgatgatgattatgtattgctggcttttaaacacggagaattgaaacacatggtcgagccccatatccaagccctatagctcccggtcaacatttttaaacatatcctgggccagaggggagcccactgccttgaagggaaggacccactgctggcagaattcatcatctgctaactgaagagctttggggccctaaatagccagtagctatacccatgtagtacatcgtgagccttgggtgagattctgacacttgctggcttcaggtaccagctcagccacaaacaagtaaagcaccaagcaagcccttagggtccccaattccaggccttggcacttgggtgacatttctggacttaccctgggcgccagagggaagtatactcccctaagggtgaggggttttttgttgttgtggttttttttttgtttgtttgtttgtttgtttgtttttgagatagagtctcactttgtcgcccaggctggagtacagtggggcaatctcggctcaccagaagctttgcctcctggattagagcaatcctcctgtctcaacctcctaagtagctgggattacaggcatctgccaccgtgcccaactaatttttgtatttttttagtagagatgagatttcaccatgttggtcaggttggtctcgaactcctgacctcaagcaatccaccagcttcggcctcccaaagtgctgggattacaggtgtgagccaccatgcctagccccctgaagggtgagtttcagaccaggcagcactcaccacaagctgaatgagagcccctgggctttaaggaaacattggcagtagcctggcagtgtgccccatggacctgcggttgcatggagtgagcttcctgtgcctttggataaggggacggaagagtgggaagaactgcatcttgtggtttgagtgctgactcatccacagtaaaatagagcaccaagtagacgtctaaggttttgactctggtccctggatcccagatagcacctcgggacccaccaggagcctgggggaagtcaccaccctgaagggaaggacacaggtgagactggcttaaccacctgatagcagagctccaggacattgagtgaacataggctgtagccagggaatggttacagcaagccttgggcgagacctggtgctgtgctggctgcaggtctgacgcaacacagtccttgtggtggtgcttataggggtgcttatctcattctactcccagcccaggaggctcagagcagtgataaactccatttgtcagggagaaagtaagggaagagaacaagagtctctgccagggaattcttccagatattgtccaaaactatcaaggtggtacctctacaagtctgcaagaaccaaagtgttactaggcttggggtgcctcagatacagcttagatcacaacacccaaatactttcaaatatctggtaagccatcccaagaaggacatgtgtaaacaagcccagactgtcaagactacaataaatgcctaacttttcaatgcccagacacagatgaacattcacaaatatcaaaaccattgagaaaaacaggaattcaccaaattaattaaataaggcagaagggaccaatcctgaagtaatagagctatgtgaccttttagacagataattcaaagtacttgttttaaggaaactcaaagatattcaagataacacagagaaggaattcagaactgtatcagataaatttaacaaaggaattgaaatcattaaaaagcagcagaaattctgtagttgaaaaatgcagttaacatactaaagaatgcatctgccttctaacagcagaattgatcaagcagaagagagaatacttagcttgaagacaagctacttaaaaataaacaatcagaggagacaaaagaaaaaaacaatgaagcacacctacaggatctagaacagagcttcaaaagggcaaatctaagagttattgtcattaaagagaaggcagagaaagacataggagtagaaagtgtatttaaagggataatatcgaagaatgttccaaacctagagaaagataacaatatgtaagtacaagaagattataaaacagcaagcatatttaacccaaagaagattacttcaaggcttctagtaatcaaactcctaaaggtaaaggataaagaaagatcctaaaaacaacaagaaaaaagaaacaaatcacataaaatgaagcaccagcacatctggcagcagacttttcagtggaaaccttacaggccaagagagatttgtgtgacgtatttagagtgctgaaggaaaaaaacttctaccctagggtagtatatatagcaaaaatagtatagtatttttgctacatatatagttttaacttcatatcactgaaagaagcactggagagagaaaaaacagcgtggaattgctaacaccaaccctccctgactggggcagcagtggtgtggtgtggcagcatctctggaccctgggggagggagaacacagaaattgtgagtgctgttctgttagagcaggaaggaaaaccagaacaaacacagctgacacctgcccacagagggaacatttaaatcacccctagccagagacgaacccacaatcccagtagtccaaacttcagtgctagcaaacttcgccactaaggtcttaagtattctcagtctccagataaacttgaaaggcagtctaggccataaggacggcaactctgagctagactcagagacaatggcctgaggggtcacacaacatactgagacactagctgaggcagccaaaggagtgctggcatcaccccttctctaaccccaggctgcacagctcatggctccaaaagagaccccttccttttgcttgaggagaggagcaggaagagtggggaggattttgtcttccatcttggaataccagttcagccatagcaggataacgtgccaattagagtcatgaggcccctgttcgaggccctagctcccagatgatatttctagacacatcctgggccagaagggaacccactgccttgaaggaaagaactcagttctgccagcactcatcacttgctaactgaaggcacttgggccctgaataactagcagctatatccaggtaccacatcatgggggctgtagtgggcctctgagacttatgggtttaaggtgagactcaagcacattaccagtttggttacagggtaaaactctttctgcttgggaaaagtaaaggggactttgtcttacacctcaggtaacaacactgcctcaggagaataaagcaccagtggactcttgaggtcctcaattccaggacttgactcttggatgacatttctggacctgccctgggccagaagggagaccactgccctgaagggggagtcccaaaccaggcaacattcaccgcaagctgacttaagagaccttggccttaagggcacattggtgattgtctggcagtactcctcatggccaggggtagcagtgactatggtgtggggctcctctgccttttgaaagggaagggaaaagtgggaaggactggatattgtggcttgagtgccagttcaacctcaatacaatagaataccaggtagacttctgaggtttttgactcagtacgagtcccagacaccacttctggacccatttggggcctgagggacctcacagcccttaagggaaggaagcaggcctggctggttttgctatctggtgattatagggcaccaaggccttaagttaacagaggtagtagtcagagtggttacaacagaccatgggtgagacccagtgatgtgctggcttcaggtctgattcagcacagtcatagtggtgaaggccacaggggtgcttgtgtcactccatccccagctttaggtggctccaaacaaagagtgagactctaaatatttgggagaaagtaaggaaagagaacaagagtttctgcctggtaatccaaagcattctcctagatcttgtccaagaccatcaaggcagtacctttaagagcctgcaataaccacagcattactgggatttggagtgccccttaaggcagaaatagcttagattacaacacccaacttcttgcatatatctgaagaaccttccaaagaaggatggctactaataagcccagagagtggagacaacaataaatacctaactcctcaaagcctagacaccaacgaacacctactagcatcaacaccatccaagaaaatatgacctcaccaaataagggtctaaataaggcatgagggcccaatcctggagaaacagggatatgtgacctgtcagacaaagaattcaaaatcactgttgaggaaactcaaagatactcaagataacacagagaaggaattcagaattctatcaaatacatttaacaaacattgaaataattaaaaagaatcaagcagaaattctggagctgaaaaatgcaatttgtataatgaagaatgcatcagagtcctttaatagcagaatggaccaagcagaggaaagaatagtgagcttgaagataggcaatttgaaaatagacagtcagaggagacaaaataaaaaagaatataagacagtgaagcattcctgcaggacttagaaaatagcttcaaagggacaaatctaagtgttattgctattaacaggaggtagagagagagataagggtagaaaggatattcaatgggataataaagaaaacatcccaaacctagagaaagatatcaatatacaagtacaagaaggttatagaacaccaagcagattcaacccaaagagactacctcaaggcatttaataatcgaactcccaaatttcaacaacaaagaatggatcctgtaagcagcaagagaaacaaataaattacatacaatggagctccaatacatctggtagcagtcttttcactggaaaccttgcatgccaggaaagagaggcatgacatatttaaagtgctgaaggagaaaaaccttcatcctaaaatacctttatgagcctgcaaaaagacaaaaaagacaaaaagaatcctccaaatatgaaggagaaaaaaaaaggctttcatacacaaacaaaagctgagagatttcatcaatactagtcctatcctttgattttttcaatcagaaaaaaaaacattaatgagaaataatcatctgaaggtataaaacttactggtaatagtaagtatatagaaaaatgcagaatgttataatactaactgtggtgtgtaaactacttttatcttaaatagaaagactaaacaatgagttaatcaaaaataataactataacttttcaagatatagtacaataaaatataaatagaaacaacaaaactttaaaaagcaggaagacaaagttaagacaagttttcattagttttttgttgttgtttatttaggcaaatagtgttaaattgtcagcaggttaaaataatgggttgtaagatactatttgcaagcctcatggtaacctcaaaccaaacagcatacaatgaatgcacaaaaaatataaagcaagaaactaaatcatgttaccagagaaaaccatgttactagaggaaaggaggaatgaaagaaaagagaagaccacaaaacaatgagaaaacaaataacaaaatggcaaaagtaagtccttacttatcaacaataagatcaaaattaatggactaaactctccattcaaaagacacagatcagctgaatggatgaaaacacaagaacaattgatccgttgcctgtaagaaatacactttacctataaagacacaaatagactgaaaataaagggatggaaaaagacactccaagccaatggaaactaaaaaaaaaaaaaaaaaaggaagccaggcacagtggctcacacctgtaatcccaacactttgggtggctgaggcaggtggttcacgaggtcaggagttgaagaccagcctggccaatatggtgaaaccccatctctactaaaaacacaaaaagtagcctgtaatcccagctactcaggaggctgaggcaggagaatcacttgaacccaggaggcagaggttgcagtgagctgaaatcgcaccactgcactccagtgagtgcactcgctcaccgagtgaggcttcatctcaaaaataaaataaaataaaaggagtcactatgtttatatcagacaaaagacatttcaagataaaaactataagaagaaacaaaggaggtcactatgcaatgaaaaaggggtcatttcagcaaaagaacataaaaattttaaatatatatgcacccaacactggagcaaatattaaaatatttattttatattataaaacgaataaaatacttaaataaggcaaatattattagagctaaagaaagagatgggccccaataaaataactgaggacttcaacatcccactttcagatttagacagatcttccagacaaaaaattaacaaagtaacattagacttaatctgaactgtagaccaaatggagctaataaatacttacagaacatttcatctagcagctggagaatatacatttttttcctcagcatatggatcgttctcaaggatagaacgtatgttaggtgacaaaacaagtcttgaagcattcaaaaaagttgaaatattatcaagaatcttctctgaccacaatggaataaaactagaaattaataatgagaaattttggaaactacacaaatgcatgaaaattaaacactatgctcctgaatgaccagttggttaatgaagaaattaagaaggaaattgaaaaatttcttgaaacaaatgatactggaaacacaacataacaaaacctacatgatgcagcaaaaagagtaccaagatggaagtttatagctataaccaccaacatcaaaaaagagaaaaagcttcaaataaacaatctaatgatgcatcttaaagaagtagaaaagcaagagcaaaccaaaccaaaaattagtagaagagatataataaagatcaaagaaaaaaaaatgaagttaaagaaaacaatacaaaagatccatgaaaaaagagctggctttttgaaaagttaacaaaactgacaaacctttagccagactaaggaaaaaagagagaagatccaaataattaaaattagaaataaaaaaggagacattacaactggtactgcagaatttcaaagaatcattaatggctactatgagcaactattagccaataaattggaaaatctggaagaaaaggataaatttctagataccccaagattcacaacaggaagaaatccaatacctgaacagaccaataaaaagtaacaagaacaaagccataataaaaagtctcccagtaaacaaaagcctgggacctgatggcttcactgccaaattctatggaacacttaaagaagaactaataccaattctgctcaagctatactgaaaaatagaggaggtgggattacctacaaaatctttctatgaggccagtattaccctaatatcaaaaccagacaaagatacaccaaataataataactacatgccagtatcactgatgaatattggtgcaaaaatcctcaacaaaatactagcaaactaaattcaatagtcccttagaaagatcattcatcagctcctgaaggaagccctaattatggaaaggaaaaactgactggtaccagccactgcaaaatcataccaaattgtaaagaccatcaacactataaagaaactgcatcaactaatgggcaaaataaccagttagcagcataatgacaggatcaatttcacccataacaatattagcattaaatgtaaacatacctcaattaaaagacacagactgccaaattggataaagagtcaagactcatcagtgtgctgtattcaggagaaccatctcgtgcgcaaagacacacataggctcaaaataaagggatgggggaacatttaccaagcaaatggaaaacaaagaaaagcagaggttgcaatactattctctgataaaacagagtttaaaccaacaaagatcaaaaaaagacaaagggcattacataatgataaagggatcaatgcaacaagaagagctaactatcctagatatatatgcacccaatacaggagcacccagattcataaagcaagttcttagagatttacaaagagacgtagactcccacacaataatagtgggagattttaacaccccactgtcaatattagacagatcaacaagacagaaaattaacaatgatattcaggacttgaactcagctccagaccaagcacacctaatagacatctacagaactctccaccccaaatcctcagaatatacattcttctcagcaccacatcgcacttattctaaaattgaccacataattggaagtaaaacagtcttaacaaatgcaaaagaacagaaatcataacaaacagtctctcagaccacagtgcaatcaaattagaactcaggattaaaaactgaaaaccatacaactacatggaaactaaacaacctgctcctgaatgactactgggtagataacgaaattaaggcagaaataaataagttccttgaaaccagtgagaacaaagacacaatgtaccagaatctctgggacacagctaaaacagtgtttagagggaaattgatagcactaaatgtccacaggagaaagatctaaaatcgacaccctgacatcacaatgaaaagaactagagaaggaagagcaaacaaattcaaaagctagcagaagacaagaaataactaagatcagaggagaactgaaggagatagagacatggaaaacccttcaaaaaatcaatgaatccaggagagggttttttgaaaagattaacaaaatagaccactagtcagacgaataaagaagaaaagagagaagaatcaaatagacacaataaaaaacaataaatggaatatcaccaccaatcccacagaaatacaaactaccatcagagaatactataaacacctctacacaaataaactagaaaatctagaagaactggataaattcctggacacatacacccttccaagaataaaaaagaagttgaatccctgaatagaacaataacaagttctgaaatggaggcagtaattaatagccttccaacaaaaaaaaaagccgaggaccacgtggattcacagccgaattctaccagatgtacaaagaagagctggtaccattccttctgaaactatgccaaacaatagaaaaagagggactcctcccaaactcattttatgaggctagcatcatcctgataccaaaacctggcagaaacacaacaaaaaaaaagaaaatttcaggccactatccctgatgaatattgatgtaaaaatcctcaataaactactggcaacccaaatccagcagcacatcaggaagcttatccacacgatcaagtcagcttcatccctgggatgcaaggctgattcaacatatgcaaatcaataaatgtgattcatcacataaagaggactaaacacaaaaaccacacgattatctcaatagaggtagaaaaggccttcaataaaattcaacatccttcatgttaaaaactctcagtaaactaggtattgaaggaacacacctcaaaataatgagagtgatctatgacaaacccacagccaatatcatactgaatggaaaagctggaagcattccctttgaaaaccagcacaagacaaggatgtctctctcaccactcctgttcaatatagtgttggaagttctggccagggcaattaggcaagagaaagaaataaaggtattcaaatagaaggagagaaagtcaaattggctctgtttgcagatgacatgattgtatacttagaaaaccctatcgtctcagcccaaaatctccttaagctgataagcaacttcaccaaactctcaggatacaaaatcaatgtgcaaaaatcacaagcattcctatacaccaataatagtcaaacagagagccaaatcatgagtgaactcccattcacaattgctacaaagagaataaaatatctaggaatccaacttacaagggaagtgaaggacctcttcaaggataactacaaagcactgctcaaggaaataagagaggacacaaacaaatggaaaaacattccatgctcatgaataggaagaatcaatatcatgaaaatggctatactgtacaaagtaatttatagattcaatgctatccccatcaagctaccattgactttctttgcagaattagaaaaaaactacttgaaatttcatatggaaccaaaaagagcccatatagccaagacaatcctaagcaaaaagaacaaagctggaggcatcatgctacccaatttcaaactatactgcaaggctacagtaaccaaaacagcatggtactgctaccaaagcatatatacagacaaatggaacagaacagagccctcagaaataataccacacatgtacaactatctgatctttgacaaacctgacaaaacaagaaatggggaaaggattccctatttaataaatggtgttgagaaaactggctaaccagctagccatatgtagaaaactgaaactggaattcttctttctaccttatacaaaaattaactcaagatggattaaagacttaaaagtaagacctaacaccataaaaaccctaggagaaaacttaggcaataccattcaggacgtaggcatgggcaaagacttcatgattaaaacgccaaaagcaatggcaacaaaaatgacaaatgagatctaattaaactaaagagtttctgcacagcaaaagaaacaatcatcgaagtgaataggccacctacagaatgggagaaaatgtttgcaatctgtccatctgacaaagggctaatatccagaatctacaaagaacttaaacaaatttacaaaaaaaaaaaatcaaaaaatgggcaaaggatatgaacagacacttctcaaaagaaaaaatttatgtgtccaacaaatatatgaaaaaagctcatcatcactggtcattagagaagtgcaaatcaaaaccacaatgagataccatctcacaccagttagaatggtgatcattacaaagtcaggaaacaacagatgctggagaggatgtggagaaataggaatgcttttacattgttggttggagtgtaaattagttcaactattgtgaaagacagtgtggtgattcctcaaggatctggaaccagaaataccatttgacccagcaatcccattactgcgtatatacccaaaagaatataaatcattctactataaagacatatgcacacgtatgtttactgtggcactattcacaatagcaaagacttggaaccaacccaaatgcccatcaatgaaaatgtggcacatatacaccatggaatactatttagccataaaaaaaattttatatcctttgtagagacatgtatgaagctggaatcatcattctcagcaaactaacacaaggacagaaaaccaaacactgcatgttctcacacataagtgtgacttgaacaatgagaacatatggacacaaggaggtgaacatcacacaccggagcctgttgggaggtaggggactagggaagggatagcattaggataaattcctaatgtagattatgggttgatgggtatggcaaaccaccatggcacgtgtatacctatgtaacaaactgtacgttctgcatgtgtatcacagaacttaaagcataaataatttaaaaaaagaaacattcatcatgaatgagcgggatttatttctggtatgcaaagatggttcaatgcacacaaattaatcaatgtgacacatcaactgaataaatgattaaaacatatcatttaaattaatgttgaaaagtatttgaaaaatttgacatctctccatgattaaaaaaaaccctcaaaaaactggggatagaaggaacatacctcaacataataaaaaccatttttgaaagacctccagctagtatactgaatgtggaaaaactaaaaatctttcctttaagagttgaaacacaataaggatgcccactcttatgactgttactcgacatagtactagaagtcctagctagagcaattagaaaagagaaagatattaagatacctaattaagataattagaaaagagaaagtaataaataataaagatacttattactttccattttggatttattacatccaaaatggaaagtaataaatcaaattatgtttgcctgcagatgacatgattttatatctggaaaaacctaaagactccacaagaaagctactagaattgatgattcagttaagttgcaagatacaaaatcaacatatgaaaaccagcagcatttctatatgccaagagtaaacaatctaaaaaagaaatttttaaaaaatcccatttacaatagccacatataatacctaggaattaacttaaccaaagaagcaaaaaatcactataatgaaaattataaaacattcatcaaagaaattgaataggaaaccacaaaatggaaaaagattccatcttcatagattggaagaatcaatactgttaaaatgtccatactaaccaaagcaatctacagattatgtccattctacccaaagcaattctatagatgtaatccttatcaaaatatcaatgacatcattgacaaaaatagaaaaaacaatcctaaagtttacatgggaccactaaacacccagaaaacccacagctatcctaagcaagaagaagaaaactggagaaatcacactacctcatttcaaattatactatagagctttagtatgccagtaccaaaatgatatggtactggcatagaaacagatacataggccagtggaacagaatagacaaccaagaaataaattcatgcatctacagtgaactaatttttggcaaagctgccaagaacatatactggggaaaagatagtttcttgaattaattatgctaggaagactggatatccatatgcaaaagaataaaactaaacctcaatctctccccatatacaaaaaaacaaatcaaaatgaattaaagacttaaatctaagacttcaaactatgaaactactacaacaaaacattagggaaaatctccagggtattggtttgggcaagaatttctcgagcaatactccacgcagacaaccaaagcaaacatggacaaatgggatcacatcaggttaaaaagcttctgcacagcaaaggatacagtcaacaaaatgaagagacaactgacagaatgggaggaaatatttgcaaactactcatctgacaaggaattcataaccaaagtatataaggagcacaaacaactctttagcaaaaactctaatcattcaattgaaaaatgagcaaaagatttgaatagacatctctcacaagaagatatataaatggtaaacaagcatatgaaaaggtgtttgaaattattgatcatcagataagtgcaaatcaaaactacactgagatatcatctcacctgagttaaaatggcttttatacaaaagacagtaacaaaggtaggtgaggatgtggaaaaaaggcaacccttgtacactgttgatggtaatgtaaattagtacaatcattatggagaacagtttgaggttcctcacaaaactaaaaattgagctaccatatgatccagaaatcccactgctaggtatataccaaaaagcaaggaaattagaatatcgaagagataatggcactcctatgtttatcacaatactgttgacaatagctaagatttggaagtaacataagtgtccatcagtagatggattaataaattaaatgtggtacatatacacaatggagtactattcattcacagaaaagaataagatctagtcatttgcaacaacatgagtagaactggagatcattatgttaagtgaaataagccaagcatagaaagacaaacacatgttctcacttatttgtgggatctaaaaatcagaacaattgaactcatggatatagggagtaaagggttggttaccagtgacggagaaagggtagtaaggacctgggagggatatgaggaaggttaatgggtgcaaaaaaatagaaataatgaataagacctactatttgatagcacagtagggtgactatagtcaataatgactacatatttttaaataacttagagtgaaattgaattgtttgcaacacaatggataaatatttgagaggatggataccccattcttcttcatgatgtgcttatttcacattgcatgcctgtatcaaaatgtctcatgtaccccataaatatatatacctactatgtacccacaaatattaaaattttaaaaaataacgatgataacttttcaagacatagacaatataataagatataaataaaaacaacaaaaagttaaaaagcgggaagataaagttaaggtgtaaagtttttattagttttttttcttattcgtttgtttttgcaaacagtattgagttatcagcttgaaataacaggttccaaaatactatttgctagtctgatggtaacctcaaaccaagaaacatacaatggatacacaaaacataaaaagcaataaattaaatcatatcacagaaaatcaacttcactaaaaggaagacagaaaaaaaagaaagaaggaagaataaattaaaatacaaccaaaaaacaaataacaaaacggcagaagtaagtctttacctattaataatatttaatgtaaatggactgcactctctaattaaaagacggtgtctgaatggatgaaaaaacaagactgaatgatctgttgcttacaagtatcacagctttgtctataaagacacatacacactgaaaataaagggatggaaaaagatattccatgccaatggaaaccaaaaaatgtgcagaagtagcttttatttacttatcagacaaattagatttcaagaccaaaactataagaaaggacaaacaagatgaaaaaagagtcaatttagcaagaggatgtaacaattttaaatatatatgcacccaacactgggacacccagacatataaagcaaatattattagagctaaagagagagggagactccaacacaataataactggacacttcaacacctcactttcagcactggacagatctttgaggcagaacatcaacaaagaaacatcaagcttaatctgcactatagaccaaataaaccgaataattgtttagagaacattttattcaagagctgcagaatatacattctttttgtcagcatattaattattctcaagaatagaccatatgttaggtcacaaaacaagtcttaaaacattcaaaataaattaaaataatatccaacagcagaagacctgaccacactgaaataaaactggaaaccagtaacaagaggaattttttaaactatacaaatacatagaaattaaacaatatattcctaaatgacctatgggtcaatgaagaaattaagaagataattgacagttttctttgataatggcaacacaacataccaaagtgtatgggatacagcaaaagcagtactaagagggaagtgtatagctacaattctctacatcaagaaagaaggaaaacttcaaataaacaacctagtgatgcatcttaaagaattagaaaagcaagagaaaaaccccaaattagtagaagcacagaaataataaagatcaaagaaataaataaaatcgaaatgaagaaagcaatacaaaaaaatcaatgaaccaagagttggctttttgaaaatttaaacaaaattgccaatgtttagccagatgaacaaagaaaaaagggagaagatgcaaataaataaaatcagagatgaaaaaggagacattataactgataccacagaatttcaaaggatcattagtggcaaaaatgcacaactacatgccaataaattggcaaatctagtagaaatgatcaaatttctagaaacatactacctgccaagattgaaccatgaagaaatctaaagcctgaacagaccaacaacaattaactagagcaaagccatactaaacagtctcccaggccgggcgtggtggttcacgcctgtaattccagcactttgggaggctgaggaaggtggatcacgaggtcaggagatcgacaccatcctggctaacacggtgaaaccctgtctctactaaaaatacaaaaaaattagccgggcatggtggcaggtgcctgtagtcccagctactcgagagggtgatgcagaagaatggcgtgaacccgggaggtggagtttgcagtgagccgagatcgcgccactgcactccagcctgggcaatagagtgagattccgtctcaaaaaaaaaaaaaaaaaaagagtctcccagcaaataaaagcctgggactcactggcttcattgatgaattgtaccaaacatttaaaaaataactaataccaatgccactcaaactcttctgaaaaatagacgaggaggggatacttccaaactcattctacaaagccgatattactctgataccgaaaccagacaaggacacatcaaaaaagaaaactacaagccaatatccctgatgaacgttgatgcagaaatcatcaagaaaatattcacaaactgcattcaacaatgtgttacaaagatcatggttcatgaccaggtggaatttatctcagggatgcaagaatagttcaacatttgtgagccattaatgtgatatatcatatcaatacaatgaaggacaaaagccatgtgatcatttaaattgatgctgaaaaagtatctgacaaaattcaacatctcttcatgacaaaatccctcaaaaaactgggtatagaaggaatacacctcagcataataaaagccatatctcagaaactccatagctagtatcatactggatactagcttagaggaaaaactgtaagtttttccagtatccagtatgataagatctggaacacgacaagaatactcactttcaccactgttattcaacatagtactggaagtccaagctagagcaatcagacaagaaaaaaacataaagggcatccaaattggaaaggaagaagtctaattatccttctttgcagatgatatgatcttatatttggagaaacctaagactccaccgaaaactattagaactgataactaaactcagcaaagttgcaggatacaaaatcaacacatgaaaatctgtagcatttttatatgccaacagcaaacaatctaaagaaaaaatttttaaaagtaatcccatttacaatagccacacataaaattaaatacctaggaattaaccaaagaagtgaaagatctctacaatgaaaactgtaaaacattgatgcaagaaattgaagtgggcaccaaaaatggaaaaacattccatatttatggattggaaaaatcaatgttgtaaaaatgtccatactaaccaaagcaatctaaagattcaatacaatactaatcaaaataccaatgacattcttcacagaaatggtaaaagcaatcctaaaatttatatagaaccataaaagacccaaaatagccaaagctgtccttaccaaaaagaacaaaactggaggaatcacattgcatgacttcaaattatactacagagctagagtagccaaagagcatgataccagcataaaaacaggcatatagaccagtgaaacagaatttaaaaaccagaagtaaatccatgcatctacagtgaactcatttttgacaaagtttccaagaacatatattggggaaaagatagcctccttaataaatggtgctgggaaactgaatatccatatgcagaagaatgaaactagacccctgtcttttaccatttacaaagatcaaatcaaaacagattaaagacttaaatctaagacctcaaacttggaaactactgcaagaaaacattggggaaaatctccaggacatgggactggacaaagatttcttgagcaaaaccccaaaggcacaggcaaccaaagtaaaaatggacaaatgggatcacatcgagttaaaaagcttctgcaaagcaaaggaaacaatcaacaaaatggagagaaaacacagaatgggagaaaatatttgcaaattccccatctgacaaggaatttataaccagaatatataaggagctcaagcaactctataggaaaaaatctaatcatccaattgaaaaatgggcaaaagatttgagcacacatgtctcaaaagaggacatacaaatggcaaacaggcaaatgaaaaagtgctcaacattattgattatcagataaatgcaaatcaaaactacaatgagatatcatctcacctgagttaaaatggcttttatctaaaagacagacaataaggaatggtagcaacaatgtagagaaaagggagcccttgtacacttttgttggaaatgtaaattaatacaatcactatggagagcagtttggagtttcctcacaaaatcaaaaatttaactaccatataatccagacatcccactgccatgtatatacccaaaagaaagaaaatcagtctatcgaggagatatctgtactcccgtgtttattgcagcactattcactagccaagatttggaagcaacctaagtgtccatcaatagatgaatgaataaagaaaatgtggtatttattcacaatgtagtactattcattcgttaaaaaaaagaaagaaatccagtcatttgcaacaacatggatggaactggagatcttttatgttaagtgaaataagctaggcccaataagacaaacatcacatgttcttactttatctgtaggagctaaaaattaaaattgagcccatggagatagagaatagaaggatggttaccagaggctgggaagagtagttatgggagtggggagtaaggggggattgttaatgggtataaaaatagaataaataagacctagtgtttgctagcaaaagagggtaactatggtcaaaaataatttaattgttcatttaaaaataactaaaagcatatataattgtttggaacacaaaggataaattcttgagtttatggatactctatttaccttaatgtgattattatgcattgcatgcctgtatcaaaatatctcatgtaacacataaatatatatgctttttgtgtacccatgaaaaggaaaactttttcaagaaacacttaaccaaaaagcatgaagaataggagatagatgacatgattctatataaagttattgcattattagtgaagtagcataatattaattcaaggttgattgtgataaattaatgatctatattgtaaatatctatactaacttctcaaaataatccagaagtagagcttttaaaaatccaatagaaaaatatacagtaaaaatatactcaatctaaaatggaaaggaaataaggaacaaagtgggtagtaaaacaactcagaaggaacaaatagaaaacaaaatagaaaaatgatatacttaaacaaccatattgaataattgcattaagtataaacagttttattaaaatgttgtcgaaatgaataaagaaacaagacccaatcataagctgtttacagaagacaaaatttagatgaaatgtaacagaaagaataaaattacagaatggaaagagatgtaccatgcaaacactaatagtggcagggcatactgttattatattagtgtcaaatgggcttcaaactaaagaaacttaccagatataaaggagtattctatgatgataaaatgttaattcatcaggaagacctttatatgttgatttattacatatatcatttttctcaaaaagtaatttccagaattcctttccccatcctggttttaaacatgatgctttcaacatctaattttctttttcatgtcttttttcatttttaagatgattttgacacattttattttttatagtagtttccagagtatgtaaacctttttaaatcaactcattaatttaatatataacaaaagacactcataagatttcctaatttagatatgaaaaatatgctgtccctaatttgactgtattatgtctaaaatataaattagttatctacttaatatacatatatagtatactaagactttctgttcctacagtcagcattttctctttggttttctcctctttaatgtcataacaataataaataacattttggagcactctatcaagcactgggatttacagaataccataaagcaaaaaagtgttgccactatgagaatttcagagggaaaagacatggagagattcatagaaactatatttaatatgataaatgcaaaaaaatcccaagattttggagagatattaacatttggatccatgaaactcaaagttatccaaacaggcttaccccacagaggtcctcactgagtcaaattatgatcaaaatttcaaaagccaaagaaaaagaatttttaaaggaataagagaaaaaacatcaagtgacatacaaaatcctcatgagaccattagcagatttctcaacagaaaccttgcaagccaggagagaatggtataatatatttaaattgctgaaagataaaacacctgtcaaccaatagtactatacccagcaaagctgtccttcagaaatgaagggaaaatagtctttcccagacaagctgaagctaaggtaattaattattattagacaagccaaatgaaaaatgcttaagggagtgattcaaccagaagcaaaagggtgataattaccattatgaaaacatgaaactggtagaggcaaatttgtaatcaaactcagaatactccaatactgtaatgatagtatgtaaatctttcaaatctctagtgtgaagtttaaaagtcaaaatagtcaaaagtgaacatagctacaataagtcactaaggaatatacaatataccctaacaagctgcaatttggtaagttggtctcctcaaggaatagtaccatttcaggggcttggtgttggtataagttgctaacagggaagaaatttgatattgggagtagtaagattaattttactaaatgggaatccatgcttaaggctttatgcagaatctctattcctatcaccataaccactttgctcatgtgcctattgctttagcactggagtagctaataacaaaatcggttgataacaaccagccaagttatttggtctacttcattttttggtgcctttcctatggtggttgctctttgatgggtgttaatatgaaggttgtttgtttgtttgcttgttttgagacagagtctcactctgacgcccaggctggagtgcagtggcacgatctcggctcactgcaagctctgcctcccaggttcacgccattctcctgcctcagcctcccgagtagctgggaccccaggcgcccgccaccatgcccagctaattttttgtatttttagtagagacagggtttcaccgtgttagccaggatggtctcgatctcctgaccttgtgatccgcccgcctcggcctcccaaagtgctgggattacaggcgtgagccaccgtgcccggccaatatgaaggttttaaactttatgtccactcctttaagtctgtctgtatacctctgccacataccttttcgtccctggccgtgaaatctttttccttaaaagccactgactagccacctcagccattcaccactgttcataggtccatatactgatctatgcaaagtagatgactaaatgcatcaccaaagttctgcctactgtgggggtgattttttctaatcactgtctttcaaagccactgcgtaagatttgtaatgaatttgctatctgttttgggcaggcaccaatataccaaactgttccattcataagccaagtttggacttttgtttttctcacttttcttattgtaaggaatatctcaagtagacaaaactgtgaactgagtagtttctggtacaataattgcaaataaaatgggagcctgggctacttgctcatgcagttggcttttgccctctgctcataattccagatggtatcactgctatttcacagtggattgttgctggacccacctgattatacaattccatgaatctgacagaccccagcacattgcaggcagtttcagatgcatgattattcacttcatctctgtcatggtacagtagcatgccaaccgttgtttttcaaaatacatgtaattccctggctaacattgatgttcttcatttttgctatcatgcttccagatacacatttttttatttccctgcttgaaatttgttggatttggattttttgtttgttttttaattttactttaagttctgggatacatgtgctgaacatgcaggtttgttacataggtatacatgtaccatggtggcttgctgtgcctaccaacccatcatctaggttttaagccctgcatgcattaggtatttgtcctaatggatttgttgaatgatactgctatcattcatcatttatgtaaaattctcagcaataatatcttcaaatatttcctttttgtcattctctttcttctcatactgaaacttcagctaaatacatagacatacacatatgtttggctttttatgtttattattctctctatattttgacctatttttatattttccacctctgcctttctggggggcttcttagataattattttccattgtttattttctagtttactgattcttatttcagatgtgcgtaatatgctgctttgtggcttttcaaatttgttcagattttattttacttattgaaatatattaatgtacatttatatggtgtcctataatttcaaaatgtgaggtttgagtatctgttttctctctcacataggatagtttacttccttgtgtttagtaatttttttaaattataaactgctctgttaccttggaactttatatatgcaaatgtgttgatgcctggtttgaaagtaggttattccagaaataatttgtctttgctctattcagtcatctagaggcactttatgttctccacgtggacgcttggctatccagatagcatcaatttaagaatttttttctgctaaataccgaagtttgaaactggttattttttttacagtttcccaaagagaaaggggaggcagattcacttatagtcaatagtatacatactctgagtgtggagtcctttgtgacccctgcttatgtaacagattttttattagcctttgacatcatcatctgtccatggggcttgctctctttccatgtatctacagctaacagctattacagtgtgtaccttccttctgagtattaatgacttgataatttgttattctttccatctcccaatccagaatagaagctcctctaaagtaggtatcatgtcttaggtcacctagcatagtgccttggacatatattatatgctaaatcggtcagtgttaattgtttactagcaaactaattgactgcttcattatttatgctcttcataactcctgcttaatgacaacatactgacatttgtcctagaccctaattccatgaccctattttatgccttaatctcattgatctctctgtttttagactctgtcaaccactctcacatagaaaccctgttcctcctcaccccttactactgtaatgatttgttacaggttaccatctcttctgttggtttatgtgattctataatattctagttatcctcctatgtttccaattatctatattctgccccttttcctgcttcctcattctatcttattcctcctgggggtttttgttgttgttgccactgtggctgtctctcatgcaccccctcacaaacttcagttatgtggtttgtgaaatttgaagatgaaaagagtttgcttgaaaccacttagctaactggggatttgttcatctttacatgattctagttttatctttaaaagagagcaattctgtctgaatattggcctttggggggacctttatgcagatgtcaggccacttaacatggtgaagatttcttttttattatgttcgagttgaatgcctcctacaaagtaagtaatctggactaattttgtcattctaaaggagcgcatactatgttttttcgtttttttgaagaccctttactgaaaaaaaaacagatttggttttaaagaattagatttgtttgatcttattttctttccccatagagcagagatattttgaaaatgtttcactttgttttttacttagactagtcccttgttaaaagtgcacaatgtctgcatgctaaaacaaatgtgcatttgaatgcacaattgattaaccaattttctaataattaagtttttagattttgcatgtgcatttgttgctcatttgaccacataataattaattagccttaattataatggattacaccttcaaatcctgcatgcatattataatagaatgacagtattttacatcacttttcatattttagtcaaacagtaaaggaagtgaatttttaagatgggggaaattttatatctgtggaagttgacattttgattaatgaagtgttacagttattcttaatgtatttatttgatggtgcattcagcaaaattaattctgatagatgaaatgtgtttaaaacactgcttacaaaatgaatggtgtctctaagctaatagagttacaaatgcacagaagaaaaaaaatgaagactttataaatgagtcaagtgaaaataaatgccagattaaaaaacaatttactgtgtgtgtctagagagccaaagggagctcaactgcaaagaatttgacttacgtacaaagtgagcagctgaaatatttaaactccatcctaatgctcttcagccataatggtaaaaggctgcatagttgggcttcttacctgaacttgtgatatgtaaagctgaaaggcaaaaacaaaaattacttcctaaaagatatatcgagtcaaggagtgcagccttgtcactcattagtggttactgggggctgtggtgtagcttgagaatcaggaaaaataggagccagaaacaattacttggctcagacatctaataagcaatggggatgagtactgcaacctgaggccagctcctctgcaggaacttttacccatctcaccttttgggtttttgttgttgttgttgttgttgttgttgtttttgagatggagattcactcttgttgcccaggctggagtgcagtggcacagtctcagctcactataagctctgcctccgagttcaagcaattctcctgcctcagcctcctgagtagctagaattacaggtgcacgccaccacacccagctaatttttgtatttttttagtagagacggggtttcaccatgttggccagcctggtctcgaactcctgacctcagatgatccacccgcctcagcctcccaaagtgctgggattacaggcatgagccactgtgcccagccgtcagcagaataggtccatttaaagtgaccatcagagagcagatattagtctacaatattcttttaaaggacggctcccatttcaggtataataccttgagtccatattaaaagttctcccaagattttcaaaatatataaatagccaagttttccctcttgggaaaggtgaaataaatataaatatcattcatacagtaaagtacatggcttcagagagagctacacgggtataaactctgattacatcactcaccacttatttggcccacctatttgggtaagttaaaaaaaaacaaaaaaaaaaaactctctctgtgtctgttttctcacctgtaaatgaaaataaataatttgttttatctttaatcttaccagaatttaagatctatgaggcagtcattttgatgttgttgttcattgatgtagctcaggtactcaaaaagggcatagggaatatatgaaacacttcaagatgttctaaatgacatatcagtagagtctcataagaaggaaaagagaaagaatatgatagaagcaatattttaagagacactggtcatcctaaaggagggttcatactatgttttttctttcttttgaagaccttttactgaaaaaaagaattttctaaaactaagttcaagaattttctaaaactaatgaaagaaatcaatccacagatttgtggaaagttttatgaactgaacaggataaatataaatttaaagttttctaagcatattagagtaaaaaatgctaaaagccaaagatgatgagggaacagttgtggtggctcacacctgtaatttcaacactttgggagaccaaggcaggtggatcacttgagctcaggaattcgagaccagactggacaacatggcaaaaccctgcctctacaaaaaaaattagctgggtatggtggtgcctgcctgtagtcctagctacttgggaggctgaggcaagaggatcatttgagcctgggaggtggaggttacagtgagctatgatctcaccactgtattccagaccgggtgacagagtaagagcctgacacaagtaaaagcaaaacaaagcaaaaagataatgagaaaatcttaaaaacagccaaatgaaaaaaaaaaaaacacttttttaaaaagaaagaataataagaatgatatctaaattcttgataaaaactgtggaagcccagaagcaacgcaatattttcaaagtactgaaagaaaataactgccaaactaaaagtctatgcactgtgaaaatatacttcaaaggtgaaaatacatttcaattgagaaaagaaacaaaaaaaatccaaaaagtttgttcccagcagactcacactataataactattaaagaaatttttcaggcaggaacaaaaaataaataaatataaaataaaaacatggaaatgcagagaagaatgaaaagcaatagaaaggtggaaatgtggataaatctaaatgaatgttgacatacaaagtataatattaatagtttcttgggctataaatacttgtaatattaaaataaatgataatgattacacaagagaagatgggtgcagtggctcatgcctataatcctagcactttgggaggccaaggcaggcagatcacttgagctcaggagtgtgagaccagtctaggcaacatggtgaaacctcgtctcaaaaaaaaaaaaaaaacattatacaagagggcagagtgtaatacaagatggtcagttagaagtagctatgatgcatgctactaccagagaggaattaaaggggcgagtaaatatagcacattcaacagaaatatccagatgttcacactgggactgatcaggggaacaactcaacccacagaaaatgaaaagcagggcagggcgacagtgcacctgggagcgactcagagcctagagaaacccctcccctaaccaagggaaggggtaaggaaatgtaagactccaggaaaccatgcttctcccatggatctttgcaaccattggatcaggagatcccctcgtgagcccactccacgagggccttgggtccgatgcatggagctgtgtggagtctcagcagagcagctactcaggcatgcagagagacccaggagctttacatactctggcgctggatccctgacaaaggtgaatacaactcagccaaggcaagaggtccatacatacccctgggaaaggggctgaatccagggggccaagtaacatccgtctgcaggttccacttccatggcccctcacaagaaaagatctactggcttggagttccagccaaccactggcaacagggtaaatcctgcctgagatgggacagaacccccaaggggaagggtgggccaccatttttgctgtttggacaactcagccactctagcctgtgggttttggagagtccaaatggctgggatgaggaagcaccccctgtactgcagcacagctgctttaccaaacgtggcctgactacttctttaagtaggatcccaatccatttctcctcactgggcaggacctcctagctggggtctccggccacccccactggtattctaggacagagctctgatctctctctgggacagagttcccaaaaggaggagcaggttgccacctttgttgtttgggcaactcagccattccagcctgtgggatttggagagtccaaaccgacaagggcagaggcagtttgccagcatcgcaccactgttttgttgaggagtgaccagattgcttccttaaacaggaccctgattgattcctccacagtgggcagttactcccagccaaggcctccggccaccactgcccaaattctataaacagagttctgatttatccctgggacagagtggctgtggggagatgtgggccaccacctttgttgttttggctactcagctggtccagcttatgggcattggagagccaaaccgatcaggagccgaagggatccccaatacagtacagctgctctaccaaaatgtagcgaaccacttctttcactgggtctctaattccgttcctcctgactgggtgagatctcccaaccagggtcccctgccacctcctacagatgcatttgggccagccaacaggtcaatacccctaggacagagctcccagaggaaggagcaggctgccatctttgctgttttgaagacttcactggtgatacctttaggtattggaaaaactgaggtgactggggcctagagtggacccccagcaaactacagcagtcctacagaagacaaacaagaacaacaatgacaaaaacccacagaaaccccattcacaccccatcagcaacctcaaagagtgaaggtagataaggccacaaatgagaaagattcagtgaaaaaacgccaaaaactcaaaaagccagaattccccctttcttccaaatgaccacaacacctctccagcaagggtttggaactgggctggggctgggatagctgaaatgacagaagtaggctttagaatgtgggtgaaaacaaacttgactcagctaaaggaggacgttgtaatccaattcaaggaagctacgaatcatgataaaacaatgcagaagctgacagccaaaataaccagtatacagaggaatataaatagcatcatggagctgagaaacacactacaagaactccacaatgcagtcacaagtattaataacagaatagaccaactgaaggaaaaaatctcagatcttgaagcccatatttctgaaaaaaagacaagcagacaagaatggaaaaaaaagagtgaaaagaaatgaacaaaacttataagaaatatgggattatgcaaagagaccaaatctatgactgattgggctacctgaaagagggaaaatggaagcaatttggaaaatatttaagggtatcatccaggaaaacctccaaaaccaagttagacaggccaacattcaaattcaataaatgcagaataccccagtaagatactccacaagaagatcatcctcaagaaacataatcatcaaattctctaaggttaaaattaaagtaaaaatgttaagggcagccagagagaaaggccaggtcacctacaaaggaagccctaacactaacattggacctcagtggaaaccctacacccagaagatattgagggccaaaattcaaaattcttagaggaaacaaattccaacccagaacttcatatctggccaaactaagcttcatagatgaaggaaaaataagatccttttcagacaaaaaaatgctgagggaattatttaccaccagacctgcctttcaagagctcctggaggaagcactaaatatgaaaatgaaaaatcattaccagccactacaaaacactgaagtacacagaccagtgatactctgaagcaaccacataaacaagtctacaaaataaccagctagaatcatgatgacagtatcaaaaccacacataacaataccaaccttaaatgtacatgggcaaaattcccagttaaaagacatacagtggcaaggtggataaaaaaaacaagacccatcaacatgttgtcttcaagagacccatctcacatgcaaagacacatataggctcagataaaatggatggaggaaattttaccaagcaactgaaaaacagaaaaaagcaggaattgcaatcctagtttccaacaaaacagattttaaacctttttaaaaagtcaatgaagagcattacgtaatgataaagggttcaattcaataaaaagagctaattatcctaaatatatatgcacccaatacaagagcaactagattcataaagtaagctcttagagaccttcagagagacttagactcccacacaataatagtggaacactctaacaccccactcataatattagatagagaatcaagacagaaaattaacagagatatttaagatctgaattcagctctgaatcaggtggtcctgatagatatctacagaactctccacccaaaacaatagaatataccttcacattgccacatggcacttactctaaaattgatcacatattcagaaataaagcactccttagcaaatataaaagaactgaaatcataacagactcttggaccacagcacaatcaaattagaactcaagatttaaaaattcactcaaaaccatacaactacatggaaattgaacaacctgctcctgaataatgaaattaaggcataaatcaagaagttatttgaaactaatgagaacaaaaatactatgtaccagaatctctgggatgcagccaaaacagtgttaagagggaaatttatagcactaaatgcctacatcaaaaagccagaaagatctcaagttaacaacctcacatcacaactaaaagaactagagaatcaagaacaaacaaatcccaaagctagcagaaggcaagaaataaccaagatcagagctgaactgagggagatataagagacacccttaaaaagatcaacaaatccaggagctggtttttttaaaaataataaaatagatagactactagctagactaataaagatgaaaacagagaagattcaaataaacaatcagaaatgataagggggatattgccactgattccacagaaatacaaacaaccattagagaatattacaaacacccctatacacataaactagaaaatatagaagacatggattagttcctgggcatatacaccctctcaacatagaaccaggaagcaattgaatccctgaatagaccaataatgggttctgaaattgaggtagtaataaatagcctaccaaccaaaaagaaaaagctgaggagcagacagattcacagctgaattccactagaggtacaaagaagagctggtaccacttctactgaaattattccaaaaaattgaaaaggagtgactcctccctaactcattctataaggccagcatcatcctgataccaaaacctggcagagatacaacaacaacaaaaaattcaggtcaatatccttgatgaacactgatgaaaaaatctttgacaaaatactggcaatccaaatccagcagcacatcaaaaagcttatccaccacaatcaagttggcttcatccccaggatgtaaggctggttcaacatacacaataaataaatgtaattcatcacataaacagaactaaagatgaaaaccacttgattatctcaatagatgcagacaagaccttcattaaaatttaatatcccttcatgttaaaagctctcaataaactaggtattgaaggaacatacctcaaaataataagagccatctacgacaaacccacagccaatgtcatactgaatgggcaaaagctggaagccttccccttgaaaactggcacaagacatgtttgccctctctcaccactcctattcaacatagtattagaagttctggccagggcaatcaggcaagagaaacaaataaaacaattgaaataggaaaagaggaagtcaaattatctttgtttgtagatgacataatcttataactaagaaactccatcatctcagcccaaaatcttcttaagctgataagcaatttcagcaagtctcaggatataaaatcaatgtgcaaaaatcgctagcattcctatacatcaataataggcatgccgagagccaaatcatgaatgaactcccattcacaattgttacaaaaagaataaaatacctaggaatacagctaacaaaagacatgaaggatctcttcaaggagaacaacaaaccactactcaaaaaaatcagagatgacacaaacaaatgaaaaaacattccatgtttatggataggtagaatcaatgccatgaaaatggccatacttctgagagcaatttatagattcaatgctattcccatcaaactaccattgacttttttcacagaagtagaaaaaaataaaatttatggaaccaaaaaaggacctgaatagtcaaggcaatcgtaagcaaaaagaacaaagctggaggcatcacgctacccaacttcaaactacactacagggctacagtaaccaaaagagcatggtagtggtacaagaacagatgcatagaccaatggaacagaataaataacccagaaataagactgcatacctaccaccatctgatatctaacctttgacaaacctgacaaaatccagcaatagggaaagaactttctattcaataaatggtgctggcataattggctaggtataggcagaaaattaaaactggaccccttccttacaccatatacataaatcaagcaaagatgaataaaagacttaaatataaaatacaaaactataaaaataacctagaaaaaaactcaggcaatacccttccggaagcaggtttgggcaaagatttcatgatgaaggtgccaaaagcaatttcaacaaaaacaaaaattggcaaacaagatctaattaaactaaagagcttctgcacagcaaaagaaactatcaacagagtaaacagacaacctacaaaatgggggaaaatttttgcaaactatgcatctgacaaagatctaatatccagcatctgtaaggaactcaaatttacaagaaaaaagcaaacaatgccatttaaaagtggacaaaggatacgaacagacacttatgaaattaagatgtacatgtgaccaacacacatatgaaaaaaagctcaacaccactgatcactagagaaatacaaattgaaactacaatgagataccatctcacaccactcaatggctattattagaaagtccaaaaacaatagatgctggcaaagttgtagagaaaaagaaatgatttttacactgttggtgggagtataaatcagttcaaccattgtggaagacagtatgaggatttctcaaagacctagaggcagaaataccatttgacccagcaatccttttgctgagtatatacccaaaggaatatagatcagtctactataaagacacatgcatactgtatgttcattgcagcactgttcacaatagcaaagacgtgggatcaacctattatatgtccatcaatgatagactggataaggaaaacatggtacacatacaccatggaatactatgtagccataaaaagaagcaagataatgtcctttgcgaggacatggatggagctggaggccgttatccttagcaaactaagaaagaaaatcaaatactgcatgttctcactaaatgatgagaacatggacacatggtggggaaccacagacactggggcctgttggagggtaggggttaggaagaggaagaaggtcaggatgaatagctgatggtttctgggtttaatatctgggtgagcagataatctgtgcagcaaaccaccacattcacctatgtaacaagctgcatgttctgcatatgtacctctgaacttaaaataaaagttggaaatttaaaagaagaagaaaaggactaaaaagccatgattctaagtgtttaccttgaaaaatagaaaaaaaattgaaaaaaccccagataagactttttaaattgaaaacaaatgtaaaatatagaaaatcgacaattgccaaagataaaattcataaaagttagcttctgggctttggtaatttttttaaattgctggttttgtgagtgggtttactttgtgaaaaatcattggtctctgtactatgttttatacacctttatgtgtaaaaagtttacttaaaaaataataattttgaaacatggtcaggaattcttctttccaagctgcatctgccgtttggtaacatctttccagcactttgaaagagagcataatgagatactcaaattctgtctttgcagatcctctcctctttcaccattcttcttccaagtctcccatagcctcatatcttcattacccaaggccagctttcctgaactcatcctctagggactctgactgaaaaatccctacagcatgccaatatgcctcactgctacaggagtaagactttctaagatttgcccattttttttccttcactgaaatgtacttatctcataacattaggccaaaagcaaaaaagttctgtgatcaaagaagttgagggaacacagaatattttatccccatcctgagattcataaaacacatatagtttattaaaatgcccaatgagtcctgcagtagataaacttatctttatttactccattttcaaaatgaactttaccatagaagtctttttttcacagcacggcatggtgacttacgcctgtaatcccagcactttgggaggccgaggcaggcggatcatctgaggtcaggagtttgagaacagcctggccaacaaagtgaaaccccatctctattaaaaatacaaaaattagccaggcatggtggcaggcgcctgtagtcccagctactcgggaggctgaggcaggagaatcacttgaacccgggagccagaggttacagtgagcctagttcacaccattgcactccagcctgggtgaccagagcaagactaagtctcaaaaaaaaaaaaaagtcttttttcacatcatcacatcataaagccttttcatttattcaaatatttatagagcgcctagtatgccaaatactaatttctgtgctggtgataaatccatgagctcttggagtttaagctctcagtaacgacggcagaaagtaaagactaaattcatacatgatttcaggtaataataaacattatgaataaaaattaagcagggtatagtgattaaacaatgacaactgaggttggagtataggaatccacagaacaaaactttggaaattttgccttagtgtgtaaccatgtgctaactgaagtaacaaagtccctttggagaaggtttgagaaaaccttcaacactctctcttcaattagtgtgtgtgaaaaagtacaaggatacttattacctgatcttgaagaccagtgctattgatagggacttctggccagctaggagagaaggtagtgttgtgcaaggcgttcaagagactcggggcccctacaattatactttgtaaatggaacttactcaatgcactcctaaggcaattgccccttcctagaaaattggagaagtgtaatggttgcgcagtttcctgaacacacagatctcagctgcttaatttattttacagtgttttttattagcctatagttgactagtataatttttcctttctacagacatggaaactggatttccaggtttcatgctgttcctcacataataaatcaggtcaatctatgaattctttttttcactatttcacaatacctatttgatatctactgtctgtgtagctctgtctcaggtatgcaaaaataaatgtgacccagaggaacttacgagcatattatagtcggaaggtcaggtactttccctttgtgtttcccagcctctgtcttaagaaatcagtaaatgcctcacaaacagatgtaattcatttgtttatgactttcccaggccacacagaacacaataaacagagtatatgcctgagatatatttagagtcttcacccaagaaggctttggatggtttttaaatactgagggtaatgataaatacaatactcttttgccaatcaatagaagtacgatattacaaaaacagaacttctccttattcttctcactgggaaggatttgctcagcagcatagcttttaacactcttacgacttaaaataagatactcaaaactgggcagataaagcatcgattctaatccaccacctgaagtcatatgactcatctgaagcagaagtggaaaaaaaaatctagaccaggaatctcaaattatcacaggcagcaaagaaagtcaaaatgattgtaccaatgagtcatccgccatctgcttctcttccagaaaatgtaagtcaaggtacagataagcaggagtaaaccaacatcaagaaaatgcaaaccacaatgttcttctacaatgatagaaggaaatatgaagtatattaaaagctaacacaaggagattagattgactcagaacctcactgagcaggctgggaagataataggttttgtaagacccaatacctgcagtaaatgatatgggaaagggaaggaggcctatactatggctaaaaagggaactgaaagccaagagactcaataggtgagttccagtttaccaatttattcttcccactccatttgctgactcaagttgtgatacagaagataggaaatctcatcttcctaacaagaagactccattcctatgaggaaaaataagctgagagtccacttgaaatctcttcttgatacctccacatccatcatccctctcttatgatccacttttggctaccttactagaacagagaactgttctgtggaattattcattccattgctcttgttttatattgatagtttagcactcatcatactgtattacagggcattatttgtactttttctctttaatatatataaattccttcagtcatgtgtcatagcaatagctaattaatactcattattttatcctaccaatctttattgagcacctactatgggccaaacactgttcttggggcttatgatatattaaaaaacaaactatgatctctgcctttgtgaagcttacattcaagtgggaggcaggaatagaaaatcatcataagtagatatgctagtatgtttgaagatgataaacatcactgaaaagaaaaacagtagaataagaaagatcaggaatgccagaaggtagtgttggggaaggggtagtttgcggcattaaagaggacagtcagagcgggctttattgagaaggtgagatttgcccagacttgaaggaggtgatggagttagtcaagtgaattttgagaacagatgtattacactttcttcttcaagctccatcaaggactttaagccagtgctaccttgagactcaggagatttggtaagttcaccaagctgccagaacacttgtttttggctcacataatatattcagtgagtaagactttagtcattttgttactattgtgtgacatgggagactgagaacaggaacagagaaaggagaagcagcacagcactcaagagtggggtgggaatggggagaagagggacctccactctcatctgaatcaagaaagattctggaaatcttgtgggtagaatgaagtcagcccttcctgtttcctaaatgtccttccttgtgatgagttttaattatctaaacctgtcataaaactctacagagtctctttgttgtctttaaagacttctttttgctggctctttttattcattctttatttctgtggtgaccaaaaggatcaatctcagctatattttctggagaggcccaggagagggaattccagttttgttgttcagtttcagccctgtactagttttataaaattatatctattttggggggctctttcaaagaaagtgtaactaatcaagatatatttgaaaatgtactcattcaattaaaaacgcttattaagcgattgacaggtttcaggcactgactgtgtattaagcatacaaagataaggaagatatggttatactagaagtaaaaacctatccttaataatattctggggcagccgggcgcagtggctcacacctgtaatcccagcactttgggaggccgaggtgggcggatcataaagtcaggagttcgagaccagcctgaccaacatggtgaaaccccgtctctactaaaaaaaatacaaaaattagccgggcatggtggcatgcactgtaatcccagctactcaggaggctgaggcaggagaattgcttgaacccaggaggtagaggttgcagtgagctgagatcacaccactgcattccagcctgggcaacagaggaagactccatctcaaaaaaaaataaaaataaaaataaaaaaaatatatataaaatattctggggcattgcataccacaggccagaacaaaatgaccccaagttataggaaaacaataaaacagatttgtcatactctagaaataattcagtcaaaagtactaaacattttttcaatgaaacaagaaaagtcatgttcttactgatgactattttactactgtgattgtcttttatgtaaaacttttaaaccctagcaacattagccattcctcctggttcctgttaataagtctgtgcttcactgaacatcctaatcacccacatttaccatcactttaccatgaaagaggaagagaatggtgacttcacaaaagtcaataaagaagaagtggaaacagtgaagtgaggggaagcctcaaggcagcaactaagaacaacctataagcacagagaataatagtggtcaggtttttaaagaccacaggacctctgggagtgactcatttggagaacatactatttctgcctttgactccacagtgaggtctgcccatacggtgttggtggtgttattttatgtaagatgtagctcagttgccaaagaagtacatgttttcctcagccctatatgacttaaagatccctctaaaactcaaattaacacataacgtgtaaatcacatatacacagtgtttagtgtcatatcataaaatgtttttgcatcaatgagttagttgttactgcttctgcagtaacatcttctgcagaaggaactgcagatatgtgagtataggagaaaataaacatatccctcacagtctgctttctttgtttaattcattcactagactgatcattctaaggaggattttgtgctgctcttgttttgctgctgggcctatcctgtttccattcccaaatcaagtattcctggaatttaaggtatcactttaccagcctgaccacaagttccccattgtttcctctgctctgctcatgacctggaataatgcctctccctggatactaaatttactgaccctgcctaggaccgagaagattgatgagtcctcaacccgtgcatgtcttcaaaaaggtaagacagaccagcaaagcagtaaaatgacagacccattgtttgagcccaacgctgggacttccccttttgtataagctgagtcacatttttcctgttgtcaacttgaagcctgttcgttgatgtacgataggactatcttgctgatatataaagtcaggcagacaggtttccttgcatttgtttgccttaccttggacccttaccaattagaaactgtccactggccaaaagagataagacatggtttattaaagctcagatactacattgaatgaaataatttctgacaattttcttctgttaaagtgccatccgaggttcctgccttgtgcaatcttactgattttgacagaggtcttttgggatgtatatgtgcattttattcttgatatctgttcagttgacacatgttttaaaaccacagatatatttgattggttggcaaattgtgaaaacaggaagtcaaataatggaatcaactgtgaaacaaccataacaagtgaagcttttctgcttaagtgccaagatgggaatactgttatgagtaacaaacaaaatgaaatgataatgtcaatataattccaacaggaagagtgagcatctggactgccctaattatcatatttccagtgctttataaccaatgaaatggtttttacattttactctccaatattgttgctaggcatgataaaaaatctccaaaattgagagagggatgtggtgacattttctagctaggaaatatttgagattttttcttttttttttttttttggtcggacaatcaccacttgcattggacttcaaaaaaataccttgctggggccaggcgcagtggctctgcctataatcccagcactttgggaggctgaggtgggtggatcccttgaggtcaggagttcgagaccagcctggtcaacatggtgaaaccccgtctctactgaaaatacaaaaattagctgcgtgtggtggcgggcgcctgtcgtcccagctacttgggaggttgagacaggaaaatcacttgaacctgggaggtggaggttgcagtgagccaagatcccgccattgcactccagcctgggtgacaagagtgaaactccatctcaaaaaaaaaaataaaaaatctactgattgcttactctagaacaggcactgttgtaaacactagggttatgaaggtcatggcaaatcaccttcttgcttataagcatttgcacattacaccgagacttttcttgtaatgcctcaaggtttccaagtaccagttctcctgtgatagtcattcttccatggtgaattttcaaaaggttatcaagcagtgtaaagaataaaaaaaatcctcaaatcaatagatatgaggaacatatgcaaatattagaataaaatgaaagagacgatttttagacaaagaccaggaaatacgatctcactagtatgtattaagtttataaaacttattacttcaaaaatttcagaaacataaacgaattttaaagacacctgaataaacttgaggcagggcagctgttagcagtataatgagggaagggtggagcatgtaccatgccacagatgggaaatcctgttcttccatcttccatcttctgagaatttctatatgaaatatgttatggaaatgatggcatgtgccatctattcagacaattgagtttttaaagtatgatcaatatttctcaaggtctgcccctgccagaaaagaatttaaaatattacaatgggacattttaatgtcatcttgttggagggagaattaatgaggacttggcacaattgattgttagttagaagattaagtcacaatgcatatattaatctatttaaccttcaaacactgttttaagagactgttttaggagaaagtacttttgagccagttgcatatttcagtcaaccttaattatattcagaaatctaaccctagaaatgtaaatttaaaggtggaagaacagaaagacaaactactctaaagctctcatcttacagatgaagcacaaacaaattaaatgaaatccagaggttacagcatttatacagcgatgaagccaagcccaaacctaggtcacctggataccaaggcttgtctcaggtctctgcatggacaaggagatgaaataaaactgcatccagaattatccaattagcctgtatctcttattgtgaaatgattccatttggatacagaatcagtcactaattgaaaaaaacactgcattgactttcaactgatgaatctgccctaagaggtgttacacttgtcattatacccatagagtattacagcactgcttaccaactctgtactaatcaaacaatcatctttattgtttcataaaggtgaaaagtaaagaaaaattcttagtgaaaaagccctcccaaagagaaatccagggaaaatagcaataataatgcaaaacattcaactatataatttccaagactttcacttcactgtgtagtcaagtaacactattattcatttcacagctatagatcaatttgctcatgtgtgaaacctaggaaatacaaccattttctcttcagatgagtaatcctggtttgagttacccatacaatttcataaaaatacattattccagatggactccagttgctgggcagatggaaatgcttaagtaaaggactaaaaacttcattatcctaaattaggtagtcagagagaaaaagtatgaatataactataacccaaataatttttaagttttatgaatatttttaaaaattctactttcaggagaaaagaacttgaaaaataattacacatatttaagtatttaaaaagtatatacttttacagtcaagtttttaatcaattagttgtagctaccataattatatttctcatagtcactttccatttttacatactgagccaacctgtccataagccaagctcaggtttatctcattccttcagttgattggacaggatttccccacaggcacaggtgcaatttctgtaagcatcactgctgtgactgtgatggttaatgtgggagtcttgtctaccttcccacatagcttacctgtgctcattgtcattgcatatgacatttctggatgtacatttctatctaatgagagactgctgctcagcccattcatatttatgctttggccagtctgacagaagttagctcataatgggcaggacaattggtgtcccatggtcaagagctccgtccctagcaggatctaatattgttccaggagcttctttggacctctaaaaacttcactgaaatgacaggtctctaaaacatcatgaggtttatctcccacactcaggcattgccacctcttactgcaaaggaatgagccacctctgtaaactttgaacattcagggatgtatacagagccaaaatcctctgggggaatctacccattatgtcttcatcccatgttttaagatcctaggttttcatccatggtctgccttggctgagcatgtaagtatctctgatgctctggaattctacttgtcaaatcctggagtctgtttttcagctgttcattattccactgcaggggaaaagagacccttcttaaatcaccagagaggttctctaactcttgcccttagcagtagtttgttaatggttctctgtttctcattatcccattgcagagcatcaatataacagtaatgcccagccaacactctgtccttgtgctccccaccgccatctctctttcaaatccttgaatcattataactgcaagggcattttccattgggatgtttcctcaagtcacccctgatgaattgttcagcgattggattttcactttgtgccagggactatctaggccccacattcctctcatgatgcagtcctccttgcctgtcgagaaatgagtgagccaggccccaagctccatcttgccacttgacttatcagaacatgtttggtttctgccatgtcaactcaggtcaacccaggaggagctaacaaaacaggattacacatgtaagatatatattgggggaaactcctgtgaaagatgaagaaggaaggggcaggagtagagagggccttcagaccacagtgaagaattggcttctgtaaaaagagaaatagaatgtttgtaatcctggtccagaccatctctaactctgtaactctcctatttccacatcttttgaccacaaagttgttagaagaactggagatcgatgtacatgggaaggcccagctcaagctctgtgcagagtgggtccttagcaactgttacgttatgtgttcactgcacagaacaggggagtaataagcagagccctgggtttccttcaaagaaatgcagtgacccttatttcatgtgtaggcaggtagatatggaggctgcccctctctgcatctacaacaagccctgtttctcattaaagtcaacgttgaacactatgttttaaataacacaaggaagaaaacaggatgcacttatctccttagacatgacctcaaaatgtattcttctttataactgttattactaactaaaatacatccttcctattctttctttggaaagaagaaaaataaggcttgtgatggaaggtaggataaagccagcacatattgagtgatgatatgtgccaggtactactttaggtactttatgaatgttttctttcttcatccttacactctttggagttagaattatccacaccttacataagaaaacaatcaaggttatagaaattaaataacttgtccatagtattgcagttaattatcagaaatgactattgactctgaaactttgtatatttcagttttgcaaaaatcttatctgtgaggtggactttaattcaagaattatagaaatgttttggttgaaataatttttttaataaaaaagaattttttcctatgttatgtatttaaaatctataatgaattttggccctatctctgttaaaaccacattgttttaaatacttagttgctcataaatctatttctcctcattataaacccttgagggagactattatatctaattcatctcatcctaaccaactaaaattaggcctaaatgtcatatgcactcaatttatgtatgctgagccaaataggataattcaaacaactcagttcatttttctgctaattctccacttactctgatacagcaaattagaatgatagagaggaaaacatatcctcttctttattccatgggacccatatcatagtggacagcctctctcaaaaaagccttaaaactcttccattttttgagaacccatagttgtttaactagcttgtcctggctgaaagatagatgtggattataagaatcaacaggaaatcctcattgcaggtacacatctcctaaatttccccactatgcagagagatggccaattattatagaagcataattactatagaagttgtagctaccataattatattctcatagtcactttccatttttacatactgagccaacctgaccataagccaagttcaggtttattccattccttcagttgattgtacaggatttccccacaggtataggtgcaatttctgtgagcatcactggccaacatggtgaaaccctgtctccactaaaagtacaaaaattagttgggcatggtggcccgtgcctgtaatcccagctactggggaggctgaggcagaagaattgcttgaacccaagaggcagaggttgcagtgagccaagattgcgccactgcactccagcctggatgacagagtggcgagactccatctaaaaaaaaaaaaaaaaaagataaaagataaatgtagagtacttgtgatttggggaaaagatcatgaaaggtaaccttacaaaacgtgacttttacagcaactttcaaagtttacgttatggtgaagagcataggctttggacacaaaccagccttagtttgaatcctgtctgtgacactgagctgtgtgaccttggacaagttacttagcctctctagtcacagtttccttgtgtgtaaaacagagataataatagtgctgtttgagaattaagaggaagacaaaatgtaaagcacttagcacatggccagcagatgataaatactcattaaacaggaatttactgtcattattattttactatgcatgcaactagctgcttcatgtgtctgagctgaatgataacaacattggaattcacaattttaatagatctttgcattcccacagcatcttttatctcagaggaccaaagttctggaaaatattaattctcgtctgttatgtttgtactagtaaaggcaggagcacatacaacggcctagttattaaaaagaactatgatataaagcgctaactccacatgcacaaagttatacataaaaccttaacagaatctaggtctctcatcttggattcctcattaattgtagcagattgtttccagtggctaaatattatttattggcagtgtaagtcaatgctgctgatatattactcttttggggagtgtttgttttttgaaaactgctctcaaattttctaaatgtgaatttaaaagtctgtcagtctatgtgccgataacacaagacagattgtaaatgtagcgggatgcagtcaagtcaaacaaatccagtgagagcgccagaagtctttattaggactgctcctgttcacaggctttgctaatgatggaacaattgtttgtgctgatttgtagctggcattgatatgccggcagcaacactttcatctaaaatccagctccaaatttttttaatactgccaatgaatttgctgtgtctgcaaagagcaactccaaagaacctttctaaataataagaaatgggaatattcaagcagtctttaattctaaatccagagtgttagttgaaatatacaatgatttttctctttgtcattgttttgtcatctactgggatgcctgcatctcaacaacttgtatgaattaataactaaacacagctttaaaatgctgaaattggcagatgttgaagggaagtaaatgctgaactgcagaaggatattccaagattccaaacttatctaacattttcttcacaaaataaaaaaatgcaaatgcgctctgactgctgttcacatttactgtggggaccagttttttttttttttttttaatcaaacagcacctgcctctctattcagagatgtctgcgtgtggggataagtgcaaacaacaaaggcttcggctgtggcagaggctgcatcattttcttggaacttgccattatgtttcaggtcagagattgaggtttggtgcagggaatggagcttttaatatcaggtgaatggatttttataagaggttgggaagctttgggtcttaaagagaaaaatggtgctttaaaaatagccacatttcttttgtactgtaattatcagtgcatgaccaatcattttttattctgtctgtgtgggcaaaaggaaatatcctctacccatctctgtgggctggccatttgaataagtcaaaatgttcccatatttaatcagtttattgagaatatataatttagctagaaaattgatcctgaaacatcacttttaagggagcatgaaaaatgatacaaattcatcaattttttaagaagtcattgtcatatgtttgctgcttaaacaggtaatgtggagtaaatcagtgattttttcacaatttctattgagaaaaggttcacattgtgtaagtgacaaaatgtctgaaataggaataatcagccttaaaaaaaatagaatggtaaaaatatgaagaaacagaacaataacttcagctgatcccagctctaacattgatggagaaagcccaggcaaatcactgaattcctctgagtttccatttctgcatctataaagtgtaaatggtaaaatgttcccttccaggactgttgtggacaggaaatgagaaaatgtttgtgacgtactttgcaaatggtaaaacattttaagagcatcaggaagaaaaggagaagtaaacgggatgataataataattacaatatgtaacaattataatgacaattataatattaaatataataattgttattaatgaaaatactaaatcctgcccagaagtgctagaaattggtaaatcctcagaccatgtcttcattatgttcttaactggaggaaaaggagacatacatactctgtaatcccacatgaaaaagtgaagtctattataactgaagtggactgcagactacattaacacctgttctttgaaagaaactcttaaattaaagttacatctttctgagagcttttttcaaaagcaagtgtaggctaacagagtatcctattcttgaaatggcttgttagggtttcagacaacctttgcccacaaaacaggggagtcacattaacttgctaaggttgcatttctctttcgttagatcagtcactcacgggttatgtagggttacatgaagtcaccaatcaatgacaagcattcattatcatatgtttgctccaaaatacaaagctttaaactgttccaggaataaaaatttttaaatagcatcctttaaaagttgcaggaattatggatagaaaactattgtacatttttgctactgaaaccaacatcccaagaaaataaaatacacttttaatagtagatgctcgaaatatacaacttcccacactcactttctgggtaataagttgtgtgctgagaaggtaaggcagttggtggttgcttatgaagaatttatgcactacagttcatctagttagagatgagagaaagatgcaactagcatatataggttgccaattcttcctcctcctctagtagttgtatattatctgcctagataagctagaaatatatttccccaaatttctttccctatagtcctgggttagtgttggccacaagaggagtttagatgaaatttgggagcggaagtgtaccaacagccattatgctcaaaagatcattgttgctcaaggcagggaggaacagacaaaacgagaaactggcagttttgtttcgttctgctcatcctgacccatgtccctagctgaatgcctgtccagccaaacaatagcaacattaggttaccagcaaaccctttgcagctgaactcagaggcactagccacaaagatcctgcaaccttcatcagacttctagcccagtactatttattattttttaatttttgtgggtacatagtaggtatatgtatttatagggtacatgagatgttttgatacaggcatgtaatgtgaaataagcacaacgtggaaaatggggtatccccctcaagcatttatcctttgcgttacaaacaatccaaattacatcctttaagttatttaaaaatatacaattactattgactatcaccctgttgtgctatcaaatagtgtttttattctttctatttttttaatccattaaccattcccacctcgcccctgcactgctctcacatccctcacccacctccaccaactatccttccctgcctctggtaaccatccttcttctctctatgtccatgagttcaattgttttgatttttagatcccacaaataagtgagaacatggaatgtttgtctttctgtgcctggattacttaacataatgatctccagttccatccatgtttttgcaaatgactggaacctagtactatttctgcttctactctagcagttggacatgcatggcttcctgcaaactctaactctttaacttgcttacccactctagacctggttgaagtcaagtccacttatcaacacaagtcatttgaaggcatttggtataaggggaaaacatgggcttcaaagtcttacaaatctatttattcatcctctttcctcttctgtctgtatgactttaacctccttaggccatatcaaccttcaaaataaatggtaagaaatcttgccttggtcctaagtgaaaaaaaaaaaattctttcattagaatcttaatcctaaattagtcttcatgtaaatttgaggctagaatgcactctacctgtataagccataaaaatcccaagctcagaattgaaagtgacccatggtggttagtgcatccgaggcacaggaaaagagaaaatacagcaacttttcaaaggagagctccttaaacccaggacacaaagtatttccaaataaatttctaagaaacatgagcttaccataaaatttttttaaatcacccagagaaactagtcaccattagcaagagtcagcagaaacaataaataagagaatctgaccttcagatctgcaatttttgtgatattatctatatttaaattttaaagaatgtatttaaatttcttaaagaagtataagagattgtcaatatttcagcagatttgataaaggaatagaacatgaagaaacagaaataataatcattgaaaactcaatggacaggataagctataggttataaatgaccaaagaaagaccttaagctttgatccagaatgcagcacaaagggacagaatatgaacaagaggttaaaggacataaagaacagagggagaagttctaatatatatgtaatcagtgctttaataggagaaaattgaggcagacagacaggtgacattccaagagataatggttgagattcttccagaagtgaaaggtagcaatccttacactcaagaaacccaactaatcacatgagctaaaatgagaaaataaaagttttatttggcaaaaaatgtaatggcaatatatttaataatatttggtttaggtaacaatatacattttttattttatttatttattttattatattattattattattattattttgagacggagttttgctcttgttgcccaggctggagtgcaatggcatgatctcagctcactgcaacctctgcctcccaggttcaaacagttctgcttcagcctcccaagtagctgggattacaggcatgcaccaccacgcccagcaaattttttgtatttttagtagagacgagttttcaccatgctggccaggctggtctcaaactctggacctcaggtgatccacctgcctcggccccccaaagtgctgggattacaggcatgagccaccatgcctagcggtagcaatgtatattaaaagatggaatgaaattttaacttctaagaagtcaccaaaaaaggacgaggcaaatgcaaatgaggcactcactcttagagatgtgcaagtgcagggctggggctctcaggaacctgacagtgagggcccgccttaaattttgcaacctgagtctctcacgtgcctcactcttgtcctgattcttagagacaaaaatctgcgtctgtgatctaatacgcagaattgtctaattaaatatacttttaaaatatagtgagctgttgtatgaaatttatgcctatctttaatctactatgttgtgatcctatttacatttggtataatgcaaccattgcaaatgtagtttgttgaatttaacaatgtaaccacctcaataaccaagatacagaacatctccatcagccaaaaaatgtcccttgtagtattttgctattacccgcccccacccctgatccttggaaaccactgacctgctttctgtcattataatttggattgacttttgcagttttatataaatggaatcatagagtatttacattttgtttttaaataataagatactaaaaatatctaaaacagcaattctctaaaaatgtcacataacagatatgggttatctttgttgcaagaagcaaaaaaacttacttatttgatatatttatggggtttttccattcacactatttttttaagtattcgagagattttagtgagcaatataaaaactgtgactcggcagggcgtgatggctcacacccgtaatcccagcactttgggaggccgaggcgggtggatcacctgaggttgggagttcgagaccagcctgaccaacatggagaaaccccacctctactaaaaatacaaaattagctgggtgtggtggcacatgcctgtaatcccagctactcgagaagctgaggcaggagaattgcttgaaccccggaggttgcggtgagccgagatcacgccattgcacaccagcctgggcaacaagagcgaaactccctctcaaaaaaaaaaaaaaaattgcaactcaatacaacaatattgcataagacaacttgaaacaaattagcagaattatcattttttacactcttagttaacttgcatttagcatcagcttttatttttatcaaaggtttcatcatggatttaagttaaattctaaagatacataaaaataaaaagaatctttcactctacagtaattaaactcaacaccagggctagaggtattcaactgaatgaccaaatcataaatacaattatcttatgtcaaatgattcctgtgcatggccactcaatacattttataagactcaaagtgttccgtgtgaaagaaagaaataatcataccatcacttaatttaaacatttttaaaacaaaaattaaatattcacttaattttctatgaccctctgttttttaatggagatgtattacctttgaagattttttttataacatgttttcataaacatgccatccaaataaagaagttttaaagcatactagaaatcaaaacagataccattgctatttttaaagaaccccctgtgacattttcacaaacctttgaggattttcaaaccacagtttgggaaggaaaaattaatgtgtgtttacaggccactcatgggtccctaattactgtgtgtcagcaaataaaatagtctcttttgttagttaccttctttgaagtctctgtattatttgatgccatttatcagaccactccttcttcctcataattttttatttcaagccaacattgtattattgctactccaacctgtctggctgatctgtctctgctccttcagaagcttccctcctttctccatggcttttcttaccactttatgctttctttcatttgcttaatcctccgtactgatcctgggcatgttgtcccaattcttcttcatcttgcaggctgcatttcctgggtcccctattagctagcttcattgaccaaaggcaaggactagagggagaaaggaagcactggcaggagacactgagggaaggataaaggatgggaagagccaggatatttctctccctccctccctctctctgctttgggtaccatgtctgatgtcttgactggagctggatgcctcaagatagcttcactcacatgtctgacaattttttctggctgttggcttgattctcctccataggaccttttgtcttttagtaggctagactgggcttcttcacagcatggtggtctaagggttttatgaggcaagactagaactgcaagacctcttacgtagaggatccagaacttacacaatgtcacatccaccacattctgttagtcaaagcaagtcacaaggccaggccttattcaaagggatagaaaaacagactttgtttattgatgagaagagcagcaataagacattacaaaagacatgaaaacaaggggatgtagttcattggaagccattattgtgacaatctacctcgctgagtcccagagttccagaaacagcacctctctcctaaacacagtgtatactattcctaatctctgggttgttccccatttgtctcttttgctcccttgtcacctgtttaaccaactccttgcattagattgcttgtggtttcctagtttgactgtaaatgtgcatctactttcttactttaacagtgataactcttaaatctggatctgagttctagatttaaaagttctagagttctgatttctagatctaaatcctattctaaatttccaaaggccttagggtatttccacgttaattttttcttcttcatctcaaacccagcatattcaaaactgaattcagaattctctcccctggacaatgactcttctcaatttatctatactctaaaccaggggccagatgactatagtaagcagccaagtccatcactgctaattttattggaacacagccaagctcattcatttttgtattgtctacgtctctttcactctacaatggcagaaccgagtagttgcaacagaaactgtgtgacctgtaaagttcaaaatacttacacatctggccctttacagaaagatttcccgacccctgttttaaagctctgatcctgtctttttcttctctatgtacaatcagagaccaaaggttatcaattcagttcacattcttcatttctaaattatttccatattcttttatctgtctctccctgcttccatcctaatctattctgcatatttcaactaaattgattgttgcaaaataccattttaattctgtcgctcatctactaacaattccacagtgacttgtttttattacaagtcactgatcattgcaaattcagcatccttcaaccaactcacctcaatttactcaacaaaatctaatttgcactttccccaagccatcttctccaatcaggtgcatcttctcttacttctcttacttgatttcagaacctctgaatgcagaaattctgtttcatcgcttatagctctagcaccaggcacagtggttggcatatggtaaacagggaatactactgattttttttctacttctgtcactttatttatatgctgcctctacttagtacattctttccttgctttcctatctatccaaccctctgtactgtctctagtctcatattttctctaaactggtctaagcttaatgatcaattttttattcaaattcctgacactaaaaatttatatcatccatctcttcactgcctcaatgcacagggagatatagaattagccacaatattgattcttgagacagtaagaacatgccatctatttatgcacaatttctaacatcctttcccatacctcacactatcctttgaggtatttcttctttgggatttgtccaaagttacaaggcttcataattattaggagccaaagtgacaatctagattctaaatttatacattctaaatttataaggctttctaggaaatttcagatgaattttatgatagaaggttttattctagaatcttgtaaattgagatatacgatatttcagatgtggcaagaagaaagagttgagagaagtatataaaaatacttattcacaggttattactcagaagagaaaaagttcacttacacagaatctaaaagttacaacctgtattttcagtgtttgtgaacaaaattctgcaacaatacagatatcccaggaaaccagctcttatgacagttgtgtgctggagcaatttcctaccagcttaaggggacagattgttaaatattcaggaattttacaaaccaagtgtcaaaccattggcaacttgaaatcacccatcatatgggtattttcatcaaaattggcaaatgcagtaaatcaaggttttttttcttaacagttttccagcacatcactgatatatctatatccatatccatatctatatatatatctatagctatatatatatagatatggatatggatatagaaacacacaaaatatgaggaagagagggacagagcacaattatagttacaagaggaataatgattgataaaaacacacattagtgtagacttttctgtattctaggccatgttctaagcacttagcatatattcaggtgtgctacagccagctagtactagcttacaaaagccaatggtgcacatctctttcccaactccatgttcagtggcctcacactggtagcttgaaatcagccgtagtgggagtatttacaccacagaaatcagtaaatactgtaaatcaggaatttttatgcagacagccagttgttaaacattcaccagcacatcactgttctttagccagacttttataagacagcatactcacttttggcctccaaaatacattattcagtacagtttgataaacaagaaacctgtgcctaagcagaggaaagggaagaaaacatatgagattacaaaaagtaagggaagactttgagtttggtacaactagtctgtgataatagaagggctaggaaataaacacattaccttccttctaccatagtagcttctgggaaaggttggcactatgttctttccatcatgctggctgtcttagcacattttgtgctactataacagaatacctaagactgggtaatttaccatgaacagaaattgattggctcacaattctggaggctgcaagtccaagattgaggttctggcattttgcaagggtcttcttgctgactcatcccatggtggagggcagaacagcaagagaagaaaagagaagggaagggagagggagagataagggaaaaaagagagagagaaagagaagggggccgaacttacccttttataataaacccacttccaagacagtaccattaatgtactcatgagggtcagagacctcattgcctagtcacgtcttaaacgtctcacctcttgacactgttacaatgacaattaaacttcaacatgagttttagaggagacaaatattcaagccatgacactggccctccccatgaaaaccagaattgcgaatagttcaatcatttgacttcagtttcttgagaaccgctgactcttttgatcagataacaaacattctttgccatcaataagtaggtgcttcctaaacccagcactttgaatttggccaagttcaaagtgcaaataaagtagaggaaaaggtgggacagagacaaggggaggagagaaccacagtaaggaaagaaattaagaatagcacctagaatgggatgagtttctagagttaagttttcactataactagggcttccttgatgttttgaaatcaaaagtgatgcctgcatttgccagtcttccttccgtccccagcaattctcagtatgtctgtgagagaaatctgggccagtgcatgcaaggacaattatgacaagcttcttctgtcatatttttgcaaaaggagaaaacttctacatgtctaggcctcagaaacaaaagttaattttcaattcaagtttacatttcctttaggggaagagctgtctagtgaattagataattttcaaaatttcctagcagaaataaaaatccaagttaaagaaggaaaatgaaaacaattacaaatggtaagttatctgccatgaacaacaactgctgggtcttgaaagtaggagagggaggtgtacggcttaattaggaagtgtcctcccagaataccaatggtctcccagctactctgcttagtttgccacagaccattgtctttcttcataaatctaaattagcatctgcagccactttcctagaaatgaagattttagctcagtgcttcattttgaacacccactggtcttgaactaaatttaaatcatgaatggagtattatttaaaggttgatgatcttcacacagcatcactttagcaatgaaactaaaaccccctgaactaaattctgctttatagccaacagtgccatggttaggttccagtttaataaaattgtcttgcttttgtaactttaaatgcctttagacattttttttcaacatgctattgtaatgtatataacattgagcatgaagtgattaaacaataaaaccttgagctaatttgcaggtgggggtggataatagagtcccatgggaagtgccatggtccttcccaaattgagggaggaaaggtagagtctcttttcatctctaacttcaaacaagaccaactcttttgtccccaaggggattttaagcctccattccaaaggaaacactgattccactgagaagattcagggtccagtgcgatcgcaaaacttaacttctttgttatgcttgtgaaagctagaagtagagtctgttagtctgttctttcactagtataaagaaaacctgagactggataatttataagaaaagaggtttaattggctcacagttctgcaggctgtacaggaagcatggctagtgaggcctcaggaaatttacaatcatggttgaaggcaaaggaggaagcaggcatgtcttcacatggccacagcaggagaaagagagatggggagaaggtgctatacacatttaaacaaacagatctcatgagaactcacttaatatcatgagaatagcaccaagggagatggtattaaaccattagaaactgcacccatgatccaatcacctcccaccaggccccacttccaacactggggattacaatttgacatgaggtttgggcagggacacagacccaaaccataacaaaggagttatgcgtggaagggtgtggttgggaaaggacaggtaatcttattgttagacagacccaaatctgcagagcccagagatggtacagaccttttatgtttcagtctataagcattggccctaaggaatagccaaggcagtttcttgttgtgctgggtcccggaaagaagctgtacatcctacagacttttcagctaaagttgggcatctagaatgtgattttttttttattatacattaagttttaggatacatgtgcacaacgtgcagttttgttacatgtatatacatgtgccatgttggtgtgctgcacccattaactcatcatttaatattaggtatatctcctaatgctatccctcccccctccccccaccccacaacaggccccggtgtgtgatgttccccttcctgtatccatgtgttcccattgttcaattcccacctatgagtgagaacatgaggtgtttggttttttgtccttgcgatagtttgctgagaatgatggtttccagcttcatccatgtccctacaaaggacatgaactcatccttttttatagctgcatagtattccatggtgtatatgtgccacattttcttaatccagtctatcattgttggacatttaggttggttccaagtctttgctattgtgaagagtgccacaataaacatacatgtgcatgtgtcttcatagcagcatgatttataatcctttgggtatatacccagtaatgggatggctgggtcaaacagtaattctagttctagatccctgaggaattgccacactgaattccacaatggttgaacgagtttacagtaccaccaacaaagtaaaagtgttcctatttctccacatcctctccagcacctgttgtttcctgacttttgaatgatcgccattctaactggtgtgagatggtatctcattgtggttttgatttgcatttccctgatgtccaatgatgatgagcatttattcatgtgtctttcagctgcataaatgtcttcttttgagaagtgtctgttcataaccttcgcccactttttgatggggttgtttgtttttttcttgtaaatttgtttgagttcattgtagattctggatattagccctttgtcagatgagtagattgcaacaattttctcccattctgtaggttgcctgttcactctgatagtagtttcttttgctgtgcagaagctctttagtttaattagatcccatttgtcaattttgacttcttttgccattgctttttgtgtttagacatgaagtccttgcccatgcctatgtcctgaatggtatttctaggttttctcctagcatttttatggttttaggtctaacatttaaatctttaatccatcttgaattaattttagtataaggtgtaatgaagggatccagtttcagctttctacatatggctagccagttttcccagcaccatttattaaatagggaatccttccccatttcttgtttttctcaggtttgtcaaagatcagatagttgtagatatgtggcattatttctgagggctctgttgtgttccattgatctatatctctgttttggtagcagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtctttggtagcttgatggggatggcattgaatctataaattaccttgggcagtatggccattttcatgatattgattcttcctacccatgagcatgaaatgttcttccatttgtttgtatcctcttttatttcattgagcagtggtttgtagttctccttgaagaggtccttcacatcccatgtaagttggactcctaggtattttattctctttgaagcaattgtgaatgggagttcactcatgatttgtctctctgtttgtctgttactggtgtacaagaaagcttgtgatttttgcacattgattttgtatcctgagactttgctgaagttgcttatcagcttaaggagattttggactgagacgatggggttttctagatatacaatcatgtcatctggaaacagggacaatttgacttcctcttttcctaattgaatacgctttatttctttcttctgcctgattccctggccagaacttccaatactatgttgaataggagtggtgagagagggcatccctgtcttgtgccagttttcaaagggaatgcttccagtttttgcccattcagtatgatattggccgtgggtttttcacaaatagctcttattattttgagatacatcccatcagtacctaatttattgagagtttttagcatgaagggctgttgaattttgtcaaaggcattttctgcatctattgagataatcatgtgatttttgtcattggttctgtttatatgctggattacatttattgatttgcatatgttgaaccagccttgcatcccagggatgaagcccatttgatcatggtggataagctttttgatgtgctgctggattcggtttgccagtattttattgaggatttttgcatcgatgttcatcagggatattggtctaaaattctctttttttgttgtttctctgccaggctttggtatcagtatgatgctggcctcataaaatgagttagggaggattccctctttttctgttgattggagtagtttcagaaggaatggtaccagctccttcttgtacctctggtagaattcggctgtgaatccgtctggtcctggactttttttggttggtaaactattaattatggcctcgatttcagagcctgtttttggtctattcagagattcaacttcttcctagtttagtcttgggagagtgtgtgtgttgaggattttatccatttcttccagattatctagtttatttgcgaagaggtgcttatagtattctctgatggtagtttgtatttctgtgggatcggtggtgatatcccctttatcattttttattgagtctatttgattcttctctcttttcttcttagtcttgctagcagtctatcaattttgttgatcttttcaaaaaaccagctcctggattcattgattttttgaagggttttttgtgtctctatttccttcagttctgctctgatcttagttatttcttgctttttgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatattgtatctttgttctcattggtttcaaagaacatctttatttctgccttcatttcgttatgtacccagtagtcattcaggagcaggttgttcagttcccatgtagttgagcagttttgagtgagtttcttaatcctgagttccagtttgattgcactgtggtcttagagacagttggttataatttctgttcttttatatttgctgaggagtgcttcacttccaactatgtggtcaattttggaataggtgtggtgtggtgctgaaaagaatgtatattctgttgatttgtagtggagagttctgtagatgtctattaggtctgcttggtgtagagctgagttcaattcctgaatatccttgttaactttctgactcgttgatctgtctaatgttgacagtgggatattaaagtctcccattattattgtgtgggaatctaagtctctttgtggagtgtgatatttttgatgtattattatgcttttgaggggtgggagagaaggaagaggacctataaaaagaaaaatcccaccctgtcaacctagggaagagtcagaattgcctagaggagttaaaggggacttaacagagcaaggttctacttcatttttgtttttcctccccacttgaaaatatagacaactcaagtctcattaatgcacaagtcaaaggtaatggtgctgaaacaagaagcaagcatctcaactcatggtagaacttgagctaagaacaatggggcagacaaacagagagtgttcacctggcaagtgtatgccaaccttccacatggtcttgagatgtgaggccaccatgggcaacttaaatgtccacttgaacaattccagcatcttccatattgggtattaacaagatcagcttttcctctaatatctgatagtatctaatattctaaaagtacggaattcatcactggacgacatggatacattctgaaaaatgcatcactgggcaattttgtcattgtgccaacctattataggaacctagatggtttagcctactacacacataggctatatggtatagcctattctcctaggctacaaacctgtacagcatgttactgtactgagtactgtaggcagttgtaacaagacggtaagtatttgtgcatctaaacatagaaaaggtacagtaaaactatagtataaaagataaatgatagtgcacctatatagggcatttaccatgagtggagcttgcaggactgaaaattgctctgggtgagtcagtgagtgagtgatgagtgaatacaaaggtctaggacgttaattactatacagttctgtagactttataaacactgaacacttaggctacactaaatttatttcaaaatttcttcaataataatcttagcttattgtaaattttttactacataaacattttaatttttccaactttttgactcttttttaataatatagcttaaaacacattatacagctatacagaaatattttttatatccttagaattgttttttactttttgaaatttttgtgttaaaaactagaacataaacacccgtattagcctaggcctacagaataatcaatatctctgttttctatctccacatcttgtaccactggaaagtcttcacaagcaataaacacacatagagctgtcaccttctatgacaagaatgtcttctctggaatacctcctaaagaacctggctggggatcttcttgaggaggtgtgactcttcagaaagatgttcatgatggtttgtttggtttgttcctggttttcattacagatttgcttggaagcagataatgcaccatgaacattcctctctataaatgaaaatctttcagtgttagggcccatgttttcaaactttttaaggagattttaagctctgcaaaagcttctgctaaaccctttgctgcgaattttcttggaggttcttctttttcttctccttcagtttccttttctcttgcctcttcttcagctgtgcatttctgttccagttccaattcattagttagttcctcaagaaccacctgcaggatctcctcgatgtcatcctcatccatatccaggttaaagttgtttgccatctcaaccacagacttgttaatttttgcaacctcatccttaacaatttctttgaaatcacaggcaaaccttttgagtgtcttcttccagatgccatgcacacactttttggtaacatcacctgaagcccaagcaaggttcttgatgcagtcataggtattgtaacccttccatcagtattttctcagtgtctagtcgcaacagcatcctgggcaaatgtcttacttaagtagtagaccttaaaagctgttataacttcttgaccccttcattgaatcaaaaaggtggtttttagaggggaaaagatcactttgatattggaataaagatcatcaataaaaggaagatgtgtgggagcattatcaacaataagcaaaatctttaaaagtgttttttccagacagtacttctccatgtcactggcatagcaattcaggaaggcatcttggaaagggaaacgggtcacccatgagttcttattgctattatagtacactggcagcatgtgcttattgatattcttaaaggccttgagttcccattgtgacaaatcacaaagagtttcaatttttaacctgctacactgcccccaagaaagactgttatcctgtccttaaaaaccttgaaacctggtattgacttggcctcttcatagatcaaagttttttcgggcatctgtttctagaataggaggtttcattcatattgaagatttgttctggcaagtaatttttctctacaatttgtttatctagagtttccaaaattttttcagcttccttcacatcaacagccacagactcacctctcactttcacattatttaatgaataacaattattgaatcatttaaactacccagaactaacagtaaattcaacatcatagtcaggtctagccatttctttcaacatcacaagctttttgttttggttgtgatcatcaagatgctgagagggatatgcttctgtgtctggtcttcaattcaggtcagtagaagtttctttctccatatctgataaatgcccttcttgaatttgtgttagttttgttgcctttaatgaaacagatgctttaacaccttccatcattttgctcttgtccttcaatatggtagccatggtccaatgggacatgcctgactgacaggcagtaaccaccactgattttccacctttgtagtccttcatcatttttaatttcatttccaggtcatttactcaatgtggcttcttactgacaccattcaccatggattttgtacacttggggccatgatgaacaaaacacaagattaagtcaaggataagagaaaatgatgcaatcaggagatgcagtaaacataagatgtatgaggctgctaatagcataacacgatatactattttacagtaataagcagaaagagtacagtctgaaataataaaaagtattgtaatacattagccagtaatatagtcatttattatcattatcaattattatgtactgtacataatggtataggctatgcttttatatggctggcaatgcagtaggtttgtttacaccagtatcaccacaaacacatgagtaatgtggcatgttagggctttatggctacaacatcactagatgataggaatttttcagctccattataatcttatgagaccactgtcttatacacagcctattgttgaccaaaacattgtcatgcaacatattactatatattgtatcaaatgttgaagaactaatgtacagcatggaatgttcaaaaatatatgaaaagtagctactatgacctcggaagctgaggagaatttcagggatgctcagacaattctggacttcagagaaatagacatcccattctgtcagaaacagaacaaaggtagatttcttgctgatatcctgaagattgttaggagaggaaaatgagaccaagaagagttatagccaggctctacaaatgtctctggcatcaacaaatcaatatacaatttgagaaacccaatgtaatatatgactaatcatcaaaaatctgtgatatttctaaatacattactgtgtgtatgtgtgtgtgtgtgtgtgtgtgtgtgtgcatgtgtttacagaaaccctgaaacagaatggagacaaaggtattactgctgctatcaatcaattaataaaaacagtatgaaaagtccattactatctgtacttcagtttcatgtgctggatagaaagaaagaaatattcatgagtcaattgctgtattttcatccatgatatcatctttgattgtcatcccaaaatagcacaaaagtgatcattataatcacaaaacaattccatagggttctttaaagtttaaaacagtttcttatgtgttatttaattgcataatagcactgtgagaaacacaggctatcagagcagaaatagcagccctatgaagaaagaggaatgatgaaaaagaaagaaaggaaggagagaaatgtgaagaggggaggaaaaaaagaaggagggagaggaaaagctgcctatccatcacttgttataattggataccaatcttaatcttaatgtctcctaacaagtcttccaagggtcaagatccacgtagttctttttactctccagtaataattgctttacaaattttaagtaatattattatcatcatcaccaatcttagctagaaagttttcttataaactcatatataaaattggggaagcttcagaataaacagagcacagtgaagcacaaagttgaggttaaaaaagcaagcaacaagcactagctttctctatagtcatcatctttctccctgatgcgctgtgtagctaagtagtaagcttacattaaaaacgggattgtagagtgagtttgcctgagaatgcctctccaagaccagcctaggaagtgcaaatccctcccattttgtcctcagttcaactcccaagattcccaacctcggtgtgtgagtcacattgcaattgcctacgatatgcatctgcacggattccttctgcttcagcagggaatttcaagctcctgcctgcctataatgaagaagaaaattagtgcgacaacgtgtccggatgctgaaaagctggcagccagcaaaacagtagtgcatttggctaattttcttttccaggctttttactgtaaagaaaattggcctccatggattaaaaatatttcaacatttgcatccctttcttgagtctgatctctttgtttccattttaatatgtcgtgggaagtttcctgtgaaaatgtaaacaagctttgtgtttattttaatcactttttcctcctgttttcgggctgtagacaaccccagcccttactcaaattctggtggttagagtagaacacaaccaagttgtaacccaagcctgtccttttgtaagaggaagtggtgggataaataaaaggaaggcatttcctaaagtagctgagagtcctattaactggctaaagaactaactcctcaatgaagaattagtcaactgaactagtttaagaaaacctttgaggtgaataattcacagctttggaacctaaatacccacccaagaaggaatctttccttttcctgttaatcctgaatattgtatctctactttgcttctggaatcaccttgaaagtgttgccatcttcagtgtttctactccctctcatctgattgattaacccactatagtctagcttctattcttactaccttactgaaatttacaaagacagatgtcaacaatgatctactttttgtataagtaatacattatgatcaatacagtaaatgtttctactacctattttactggatttctctgttgtatctgaagatgtaaaccactctcctttgagaattttgtcttcttttgttttccatggcatcatggaaacctgattccttttcaacattgcagatcatcaatccttagtcttcttcactgaattctcttccattgtcctcttaaaataggagttatattttataatctcattcattctcatcttttcaatatcacctctatataattttcccatttatatgtctagcctagacttccttcctaaatccttacatcttgatctgcacgctttgattctagcagtgctattgtgaacaattccaaaccacctcctgctgccaaaatctcacctcaagtgcttgcttctcttgtcttttcctgttgcgactcaagtccttttataatgtcatagaagcatttttgcccacttaaacaagagcagctcacaagacagaagtcagaaggtatatgtttcagactcccacctttcagatgggtaattcttggaggctttctttgtttttctcaaaagtccctcgttgcctagagcactgacctcaataaagtacccttacactggctcttcctttttccctatttcactttccctctgtgaccactcaggttttgtgagatcacttgccaaaccaactacttatggccaaatacctttttttaatagattttattttttagaccacttttagtttcacatcaaaagggagcagaagatacagagagctcccatatgtaatgcttgtcctcacatgtgcacagtctcccccattatcaacatcctgccccacagttgaacatttgttaaaatccatgaacctacattaaaacatcattgtcacccaaggcctatcgtttacactaggatttactcttggtgatgtatattattataggtttagacaaatttataatgacatctgtctaccattatagtgtcatacagagttatttcactggcctgaaaatcctctgtgctcctcgacctattcatctctacctccccataacccctggcaaccagtgatctttttactgtcttcatagttttgaatttttcagaacatcatatagttgaaatcctgtagtatataggcttttaagattggcttctttcacctcataatatgcattttaagtttccctcatgtcttttcatagcttgatagctcatttctctttggtgctgaataatatttcaatgtctacatgtaccacagtttatccactcacctactgaaggacatcttacttgcttccaagttttggtaattatgaataatcaggccacaaaaatctgcgtgccccgcatgtgtttcccccatgctgttctcgtgatagtgagggagttctcacaacagctcgtgattttaagtttgacacttccacactctttctctctctctctctctctctcctgccgccatataagaagtgccttgcttcccctttgccttctgccacgactgtaggtctcttgaggccaccccagccatgtggaactatgaatcaattaaacctcttttgtttataaattacccaatctcaggtagtttctttatagcaatgtgaaaatgaactaatgcaaataccaaggataattgctggatcatatgtatgataagagtatatttagtttttttaaaaataaaattgagacagggtctcaccatgttgcccagtctggtctcaaattcctgggttcaagtaatcctcccaccttggcctcccaaagtgctggaattacatgcatgagccacagtaccttcctggcctatttacttttataagaaactgccaaactgtcttccgaagtggctgtatcattttgcattcccaccagcaataaatgagcattcctgttgctccacattctcacaagcatttgatgttgtcagtgtttttgatttttggttattctcattgatgtgtagtgccatctcattgtcattttaatttgcatttcctgaatgaggtggattatctttttattgtttatttaccatccataggtcttatttggtgaagtgtctgttggggttttgggcccatttttcaatggtacccaagttcttattttaggcattgctttaagggaaaccaaaagataattggtaccagcaatgatcctgcaaaacagaagaatgagatcctataactagattgtttacatttagatgataccaataattgaatgactggtaataagcaggatggtgataagacctaacatgcagtaccattcaattattaagaccagcctatccagcatggtgaaaccccatctctactaaaaatgcaaaaattagtggggcatgatagtgcacccctctaatcccagctactcgggaggctaaggtgggagaactgcttgaatctgggaggcggaggctgcagtgagccgagatcacgtctctgcattccagcctgggaaacagcaagaccccacctcaaaaaaaaaacaacaacaacacacaactctcatctgtagtggatgtgacaaatacagaggaaaagaaaggtattgcgttcattgatattgggcaatagtaattataaggattatggaattcaatggccttcattaaatgccttaaatgtcttgaaaaaatatgagtatgaaataaaaataatatgtcgggttcagctatgtcctgtgaagtgcaccctgtgaagatcagaagacctcaatggatgggtaaaaagagaccttcaactcctataatcaaagggtagttctatgctgaaagtcaggtcaaatatttaaaccttgtgaagacactgaatgtgcagccttgaaaaatcttcaaagctgaagacacagccataataggggagtagtaaaatcctaaaacctgatatgggaatatctgtagattcattacaccaccatggcacatgtatacatatgtaactaacgtgcacattgtgcacatgtaccctaaaacttaaagtataataataataataataaaaaaaagaaaaaaaaagattgaaccctaagttctcctggatcctccagattggcataagcagccactgcccctgccagagaggagtccttcttacctggagatattgtccagatctcacctgaagcagatgcctagcaaggtgatgtttcttcctcaatatccactattgcctttccttctagcttccaaaccaataattaaagtcatatatcagggtacactaagtggggaaatacaatccctcttccagaaagaaatagcttattcacattttgtattaccggcttatatgttctggcagaaattggtaaaatatgtgtgggagtggattttgagggttaagctgggcagacagtatataaatctgaataagggagaggttgttgacattggagtattctttcatgactcaggatttaatgccttggcaagaacacctggatccactccaaatacagaactgggatccctctttgaaacttagtcacatttatggcccatagtaataatggtggagatgctggaactgtgttggcagagtattggagaaagatttagaagtgggagaaaaactcactctgactgtgttcttcggaagagcccagaagatacgcctttactaacaaaataaagaataaactttatgggagagtagccagttatatctttgaaaatttcaatggtagctcttctctgtaggacagggtagatagaaggaaatgatgtcatggtggaactcatttcctctctatcaatggcaatgtaaaattccaaagcatcagataggaggttgcaacacttaacagtcataggcaaggtggaaataataaccataataggcagcaaatctagaatgacaatcaggagtcaatcaagagtgaggcagatgggctgctgactacagacaaaaatcaatggctggtaaacagaagactgatctcagctgctacagtggaaaatcacaattattcatcaagcttcaagctttaagatctgatccaattctcaaaaaaagagtcattaaagaggataatgttcactgcaaggaaagatccctaaaggtccccttaaggaaggtatattgtatatactgctacagcaaatatatacagtaaacatgctccaaattcattatctgaagaaactgaccacttaccagactaagttgtgcactggggaaagaggaggactctgacctttcaaggactattagatatatccctaagccgacaaaaatacaaagagacatgctatgttgtcatacctcactacctcaattagagtggggcttttgaaggtcagatgaatcctctccaaagactatctcacaatgagtttgtatacccattctgttgttatttcccctgtgcctgagtgtacaattgggatgaatatgattagtagctaacaaacactcactcacatggttccttgagctgtccaataagaacaattgttatatgaaaggccaaggataaggctttgaagttacccttacccacttaagatagtaaatcagaataccatgctcaatgaaaatccaagcttaatgctacaatcaagatgtaaaggcacaggtattgtggtcatcatcatatcattgtctggttgacatcattacagataatagctgattaccatgaaaataccaaatgagacccacaattgcacgtctgtgtcagatgtggtatgttgactagaactgatcaacatcacttgttgatcaggcagtggcagttggtatgtagctattaatctgattaatatgttcttttcaatcctcatcaataatgaagatgaaagaaattcgcatttatgtggaaaggacagcaatgcacattcactgccttgtccccaggctatgttatttatcctgttctctgtcaaaatgtagtacaaaggaaactagatcatcttgacattctagagaaaattatgctggcctactatattgatgaaattataatgaacaggaaatggtgagtagctctgttaccattgtcaaatcatatattccaatgagtcagagataaaagctacaaagattgagaggctgctacatactttgaagatttttaggaagccaatagcctggcacatatttgaacatgttgtcgtgtactccaagaaaaaagacaagctattgcaccttgcaaccttgcaactaagaaaaagacacattcagtcgtgcaacaggtgctgtcagtgttttgcacagaacatcttattattttccatttctttgcttataggtctgacttctaattgccagcactgtaattttttgctcgaaagctccctttctgaccaccagactatggagaaggccagaaaagcccaataattaattcctcccaagattaatcctcaattagtgactaataacagttggtggatacttcctaagtactgcgtttcacaaagtctataagagttcctaagaaggattaagctctagttgccctcagtgataacttgcttgaaaatttcatctttatgagatgcaactcacatagtgctcagagaggaatttatagttgtaaacacctatacctaaaaatgaagaaagaactcaaatcaataatctgaacttcttccatatgaaactaaaataaaaaagagcaaattaaacccaaaaccagaagagggaaggaaataatgataattagaatgtaaataaataaaatagagaatagaaaagcaacacaatcaacaaaaccaaagcttggctctctgaaaagatcaataaaattgagaaatctttagctaaaaaaagagaattactgaaacagggaatgaaagaggaaacataactactgaccatagagaaataaaaagtaatctaaagaaatacagtgaacaaatgtataccaacaaattagataacttaaataaaatctacaacttcttagaaggatacaaggctgggtatatgcctggtggctcatgcctgtaatctcagtacttagggaggcaaacgtagatggatcacttgagctcaggaattcaagtccagcctaggcaacatggctgtctgtctctatacaaaatacaaaaattagccaggcatggtggtgcatgactgtcatcccaattactcaggaggctgaggtgggatgatcacttgagcctgggaggtcaaggcttcagtaagccaacatcacaccacatactccagcctaggggacagtatgagaccctgtcttaaaaaaaaaaaaaaaaaaaaaaaaaacacaaatgactgaaattgtgtcaagaaatagattgaacagacttataataagtacaaaaaaattgattagaaatggggaaacttccctccatgaacaacccggatgtaagcgtgggcaatgttgcaaaacctcatctctgaaaaaaaaaaaaaaaaatcagccaggtgtggtggcaagtgcttgtagtcccagctgcttgggaggctgaggtgggaggattacctgagccaagaaaggtcaaggctatgtgatcagggcactgcactccagtctgggtgacagagtgatactctgtctcaaaaaaaagaaaagcctagattcagatggcttcactggtgaattctaccaaatatttaaggaaaaattaacacaaatcctttacaaatcttctagtaatataaaagaaaggagcattttccatctcattctatgaggccagttttaccttaatagcaaaactagacaaagacaataaaaactataaataaagacataaaaattctctgtaaaatactagcaaaccaatactagaatcattaaaaaagattatagaccatgaacaaataagatttattccaggaatacaaggttgttttgatatccaaaaaatcaattaatgtaatatccaatattaatagaacaaaaaacaaaatcatatcatctcaacagatacagaaaatgcatttgacaaaaatctaatactctttcatgatgaaaaagaaatactcaataaactaggaatagacgggaacttcctcaatctgataaggaatatctgtgaaaaacttcatctaccattatacttcatggtaagacactaaactttttccccttaagatcaggaacaagacaaggatgccgacttttgcctcttctactgaacattgtactggaggttgcagccaaggcaattaggccagaaaaaaaaatgtatacaaattggaaaaaaagaagtaaaactacctctattttggggtaatatgattttgcatatagaaaatcataaggaaatttaaaactagcagaaataataaagtcgaagattatatggtataaggtcagtgtgcaaaatcaattgtaactgtgtacacttgcaataaatatgaaaatgaaattaagaaaacaattccacttataatagcattaaaaagaataaaatacttagaactaaatctaacagaagtgcaaaaaatgtatactgaaaagtagaaaatactgttgaaataaattgaggaagaataaataaatatcaagacatctcacgttcatagatcagaagacttagtattgttaaaaaggaagtatttcccaaatgtatctgtatactcagcaaaatatctattaaaatcccagacaactcctctgaaaaaattggatatgattcaaaaatgtatacaaaaattgaagagatccagaatagacaaaataatctgaaaacaaaagaacaaaattggagaactcatacttcccaatttcaaatataatcgtaaagctaaggtaatcaagacagtgtgttcctgatgtaagactagaaatataaataaataaaatgaaatagacattcctgaaataaactctcacatataaactcaattgattttcatcaaaagtgccaagaaacagtaatgggaaaagaacaatcttttcaacaaatggtgctgggataactgaataaccaaaaagaatccaaaaattgaatttggactcagactttttaccatatataaaaatcaagtcaaaatgaattatagacctaaatatgatagtcaaaactataaaactcttagaagaaaatttatttgagaagatcctcatgaccttgacttaggcaatgatttatttgacccaaaccaccaatgacaaaaaataataatgataaattggactttatcgaactagcaaacttttgctctttgagtgctactatcacacaaataaaaagacaactctgatggttaattttataagacacttttctagatcatggtactctgttgtttggtcaaacatcaatctggatgctgttgtgaaggtattttttagatatgattgatatttaaagcagtagactttaaggaaagcagatttatccttcataaagcaggtgggctttatccaatcaacagaagtccttaagagaaaagggtcctgggaaaatgaagaaattttgtttctagactacattcatattcaagactgcaacatcaactcctgacaaaattttcaacctgtcagcctgccctacagatttcagacttaccagcccacacaatcatatggatcattttataaaacaatctctccctcggccgggagcagtggctcacatctgtcatcccagcactttgcgaggcagaggcaggcggatcacgagctcaggagatcaagaccatcctggccaacatggtgaaaccccgtttctactaaaagtaaaaataaaaaattagctgggtgtggtggcgcgtgcctgtagtcccagctactcaggaggctgaggcaggagaatcgcttgaacctgggcgttggaggttgcagtgagccaagatcaccattgcactccagcctggcgacagagcaagactgtgtctcaaaaaaaaaaaaaaacaaaaacaaaaaaaactctccctctctgtttcaacctctctctccagatatgtgtgtatgtatgcataatgctagaagatactgcaagtttgattccaggctacagcaatagagcaaatatcacaaataaagcaaatcacatgaatattatggcagacatattccccagtatatataaaagttatgtttacattctacttcggtctattaatgagcagtaatgttatatatcaaacatgtacatactttaattttaaaatagtacttaaaagttctaacaatcatctgagccctcaggaagtcataatctttgctggggaagggtctcgactccatgttgatcactgctgactgatcaggatggtggttgctgaggattggggaggtggtggcaatttcttaaaataagacaacaatgaagtttgctgcattaatcgcctcctcctttcacaaaagattgctctgttgcatgtgatgctgtttgatagcatttccatttccctacaatagaagctctttcaaaattggagtcaactctctcaagtcctgctgctgctttatcaactaactttatgtaaaattctaagtcctttgttgtcatttcaacagtttacagcgtctccaccagaagtatattccatgtcaagcaaccactttctttgctcatctataaacaacagtccttcattcattcaagttttaccatcagattacagcaattcatccactgaagtggaatcttcagaatccactaattctagttctcttgcggcttcaaccacatctgcagttacattctccactgaagtcttcaactcctaaaagtcatccttgagagttggcatcaacttcttccaaactcctgttaatgttgctattttgacctcctcctgtaaacaacaaattttcttaatgacatctagaatggtgagctctttccagaagattttcaatttatattgtccagattcatcagaggaatcactatctatggtagctataggctaacaaaatgtttttcttaaataagacttgaaagtgaaaattactccttgatccaggggttgcagaatgaatgttgtgttaacaggcatgaaaacattattctccttgcacatctctctcagagatcttgggtgaccatgtgcattgtcaatgagccgtaatattttgaaataagcctcttgagtagtgggtttcaacagtgggctaaaaatattcagtaaactgccgggcatgttgactcatgcccaaagtgcctgtaattccagcactttgggaagccaaggcaggtggatcacctgaggtcaggagttcaagaccagcctgatcaacatggtgaaaccctgtctctactaaaaatacaaaaattagctggtcatggtggcacatcctgtaatcctagctacttgggaggctgaggcaggagaattgcttgaatctaggaggttgaggttgcagtgagccgagatcacaccattgaattccagcctgggcaacaagagtgaaactccttctaaaaggaaaaaaaaaaaaagtcagtaaaccatgcagtaaacagataggctgtcatccaggctttattgttccatttatagagcacaggcagagtagatatagcataattctaacaggccctaggattttcagaatggtaaatgagctttggcttcaacttgatgtcaccagttgcatgagcccctaactaaaaagacagcctgtcctttgaagctttgaaaccatgcgttgacttctccttcctggctatgaaagttctagatggtatcttcttccaatgtaaggctgtttcatatacactgaaaatctgttgtttagtggagtcaacttcatcaattatcttagctagatgttctggataacttgttgcaacttctacattagcacttgctgcttcaccttatacttttatgttatgaagatggcttctttcctttaacctcatgaaccaacctctgctaacttccaacttttctttcttttcaaagaaaataaacttcagatctactaaataattaaattccaaatgtaatcattgtatgtaaaaaaatgaaaccatagaatagaaggaattgctgtttaacatttatataaacctaggatagggacagcatgatgccaggaaaaggaattgtaatgaaagaaattgattgtttttaccacaaaatgcaaacttctataaaaagcaccaccagtaaatccaaaaataaattgaaaaacacttgtatcatataaccaaaggcaaaaatcttcatatataaaaagatactgtaaattaataagaacattccaaactacctcaacaaatgaaaatggctaaagataagcaagtttttttgtgtgttttttttgcttgtttgtttttgagacagagtcttgctctgtcgcccaggctggagtgcagtggtgcaatctcagctcactgcaacctccgcatcccagttcaagagattctcctgcctcagcctcccagataagcaagttttaaaagaaatacagattaaatagacattatagcattaatcataacagtgagaagctagaaacatgaaataatcaataataggcaaacaactgaaataaatgatacacatacctatacctttgaatattaagtagcagttcttcaaaatgataatagaaaaaaatgtgtttaccaaatgtacaagaaaaaacaaacctgttagaaactgggcaaaggacacaaacagacacttctcaaaagaagatattcatgtgggcaacgaacatataaaaaaaagctcaacatcactgatcattagagaaatgcaaatcgaaactgcaatgagataccatctcaggccagtcagaatggtgattattgaaaagtcaagaaacaacagatgctggtgaggttacagagaaataggaacacttttacactgttggtgggagtgtaaattagttcaaccattgtgaaagacagtgtggcaattcctcaaagacctagaggcagaaataccatttgacccagcaatcccattaccgggtacacacccaaaggaatataaataattctatcataaagatacatgtgcacatatgttcattgcaacactattcaccatagcaaaaacatagaatcaacccaaatgcccatcaatgatagactggataaagaaaatgtggtacatatacaccatggaatactatgtactcataaaaaggaacaagatcatgtcttttgcagggacatggatggaactggaaactgttatcctcagcaaactaacacaggaacagaaaaccaaacactgcatgttctcacttataagtgggagctgaatgatgagaacacatggacacattgggggaacaacacacactggggcctgtcagggaagtagagggggagggagagcaccaggaataacagctaatggatgctgggcttaattcctgggcgatggtttgatctgtgcagcaaaccaccatggtacacgtttacccatggcacagacttgcacatcctgaaaatgtaccccaaaacttaaaataaaagtggaagaaaaaaaaagattagagtttgttcaatgtgtaaaaccaattaaaaaataatctatatcttaaaaaaatgtgtttactgctagggaatgtgcattcccaacaatagcatagatgttttcattttttataaaaaattatatatattgacagaaaggaatatgaaaataatattgtctatttgaaattgtatttaaaattttcttttgactgtatttgctttttctgcaatgaattgctttcatagtaaaaaaagtcttttaaaaattagtcccagcaataaaaccatagacagataaaaaatccagcaatccctgaggtaaggtggcattttaaaaatcgaaaatatttatttggacagaaaagcaaaactttaccataattatgaatactgtaattataaagtaaatgaacacttcaatcatgtaacagttgtgatttattattaaggttttaggtctataatacatttaaaatttaatgaactttggaaagacaatatcataaaattgtcttaaaacactacattaagtcattattaacattgcagataaagatggcaaaattctttactcttaccacatcatcatataattatcacatttgttatcaaattttagtttggaagtcagtccacttatcaatatcaaattctactttgttgcacaatgtccagtttagcaattttcaactatgttgtgaaattcaagaaaaataaagttgggtctaagcagttgacaagagttctgcttgaaaacctattcttacaaaagaacttgtcaaaacatttttatctttaaaaatttttaaatgcaactattaatgtttcacttttgctctactcaattttgcctgaaaaagtttattaaaattattaaggaaataaagtgtagaaggattatagaaaatattttcaataaaaagaataatcattaacactggtaattgccactaggaaggagtatacatactgataaaaattatagaaacctgttggtggttcccataactaccactgatgttaagtcccacaacatcaaaaatgaagaaatagttccatgagctgtcaataattgtctgaaggcaatgtattattcatcagcaccagaatccctctgaagttcttccacatgttcacaattttttaccattggtcatctatcaaatactgcaactgttctgggaatatccaactaacaaaagccaaagctgggcattgacactaacggtagcttactgatgtttcccctgcaaatctcacattttctgataataaaattttgcacaaaaggtagaatgcaaaaggctgattatacatttatctaaaatcttataattacagtagtttctgaaaaaagttgtccagtagtataaattgcttctgcatcagttccacaaataagacaaggaccaaaaacatccaaacggttcacagacagggttgagaagtaaccttgtgatttcaatttggtcttttgtaggatcagtgctgagccaagaactttgagagactggtgaacattagcttggttactaatgctatgggacaaaaaagttctagctcttcctccttgttgaaagagtgatggtacatctgtggaaacatcccagtgccagaggaattcatcttcagaacaataaatggaggatctgggttggataggtgaaagtgaacttcctacattttagctctgtaagccttcagcagagatacaggcatagtaccttgtctaacattccaaatactcaacattccatcctggccaccagtagctataacatgctgtttgatgagatttctatcaacacaatggactggcactcagtcaccagtcatgacaatatctgagaaggctcatttccttgttgtgtgaaatcccacgtttttaactgtccaatcgaatttacagtaagaatctctcaggagttcgaagaaagattacagcatggagtatactactatctgcattgcctacagttcttacagcttccttgtgataagctttgaagagatttattcaaccatcatctccaacattaatgatttctgggctgttgcacacaacacctgtacatggtgccctgctacacgaaggactttctgggcctatgtggtagtgagctgtagttcacagctggttgactgaaagagtctggttattcggatgatgaaggaaaactgatacacatcctgttgatgaagcagctacaattctttcctggtcagacaactgtcaatccattatatcaccatggtgtctaatatcacacaataattgattgtctccttcaaaccctctatcagagtccaagtttccaaaatctcccatagaccgcagtgaaacataattttccccattgtcctaagagcccatagtgaacatctctgtggtcttcaagtgccccagaggactggtcaccagcaggttttgcagattttctgagacacaaacagcatacagcaggtacagcaagaagcaagcactgcttccaacttctcttctgcagcttcctcacctctctcagtctttgtagaattgaagagagttagggtcttgctctggattaggctttggcttaagggaatgttgtggctggcttggtcttctatccagaccaactacaactttctccacatcagcattaaggctgtctcctttttttcattatttttcatgtgttcactgaagcagcacttttaatttccttcaagaacttttcctttgcattcacaatttggctaactctttggcacagtggcctagctctcagcctatcattgtttttgaccttcctctctcagcaaatttaattatttctagcttttaatttgaaaagagaggcgtgcaactcttcctttcacttgaacacttagaggccattgtacggctatttcaatattattgtgtttcagggaatagggaggcctgaggagagtgagggagatgggggaatgggtggttagtggagcaatcagaacatacacaacctttgttgattaagtttgccatcttttatgggtatggttcatatagaccccaaaaattacaatgctatcatcaaagatcacttatcatagattactataacagatataataataataataataaagttttaaatattgtgagaattaccaaaatgtgacacagagacacaaagggagcatattgctgttggaaaaatggcattaatagaattgcttgcggcagggttgccacacaacttcaccttgtgaaaaatgaaagctctgttcagtataataaagcaaagcacaataaatggaggtatgcctgtgtgtgtgtgtgtgtgtgtgtcctattggttttctttctctggaagacactaatataacaacctaaataatagaagaaaatatttgtaaattattaaaggtgacttttatctagaatatatttttaaagtcttacaactcagtgataaaaagacatcctaatttttaaaatttttttaatatactttaagttctagggtacacgtgcacaatgtgcaggtttgttacataagtatacatgtgccatgttggtttgctgcacccatcaactcgtcatttacaataggtatttctcctaatgctatccctctcccagccccccacctcctgacaggccccggtgtatgatgttccccgccctgtgtccaagtgttctcattgttcagttcccacctgagtgagaacacgtggtgtttgttttctgtccttgtgatagtttgctgagaatgattgttctagcttcatccatgtccctacaaaggacatgaactcattcttttttaaggctgcatagtattctatggtgtatctgtgccacattttcttgatccagtctatcattgatggacatttgggttggttgcaagtctttgctattgtgaatagtgccgcaataaacatatgtgtgcatgaagacatactaattttttaaatgagcaaagggttaaatatacctttctccacagaatatatatgaactgccaataaggacatgaaaagtacattattagtagtaattaggaaaatgcaaagcaaaaccacaatataacacttcacattaactaggatgactaaattcaagaagacagcaataacaaatattggcgagaatgtggagaaattgtaacactcatatatgttgatgtgaatgtaaaatgatgcgaccattttggcaaatagtttggcagatgactgtttactcttaaatatggagttattatatgatccagccattccattccttggtatgtacccatgagaagtgaagacatgtccacataaaaattggtacataaatgtttatagtagcattatttgtattagccaaaaactggaaacaaccaaaatgtccatcaactaatgaatcgataactaatacatggtatatccatacaatagaacatggtttgaaaattaaaaggtgaaagaagttactgtctgctgctaatgtttccactacagatacaagaaaaagtctcttcacactttctgtctgtctgattgtagcagcctgagattgaatagaggaatacaggagggaaaacccagaaagagaatttttacggctcaggaataatcttgtaaacactaaagagcctgttttactacaaagaaaatcctaaaatttggtttacatgagaagtgttgggaaatagctcctcctatcctaacctagctggttacatttgtaagaacttaaaggctaaagctaattaaaagcaagccaataataaaaagaaaaggaagaacataaaaaggaatgaaattccaatacatcttacaacttgaataaaacttgaaagcattatgtgaagtgaaagaagtcagtaacaaaaaaacaaatattgcatgattccattcatatgagatgtccataatagtcaaatctatagagacagagagttgattagtggttactaacaactgggttggacagtgaagagagaagtgtaaggaagggtgaatgactggtaataggtatcaagtttctttttggggtgatgaaaatgttctaaagttacataatagtgacctcattccatcttacttgccatctatcttcataaatagccctgcttgtgtttttgccagtttcctccctccccagcttctactttgatctttctattcctcttgtttcttctagtcttgcatcataatccaagctccaagcacaaaaacaaattatctgttcccaacctctttgaatcagaagcattagcaattatatgaaccatcatttgccttgggtccaccaaaccagccccaattcctgtggccaaatctgcggatacagttatttggagtttggaatttataccttcacaactctatggttaggttctgtgaattgcagagagtctaatcaactcatgatgtagctaaaaatataccatccaagaactgagttacaagtccctgttatctttcagtctgacttactggagactctgaaggagggaaaccagaggaacagcagcttttacatccaggaagatggtgctcatgacaacagccatccatacatagttgtccagaaagcatgttgccagtgtgagctaaaatttctttcctaaatacccaaaatggcacatctatccttcatttgccctggtagaagagcttacgtaaccagagaaatggttctagtttcctgtttcagaactttggaaaaagcttcttagaaaatatgaggaacaaggacttattttctgtcttagtatgctgttctatgggatgatagatgtaatctgtgtttcttaatccttgttcccacttttgatgccaaacaaagtaacaatggttgacactgaatgtggacttttgaggctgtctgactcctcctaagaggctgactctacctcttcctctttatttgctggttattttaatatgactatagaatctgttctaactagataatgaataagagagcggaaggaacaaggacataaatttgcaaaaactaaaaaaatatgaagtgcacaaggaaattgattgaagccaccaatgccagggaataaatcctatgctacttcaccatcagtgtgccagcagggtattgatttctggatgcacgatggggaaattagtgccggctccagtacggttgtgcagcagtaacagctcaaggagtatctggggagaccttaatgactaagagagctttgggaactttctctgggaattttaaaaataaaagtagtataattcttcattaaattataagtagttgaaatatctgcttttggaaaagccataaatataaaaaagtctcatttgatccagaaaaaggtcccaggattgagatataattcctcagaagtcagccaagagtgaggagaacaagctttgtacttttaaataaactatctcccatgggccctaaatggacacagcatctgcagtccccaaaaatgtacatacttgatagagaacaatatattacatatatttcataaatgcatagaaagttttagaaacaattagattaaaaacagactgtgttccaaaatgcctttgtatgtcagtcaattggaattagaaaactttttccccactaaatccatagttcatgttcccaggtgaatcctagaaattctacttaaaccatatgcagttgaaaatgtggactaagtcccaagtcctttgggttctaagccactgtgacctctgagggtagggaccagaaaaagagaagctttcacagtagcccaggaatatggttcctatggcagcagacatagatagatagatagatagatagatagatagatagatagataaacaggttaatgaatggatgcacagcaaagtatacatgctatccaaatcccaacatgacatgttgaacctaaattttttctattttattttttaaaaaattaacgtaatgcaattttaaataaaattgctgcatattcagagtttcctttttccatttcaatgcttattttcctttataaaactaaaatgcagatcttttatccagtagcacttttatctgtggcccaaggaccccaccaataatttaacacatatcatcctttaaacgtaaaaacagctgggtgcagtggctcatgcctataattccaacattttgggaggccaagatgggaggattgcttgagccccgcagttcaagaccagcctgggcaacaaaaatgttgcctgtctctaccaaaagttttaagaaattaaccaggcatggtggcacacacctgtggtctcagccacttgagaggctgaggaggtcgaggctacagtgaaacagatttgcaccactgcactccaacctgggcaacagtgtgaccctgtctcaaatgataataataataattagccttagcctaccttttccttacaaaggtttttactgctgtctcttttatcacctttcccttgaaagttcctgacaacttgaaaccacttatttgcatgtagtgaactgcttaatacttgtgttagggtatatcacagacctctgcctcagaaaagaaagtcacatttttatgctcttcaacaataaatcctctaagcaaaaatgtggcattgccttacatgtttagattcatacataagattccctacataatttgtggtataatggacatgggatataagattctggaattttatgcagcatctagaagacccaaaaggaatgtttaggatttctctttcctatcattctcatctttctttctctgtccaagtctttcccccagaacacttgctcagccaggcattcttcctgagttgccctcttacacttcattttgcaagcaggacatgttattgagataaggctttggctgacttacattccggccaaactgtaatcacctgccgtgtaggctgcttcccaaaacagtaggggaaattttattggagatgccagtcatttttgtacaatagccaccccaacatgttagtgaccatttcattctccatattgtcagaaaaatctgtgtatttgtgtcaaacttaattcaaggtgcaccttaagtcctcagtacctcgccagtctcaggaggccctttatgcctctttccatcttgaggtaatcttcatttttagcctacacaaagctgagaaagagacaaatagggggacaattttgtgaaagtcagcccaaatcttccaattttttaagtatcattttctacttgccataaattcaatagagggtcactcactatggtgttatacattattcaccaagtatattatattacaattcttccttttagaagtttctgaaacagtcaggacttagatcatcacctgaaaatttaatcccttgttaggtcaaccctgattgataattcagatcatatgtcatacacgtggccaaaatttccattttctattttctacttagttatggactatagtatagttatatctagccttaatgaccttttgaaaaaaattcctttgtagcaatagccatatagacattgttagtactttaatgaaaatgatgaccaaattcatcataaatgaggcatgcagagtttaatttagtgctattttccatttttcttttttgtatttttttttagagatgtggtctcattatgttgcccaggctggtctctaactcctgggctcaagcaatcctcccacctcagtctcctaaagtgctgggattctgggcatgaggaaccatgtttagccttttctatttttaaaagaagagtgttcgttggttgaaaatatctggcccctccgccccatccgggagggaggtgggggggtcagccccccgcccggccagcagccccgtccgggagggaggtggggggatcagccccccgcctggccagccgcccagtccgggaggtgaggggcgcctctgcccggccgcccctactgggaagtgaggacccctctgcccggccagccgccccgtccgggagggaggtgggggggtcagccccccgcccggccggccgccctatccaggaggtgaggggcgcctctgcccggccgcccctactgggaagtggggagcccctctgcctggccagccgccccgtccgagagggtgggggggggggtcagccccccgcccggccagccgccccatccgggaggtgaggggcgcttctgcccggccgcccctactgggaagtggggagcccctctgcccggccacgaccccgtctgggaggtgtgcccagcggctcattggggatgggccatgatgacaatggcggttttgtggaatggaaaggcgggaagggtggggaagaaattgagaaatcggatggttgccgggtctgtgtggatggaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggtgcgagatgtgctttgttaaacagatgcttgaaggcagcatgctcgttaagagtcatcaccactccctaatctcaagtacccagggacacaaacgctgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaataaaaaatttaaaaaaaaaaaaaaaagaaagaaactgtattcagaatagccccaaactggaagcaacccaagtgtccatcaacaggatgaaaatgactaaacacattatggtatatccacacaatgggatactgtgtatctataaaaaggcataaactaccaaaaaaaaaaaaaaaaaaaaaaaaaaaaagaaaatatctggcccctagcagatattagtaacttagttctgtatagagaaaaatgatttcataatcatagacgatataaactatggacaaccatcttgccaattcacattggcaagaagaaacaatgtgatcaaccaatgtaactgtgaataaaatttctggggaagtctcaccagaagtggcaatcctattagaatggaagatatggcacctttgtgatttggggaaattttcaatatgaggcaaagttagtttgggatgtctatttgcatttattgactgggtaacaataaataaaacattcaaacccatttgtgcctcagtttccatatttgtgaaagaaaaagaatggcctttgtgtttgaagctcttaaaatcaagagagacagtgtatcacagtggttaggtacacagccctgtgcattctgattcttcctgttactaaatgaccttagaaaagttactcaaactctttgtgcctccagttttgcgtttgtaaaaaggaatgataatatatcaacttttagggatattgtgaagattaaattaatgaatgcatgtaaaatgcttagaacaatgtcaggtacaaagcaataattcaatgtatgttaggtctgcagcaacagtcatcaaagcaagactatctttttaaaccagatgctataccttaattctttgttcttaattctttgttgtcacatatttccaagtgctttccaatgagttcttctatatctctgaatattatttccaggaaaatattaaattgaaacacagtgagagcaaagaatatatgctgaactgaaaatcaggatatgggatcacttgaattttccccaccaattgtgacattagtaacttgggctctcggtttcctcatctgaaaaataatggaagtaaattaattatgtctaaagccccttcagctttaacattctttcaaataagactgtatttggtcttattatcctgaaataattggaatgacattttacaatagccattctcaatatgcatatttgcttaggtatgttaagctctttttttttcttttaaacctcaaattcaaggtttgtgtcaactaaaatagacaaaatcttatgaatgttgaaccaggaatgtgacaaaatgcatttttccaccatagagtcaaagttagcataatatactttatctaaatgaacacattttagtaaaagtaaagttctgatttagggcaacttggaaaatgagaatttcagttaagacctgcctaaaggaaaggaagctgaggaaatgagcgagagaacgagtataattcttaaaggagaatttaagttacactttggaaaatacttgtaaaaacagagttgtctttgcagggagcacatcatcttgaggggaggtgctacaaagttagaaaaaagacaaataacaccaagcaaattacagtttttaaaaatagtattatctcaaggaaacagatgagagcctacagggaaggggaaaagttagtaagaaaagaaaataataaaaaatataaaacaaaaagttgtcccaaaaaactgatgaaagagaaaaataaggaaatagcacggagatatgagaggaaaaagacataaaagaatgacatacatggagtcatagtgtcaaaaatacattgatctgacagtcagaaagacagcttccatattccaaaaaataaggtgggggtggaggtgggttggcataaggaagagcctagaatgttcaaaaatatgaaagacaaaaaagctaggaaactgttctgattaaaggtgactaaagataatacataacccttgatagaatcctagattgtaaaaaaaaaaaaaaaaaaaaaaaaaagacatggagacaatcagggacatttggatatggatggattatatattaaataatagtattatgttaatgataaatagtctgagtggcaatggtattgtagttatatgtatacatacatatatatagtatgtaggttatatatatatgtcttattataggagatagagatatatgctgtggtatttaggggtaagatgtctgcaacttactctcagccttttcagggggaaaaaacgtagtataaggaaaaggagacaaagtaaatatggcaaaatgttgacaattcatgaatgtagagggagaatctacaatgttcattgtcctattcttgtaatctgcctgtaggattgcagttttcaaaataaaaagtttctcaaaattaaaaataacataaaatcttgcaataaataaattccaaagctgtttaaaaaaagcaaaaaaaattatgtagcataagctaccttgctcaacccttgtccatcatccttctccactacaacttcatcaaagagagagtgtgtaaaaccaaattattactaattattgattagttctgcaaataagaaccctgaattctttagaggttagtgctcttcttatcattagaaccacaacagttctctactgccagtctggacagaagcagttactttgtggtatctattgggtaacattgagaggaagaaatgggaacctctaaatgcaaattaagcctgtggttaaaaaaaattaattaaataaaaaaataagctaacgcaggagaactttttttgtctcactaagatagttgtgtaatatcttgagtggacaagcaaggaggggtaatttaacagatatagcaatgtgtcttgtgtgttaggcatatatggtggagaatagactggttttggtagtctatctctaaaaagagaagtataggtaactgaatgtgttttaattatttgaaagatttacttctctaacaatctaaaaactgaaaacctttaaaaggaaccctacctaaaagaggaggattttttcttaatgaggaagcattctatcattacattcagtttaaaattacaatgaacaactctggcaaatatgaaaagggatgatgctcctatacattggtggtttcagcataaattggtacaatattcctggtaaataatttggcaacaggtttcaagagtcacaaaaatattcttatcttttgatcactttttatcttaagaaaataaagaaaacaaaagagaagagtaagagaaagggaaagggaggtgagaggaatgaagaaagggggatggagggagagaaggagggcaggcaagctgtgtatagatggtcatttcagaatatttatagtttaaaaaagagaaaggaagaaagatgttcagcaataatgacatgtttatataatgcacatcaatataagcacgtataatatctttcaagccttaagactgaacaggaagaaaaatgctaacatagcgatgagtggagtatatataattaaaaatggcatccatttgatgattcatctatgtaaagtcatgtaagcataaggagaaggtaatttgtttgattatgaacaggatggagtgaggtttatcctttttttttttttttttttttgagacagtcttactctgtcgcctgggctggagtgcagtggcgtgatcttggctctctgcaacctccacctcctgggttcaagcaattctcctgcctccatctcccaagtagctgggattacagacacccaccactacgcctagctaattttttatatttataatagagaaggggtttcaccatgttagccaggctggtctcgaactcctgacctcatgattcgcccgcctcagtctcacaaagtgctgggattacaggcatgagccacctcgcccagccggtttatccttttaaagtccccattgctattgttacaagagtagagtttagttaattgctttctatttatgacagggcatggagtgcagcaaagtctaccaaactgaatacagttttggagtgtcgacaaaatatgaatttcctcttcacttctgcagactatccatatgaaattatatttaatctgtataactaactcctcagtctattctgctgtaataaagcatcttttcaagaaatgaaaataatatctacatgattagaaaagctgtttatgccaatttgatgaagcatgtattttaggtttgcacctatatagtgtggttttggaactggcaacacttctatttccatctgtcatttaaagcaagcttggtttagaagagccacatagtgtgctaaaggttagaacaaagactctagagctaggtcaatctgggtttgaatcccttacatgccttctagttgagtatccttggacaaatttcttaatatctctctgcacttccattttctcatctgtaaagtgggtagaaaacttatgcctactttatagggatatcatgaagattaaatgagttgatgcatatgaagttcttaatacagtacctggcatgcagtgatgttagctgatcatcagggattattggttctctttaacccactgcttttatacaatgaacagttagttctaagggtgatcaaattaaagcacatcttttaatattgtggggcttgggtctatatttagactcatttccagaatagtctcatggccagaatttagacgcagccagaatagtcaatggctaatattttttgaggacatcttcagtgccatagttctatcatcacatattatataacaatgtaatattagtgttgtggggatattttttcaggaaaattatgtaaatttatgtccagatatattactttttgaatttcatagaacatatatgattgaagggaagctgaagagtaaattttggttttcttgaaaccactactgaaaagagttcacctccataatgcctcttgctatattcctattattcaaggtctatctagactgccccagaagattttcagacattttaggtaatctacacttcttggtttttctagagaagtcagtcggggaatcatgggaattaatctaaacttcttacaggaattattctaattttctaatccaggaaggtgagaatggaccaggaaaacttcttagtaataagcagaaagaatttggtgctaagaaagaagttaagtacacagattgcattctgtttttatttaccaagcagtcctgaacatttgtaatgcacaaagctgtatacaggcacagtatagaaacaagttgcaccatctttgctctcaagtagcttatacttcacatgacaaaaagatatgcatgcacaaatatatagcaaacgaggaaatgcatataaaatatcgtcctatcaaagcatgattttgaataagctttaaatcctaaaagattcattccagcaagtattaatagtattttggttctcattagttctaccaataacttgggtcttgaactttcaacacttcattaactgaaagaagaggctggggtaatcactgttgcaatagcatgactgctatttttttttctcttgcagccaccaactgatagctacaaaactgcacttcctagagacatgttgagagaggttcaaggctcaacagaacttacccttttgctgtcagaggtacaattagatgtttgatgtagctcccaggttaattacaaagtgagcattacattagattaataaatgctgaggttgatgcccttgcaatgagggaagacagtaccgaataattcagctcacattttctggtcggcacttatcaatgttagttatttggcaggtcagcctgacctgggttatgtcacaaaaagccacatggggcagctgtggaagcaaatcagtgatcctagctcaagggttgtacaaagcattttgtgcacatttaacaagttcaagtaccattcaatacttgatggtacttgaaccatccaatacatgctggtttttccctgggattaaaagtaaatatgtttttccactttttaattggccaaatattttattgaaacatttaattgaaagtaatctccaaaagtatttccaagttccaggaatttgaacagtatgctgatagaataaaggaggctattactgtaaaacttctttcagtatatataacctatatccacagtacatcagaaagcaactctgcttgagcatataaaaagtgatgtctaagtaggaaaaaatttggcactaggccaggtgtggtggctcacacctgtaattccagcacgttgggaggcagaggcgggtggatcacttgaagtcaggagttcgagaccagcctggccaacatggtgaaacctcgtctctacgaagataacccaaaaattaaccaggtgtggtagtgagaacctgtaattccagctactcaggaggctgagacatgagaatcgcttgaacctgggaggcagagtttgcattaagccgagatcatgccactacactccagcctaggcgacagagcaagactgtctttaaaatttttttttaattggcactttattttattataacaatagaaatgacagtacaaaagttcatcttttctaaatagaacaatgactagcatattgtaaggtcttgataaatattccttgaataaatctttggctagcctgagaaagtagaattcatttggcatttatacctaatattaatttcctgatgatttacacaaatattttagggtcaagttttgaaaccccaataacctaattccttactattccacagtgtggtccacagacaagcaccaatatcacctgggagcttgtgagatctgcaaaatctcaggcctaattaatcagacctgctgaatcagaatttgcacattaaagtttgataaaatctctttcaaaactggtgaaataaggccgggcacagtggctcatgcctgtaatcccagcactttgggaagccgaggtgggtggatcacttgagatcaggagttcgagaccagcctgaccaacatggtgaaaccctgcctctactaaatacaaaaaattagccgggtgtggtggcgggtgcctgtactcccagctactcgggaggctgaggcaggagaattgcttgaacctgggaggcagaggttgcagtgagccaagatcgctccattgcactccagcctgggcaacaagagcaaaactctgtctcaaaaataaataaataaataataaaacaggcgaaatagtcctaaagttaagatcaaagccctctttaaatagagaaacacaagggaagtagatcttaaaatatggtaatggaaccagaaaggatgtttggaaagtgcaaaatattacttgcatatgtgatgtggcagatacatactgtcaaatgttcatacccaagtaattattgtgactttgagtgagttcctcaacctctcttgcagttatttgtaaaagaaaaaaggcaagttcgaaaacttctagttctaatgtgactttcctcttgtcttcaagtgctttgggtcttatttcccacaaattaacagaagcatccctttcaccctacgtcataccagtttggccactgtgtgtgcctcttgtcctaatttttacctagccctcaccctacactactctgccacacacctgagacatatgctataggcattctggatatacttttagcccattaaatgtgaaaacagcatttattctggaaagctctcttcatttcagataaatcagaaagacatttactcatatatattatacgtatatcacctgattaattgggcaaaataaaatgaataacccttttaatatccccttttcaacacatattcccttctgttatacttcttactatcgttggggaaacaggagagatgtcttcttttttctctgctctgtaaaaatttttaaagaaatctttcataaagatctcttttgtattttttagtttgatatatttgttctactaacttaataaggtattttaatggagattccatagaaaaataattgctagcagagttttaaagacagtttaagtacttatatccctagagtagaggaatattgtatgacatgatttaagaaaaccattgctaatgaacatagtcatcagcagattttgacttaaggggcactgaaaaatcctctaatcttatcttctcttccaaaatatactatctgctgggaccttctatttgcatagtatgaagacaaagaactactaagccatatggcttcaagataatcctgatgtggtaacttaaaagatgtcatcaaagtcttgccacacctctcatcaggaggtgaaatctatttccactccccttgaatctagactggccctgtcacagactttgacaaatagattgtggcaaaagtgattatggaacttctaagagtaggccttcagagatctatatgctttctccctcttggaatgctctctattggaagtgagcaaccatgcaagaaataacaactaccctgagtccaccatgcagggaggaagcctgagctaacctcatggagagagagagtgtgtgaaggagtacagaagggccatacctgtgagtaaaactttctcggaacttccatttcagctccaccaccagataagcacaactgagcgaatgacaccaaccagtgccaagagaagcaggactacccaactacactttgcctaaattcctgattcacagaattataagcaaataaaatgattgtttaaagca

SEQ ID NO: 102 - DNA, 312920 bp, Homo sapiens
tttccttattactagcatggaggggtgggactagaagacttctagtttcctcccagctcaatgaaagcaaagaatgctttcttcttaagttttattagtgtttctcagtatttctttaaccttccgtggatgaactgcctgatacactggaagtgcacaaatagatttaaaagtttcacttatgaggtaggtaattaggttttatccagttgcttacagcatgctaggtattgaggggaaagttaactagttttatcagcccctggtttgagtaagtagtagtcagtgttttgaggagttgggactagaagaaagaaaggagatttgttaaaaaataaaggtgggctgctgtgtacctaagcaaggacatcaaccttcagttatcaaacaataataattcacagaatggttttcagaaaatctaaacatagcaattaaaaatttcaagctgagatttgaagaaatctggaagtttatccttctgtctcaggaagattttatatttctgttttagcatttgaaactccagctcctgccgaatgcttctggtttcagagagctcacaatattataagtccaactgttttgtttccagtgttgatacactttacatgggtactgtgttttccagagagtggaaaagcactttgattatatacaatactcatgtgtgtatgatgggaaaagatagtcactctattttcttttttaggggaagattaacattcaactaaaggatactctgaatgatcattctacttgtgcatctgacaggttagaaacagactgcgagattacaatatattactactaattatttctcatattttcaaccttgatatgagctattttatgataagcccttgtctccaggaacctggaagtttcaagagctctaaaacaatcattcatagcagacttctttaccgtgaggctattcctgtgttcatgttaagatcacatcattctgaggaacatggctcaaaagaattaatttcaagaataagtaacattgtctaacattctggccgtagaagtgttttctcttcctatatcatgttttccacttgcgaggaaaatttttaatgaaaaacactttggcagcaaaaagaacaaagctggaggcattgtactacttgccttcaaaatagtatagtaatcaaaacagcatgatactggcataaaaacagacacataaaccaatggaacagagtagagagcccagaaataaatccacatatatatggccgtttgatttttgacaaagatgccaagaaaacacagtgggaaaaggtcagtctcttcaatagatagtgttgacaaaactgtgtatctacgtgcagaataaaaatggtcccttttctcaccatatacaaaagtcaactcaaaatggattaaagatttagatgtaagatatgaacatgtaataatactagcagaaaacataggggaaaactctatgacattggcctgggtaatgatttttttaatatgacccaaaagcataggcaaggaaagcaataatagacaaatgggattataccaaactaaaaagcttctgcatagctaaggaaacaacagagggaagagacaatcagtgaaataggagaaaatatttgcaagtaatacattttataagggattaatatccagaatatgtaagaaactcaacacaaaaagcattaaaaaattgcctaaaaacaaataacctaattaataagtagaggacctaaacagacacttctcaagagaagacatacagatggccaaaaggtatatgaaaaatgttcagtatcacttatcatcagggaaatgcaaattaaaaccacaatgagatatcacctcacacctgctagagtggctattaccaaaaagacaaaagatagttgttggtgaagatatggagagaaaggaaactttgtacattgttggtgggaaagtaaattagtatagccattatggaaaacagtatggaggttcctcaaagtttaaaaataggggaggaggtttaaaatggctgactagaaggatttcatgcctgcctcctctacttagaagaaccagaatagtgcatagacggtcataatttgaatatactatccaagagagaatgctggcatgcaacagggaaaggacagaaaacatgaaaagcaggaaagaggaaggaaaagtggcagcctgcctggctggcattggctgggagccagaagtgacttcacaacctggggaatgggtgagtgagagattttcagtggcctacatccccaccatggaatcgtgcagttctggccatgggagaaccccttgacccacccaaatcctgggactaacatacggagcttctggaagatgatgggacagaactgcttcagggagggagctcgcactgggtcccataccctttctgagacccaagctgctacatttaagactccatttccaaacctagcaaactgcatgctctcctggggctcagtggtaccaggactgaggaattatggaaacttgggctgttactgctgggacaggagagcaagctgagagccctcctgcagtcagccagggctaagaagcaagtgaggcatgagctgcagtggccaatttcagcaagcaagtgatgctgggatctgagatggagatgcaagtggggtgcaagctgctgctagaacttagtcacaagctgggtgggtgctcctgcagccaaagtggggtatgagctaggtgtgccaactactgccaccaaggcatgggggacaagccctgctgggtctggggtgtgaaaggaatgtgggttccctacttgccagaccagtctgtgggcattaaggatggctttacactctccaaggataagacctaagcacggctgctatgtatggcccttcacccaagcactctgcctcggacctgagggttgccgtgtcttaaccaactgcagctggtagctgttctcacagctggcgggcttaagcacaagaccacttggcccagctttgctcctcctcaaagacagagcacatagatcttcaaatcaaatcaattcaccacgacaggcacctgagcactcctcctgggagcctgagtttgggcctaacctcctggctgctaacatctcagctggcactttcctgcaagtgataactgtgggcttggagactggcccacccagcccatcaccaccaccatcagtgtcaacacatacaacttgggatctagagaattgtctcaccactgcaactgttgttgcccatgccatgccagcctcccaggcataagaacccacctgcccatcccatccactgctgccatttccagtatctgagcatgccattaggggtccaagaatcagcttgccagtaactaccagcataggtgccaacttatgctgccctggggcataaagataggcatgctcagcttattgctgccaccaattggggctgaagactgaagtacccagcatcctagttctcagcacaacttcaccacagcctccaataataaccatacctaacctaccaaggaaacaacatatatcaacaaggctgtttccagctaaagaaatcatatagagactactgagtacaccaaaatcaaagcttgagtatctgagcccttccctaaaagaggatattgaaaaataagaaaaagtaacagttacactagatgtgcagaaatcaatgttaaagacacagaaaacatgaaaaagcaagaaaatgcgatgccccaaaggaacaataattctttagcaatacatcttaatcaaaaagtagttttggaaatcaagacaaagaatacaaatgattgattttaaagaagctcagtgagatacaagagaattctgaaaaacaatacaaaaaacaaccaggaaaaaaatcaggatatgaatgagaaatttaccaaagagatgaaaacccacaaaagtataaaacttactagtaaagcaattattcagaggatgaaaagaaagcactcaaatggtaccactgcagaattctatcaaatgacaataagagaaaaaggaacaaagaatatataaaacaaccagaaaatcattaacaatatgacatgaacaaagcctcatataccaattataaccttgaacataaattatccacttaagatatagaatggctgaatggacaaaaaattctaattttatgttgtttacaaaaaaattcaccagtaaaggcatatatatttggcgagtaaatggacgggaaaaggtatttcatgtaaatagaagtgagcaggagtagctatacttacaccagataaaacatactttaagtcaaaaacaataaaagataaagaagatcattatataataaagggatcaattcagcaagagggtataataatactaaatatatatgcaccccaccctggaacaacctgattcataaggcaaatattactagatttaaagagagttagattgtaatacagtagtaggagacttcaacacccatctgtcaacactagacagatcattgaaacaggaaattaagaaacattggatttaaactgaacttcaaaccaaatgggtctaatgtataacaaatattctattcaacaactatagaaataccttcttcacatcagcacatggaacattcttcaggatagatcacatataagactataaaacaagtctccacaaacacaaaaatttaaattatatcaagtattttttcagattacaatggaataaaactagaaatcaataccaagaggaactttggaaattatacaaatacatggaaattagcaaacatgctcctaagtgaacttgggtcaatgaagaaattaagatggaaataaaaaagttccttgcaacaaatgaaagtggaaacacaacatatcaaaacccatgggggggattgttccaagatggccgaagaggaacagccccagtctaaagctcccactgtgagtgatgtagaagacaggtgatttctgcatttccaactgaggtactgggttcatctcattgggactggttggacagtgggtgcagcccacagagtgtgagctgaagcagggtggggcatcacctcacccgggaagtgcaagggttcagggaattccctttcctagccaagggaagctgtgacagacagtacctggaaaatcaggacactcccaccctaatactgttcttttccaacactcttagcaaacggtacaccaggagattatatcctgtgcctggctcggtgggtcccacacccatggagccttgctcactgctagcacagcagtctgagatccaactgcaaggtgacagtgaggctaggggaggggcgtccaccattgctgaggcttgactaggtaaacaaagcagctgggaacaaggcctgcatgcccctgtagactccacctctgagggcagggcctagctgaacaaaaggcagtaaaaacttctacagacttaaacgtccctgtctgacagctttgaagagagcattggttctcccagcatggagtttgagatctgagaatggacacactgcctcctcaagtagtccctgacccttgagtaacctcactgggagacaactcccagtaggggccaactgacccctcatacagccagatgcccctctgagacaaagcttccagaggaaggatcaggcatcaacatttgctgttctgcaatatttgctgttctgcagcctccgctggtgatacccaggcaaacagggtctggagtggacgtccagcaaactccaacagacctgcagctgagggtcctgattgttagaaggaaaactaacagaaaggaatagcatcaacatcaacaaaaaggacatccacaccaaaaccccatctgtaggtcaccaacatcaaagaccaaaggtagataaaaccacaaagatggggagaaaccagagaagaaaagctgaaaattctaaaaaccagagtacctcttctcctccaaaggattgcagctccttgccagcaacggaacaaagttggatggagaatgactttgatgggttgacagaagtaggcttcagaagatcggtaataacaaacttctctgagctaaaggaggatgtttgaacccatcgtaaggaagctaaaaaccttggaaaaagattggacgaatggctaactagaataaacagcgtagaaaagaccttaaatgacctgatggaactgaaaaccatggcatgagaactatgtgacatgtgcacaagctccagtagctgatttgatcaagtggaagaaagggtatcagtgattgaagatcaaatgaatgaaatgaagcaagaagagaagtttagagaaaaaagagtaaaaagaaatgaacaaagcctccaagaaatatgggactatgtgaaaagaccaaatctatgttagattggtgtacctgaaagtgatggggagaatggaaccaagttggaaaacactcttcaggatattatccaggagaacatccccaacctagtaaggcctagagcttgcccagagcttaaagtataataaaataataataataaaaaaaacaacaaacaaaataaactaaaacccatgggatacagcaaaaacagtgctaagagggaaattcatagcaataaaggcctacatcaaaaagattagcaattaacaacctaacaatgtacttcaagctactagaaaatcaagaacaaatcaaactccaaattagcagaagaaataataaaaatcagaggagttctaaatgaaatagacttaaaaaatgcaaaggatcaacaaaacaaaaaattggttctttaaaaaggtaaacaaaattgattaataaatacctatactaaccaagaagagaggagacccaaaaattaaatcagagaagaaaaaggagacattacaaccaatactatagaaattaaaaaaaaaatcaacagataattatgaacaattatatgctaacaaactggaaaacctagaggaaatagatacattcctggaaacatagaatctaccaagactgaataagaaagaaatagaaaaatgagtagcaatattgaatcagtaataaaaagtctcccaacaaagaaaagcccaggaccagatggagtcacagctaaattctaccaaatttacacagaataactaataccaatcctgaaattattccaaaaatattgaaaatgagggaattctttataactcattccatgagaccagcattatctgataaccaaagccagacgaagatacacagaaaaaaaaaaaacccaaaataaaaaaaaagcccactaccaaccaatattcctaatgaacctagatgcaaaaatcttcatcaaaatgctagcaaacaaaatccaacagcatataaaaaagataatatgccatggtcaagtggaatttataccagggatgcaaggatggttcaacatatgcaaatcaaaaaatgtgataaaacagaatgaaacaaatactgtatgatcatctcaacagaggcagagcatttgataaaatttaacatcttttcatgtaaaacctctcaacaaactggaaggaactttactccaaatgaaaaaggccacgtacaacacatcttccactaacataacactgaatgagaaaaaggcgaaagcctttcctcttagaactggaacaagataaggatgcatactttaaccactcctattcaacatggtactggaagttttaggctgagcaatcagttaaggaaaagaaccaaaaggtatcaaaatggaaaaagagaaagtcaaattctccctctttgctgataatatgatcatatatctagaaaaatctaaagaccaccaaaaaactttcagatttgataaatgagtttagtgagcttgcaagatacaaaattaatatataaaaaacagtagaatttctatgcacaagtggtgatctagttaagaaaggtatcaagaaaacaatttcatttaagacagctacaaaaaataaaatacctagtataaatttaaccaaggaggtaaaactttctacaagaaaaactacaaaaatcactattagaagaagttgaaatatacatcaacaaacgggaaaacatcttatgtttgtggatctgaggaatcaatattgttaaaataaccatattgccaaaagcaatctacagattcaatgctattccaatcaaactagacatgttattcttcacaacattgaaaaaacaatcctaaaattcttatgaaaccacaataaagcccacatagccaaagcaatcctaagcaataagaatgaagttggaggtatcacattatctgacttcaaaatatgttgcaagactatagtaaccaaaaacatatgctactggtataaaaatagacatatagaccaatggaacagaatagaacacccagaaataaacccacatatttacagccaattgatctttgacaaagcctacgagaacttatgttggggaaaagcaccctcttcaataaatggtgttgggaaaatttaatacttacatgccaaaagatgaaactgtacacctgtctctcaccatatacaaaagtacaactcaaaatggattaaagccttaaatataagaccccaaactaaaaaaaatgctagaagataacctggggaaaacactcctggacattggtctaggcaaaaaatttaagtcctcaaaagcacagataacaccaccaaaaatagacaaatgggactatgttaaactcctctgcctagcaaaggaaaacaatcagcagagtgaagagccaacctgttgtatgggagaaaatatttccaaactattcacgtgatagacaactaatacccagaatgtggaaggagctcaaacaacaggatttaaaacaaatactccaaataaaaaggcaaaagtcattaatacaaatttcttaaaataagacacacaaatggccaataggtttatgaaaacatgctgaacatcatgaatcatcaaagaaatgcaaatcaaatccacaatgagatattatcttatgccaatcagaatggctattatgaaaaagtcaaaatttaacacatgtttgcaaagatacaaagaaaaggtaactcttatatactgtgagaatataaactagtacagctgcaatgaaaaacagtatgcagatttcccaaaaactaaaaatagaactactgttcaattcagtaattctactactgagtatttacctaaagaaaaagaaatcagtacatgaaagagatacctgcactgaatctttcttgcagcactattcacaatagcaaagagatgaaaccaacctaaatgtccattagtggatgaatggctacagaaaatgtggtatatatatatacacacatgtatatatatatatatatatatatatatatatatatatatatgtatatatatatgtgtgtatatatatacatatatacacatatatatacatatatatacatatatacacatatatatacatatatacatatatacgtatatatatacatatatatacatatatatacatatatatacgtatatatatacgtatatatatacatatatacgtatatatgtgtatatatatgtatatatgtatatatatgtgtatatatatgtatatatatgtatatatatacgtgtgtatatatatatgtatatatatatacgtgtgtgtatatatatatgtatatatatatacgtgtgtgtgtatatatatatatatatatatatatatatataaaatggcatacttttcagccataaaagaataaaatcatgttatttgaggcaacatggatggaactggaggttattatgttaagtgatataagccaggcacaaaaagacaaacagtgcatttctcatatttttgtgggacctaaaaaatctgatcacatggatgtagagagtcgaaagatagataacagagactgggagatatggaaatggggaggtgtaaggatgaggagaagtgagttgaagggtacaaacatatagtaagagaaggaataaatgtagcatttgatggcacggtaggatgactatacttaacaaaaatatatactgtacttgggtgatgcacaccttaaataccctgacttgatcactatacattttgtccatgtaacaaacttctaacatacccctatacattcgcacaagtaaaaaaaaattaaaatagaactaccgtatgatccagtaatcctactactggctatatatccaaaggaaatacaatcagcatgtggaagagatatctgcgctcccatgttcactgcagcattgttcacaatagccaatatatggaagcaacctaagtgttaatcaatagatgaatgaattaagataatgtggtatatttacacaatggagtattattcagccttaaaaaacaaaattttgtcaagattttgtcaaaactcacctgatagacgactaatagccttaaaaaaggaaatttttgtcaaaattttaaattttatttgcaacaagtggatgaacctagaggacattatgttaagtgaaataagcaaggcacaggaagacaaatatcatatggtttcagttatattaaaatctaaaaacgttgaattcatagcaatagagagtaggatggtagttaccaggctggggcagggagtggggctggggagatattggtaaaaggaaagaaaatttcaggagtaaattcaagagatctattgtacaacatggtgactctaattaataaaaatgtgttatattcttgaaaattgctaagaggatacattttaagtgttctcaccacaaataagtatgtgaggtgatgtatatgtttattagctcaatttggcctttccaaaatgaaatatgaaatatacatatttcaaggtatcatgtcatgcatgataaatgtatacaacatttatttctcaactaaagagtaaatctgaaaaaaagaatacttcaggagaaaaagaatcttgtcacaagttcagagttataattctttttaaggtatttagtgcttgctcaacatgaaaacaaattaacgacataggattttgttttattttctgtttatgaggacagcagcaaaagagtggatgccacttattgggcagccactgagcactgggaattttggcattattcatccatgtagacttccaacaagtccacagaattgtgattcttgtttttcagatgacgaaactaggacacagagaggttaagcttcctgcccaaggtcatgtagctaataagagctggcctccctctctacaaaggttatatatcttttcttatactacatgggattttaaagaagtactatttttccattttaaaatgatttttcaatggcttaacaaaaaatatgctttcaagctattattagaaatgacctatggaatttatttagcatgcaattagaataagccacaaaatacatccattcgtgatttgaaaagcagtggttaggtttggagtagtaatttaggttctagtaggatcacctcttcagtattggaagggccttttaatcccctcatcaaattttcaagtgtaaggattccctttgccacatccactaggagaactacttgagctcatatagtgatagatatgcactactttaggtagaactttccatttttgaacagcttgaatgattggtaattctacacatttatgtattctttgccgttggcatattactcagctttttaacacattttgtttcattcatgaatgcttctgtttattttgagtccatgactgtcctatttactttcactcataggagcaatgaagatttttttctatacgaatatggtacatggggaagagtttttgggttaatgtttctaatttaatattatgtattatctttttgctgtttgttttggtgaacatatttcttgcagatttgacaataatgagtatttgcttttcttttttatgaagtcccttctataagatcgagctttgctaatgcagctctgtatttgcactgcacccttaaaaccagcatcttggaaggcaagaatatttctgacccataggaatagcttgccatcttagcaacagcagatctgtttgtgaatagataattacaaaatgaaaccttggcaaacaagaatgttcctttagttttaggaatggaaattttgacttttgatttacttattaattccaatatggaaaaacacaaaaaggaattttatgttacataccttcaattgcacttcttgtgctctttagatacatgtggcctgaagttttgatgattggaaaaaacaagcattgctgttttttttccttccaatttggaaaggtatcatatatttttaacttgagaccccttagtataaataaaatgcatccttgctttttaccacattcttcattctaatatataaggtgctagtgtgcagaagggaatatgaaatcaggtatgattccaaaaatgcatatgcaagacacatggataaaatcataaaattacactagaaccaattctaactcctacatgactagaatctatggaacatggttatgtgtctcctggttaagtatcaaccaccctctggatgtagttttagtgaagtttatatccctataattgttgtttgataggtagattttaccttttgtggataagtatgctctgtgatcagaattaaaggtgtgttcatcattacttttatctgatttttcactttgtcaaagaagattagaatagcatgtggaacttgattcaactgtgatattttgatatattaagaaatatatatttgggttttatccctagtttctggcatagaacttctaaaagccttggaatttccctagtgatgggagtaagagtagtttcttattcataataagctcctgtcacatacctgagtttatgctaataagacgacctgtggtgggtccctagatagcttcaggatgggagctggttgccagacgaaacaaccatatgattaaagggttggaactttgagcccagcccctgacccctggagagaggagaaaggctggagattgaattaatcacaaatggttaataactcagtcaatctcatgtattcataggggaatctcatgtattcataggggaatctccataaaactcctaaacaatggtatttaaggagattctggcttagagctgttcaagtaaattattgagcctgaggagggggtcatggaaactcttgatttatagtccattgaacagaactataggagactcaggacttgcattggtatctgaagtgagggtagtcttgtgggactgagtagggtctgtattaactctggttagttagtgctaaaaataaatggaatcattggatacccagttggtgtctggagagttagagaattagttgttggtatgggaaaaacaaaacaaaacaaaactatgcatttgatgtcagaaatatgggtagaaacagaccatggtatcaataatactgatttcttccaagaatcatccccttaaagggtttacaaatggataaaattgatattttcctaattattctcatttagagatattgtttcaaactcacagatattcatttcctctttaagataaattagcaatgagtgaactctttctcagttttctagctcttcctctaataatcatcttcactccaaaatggtagctagtggcctgtctatgagatacatttttaaaaatatgattggatttaaaatacattgcctattttatgtgctggatttatgtaataaccaccatttattgagtgctatagactggtcactgcgttttaatcttcaattctgagttaagtagcattatccccattttgcaactgaaaagactgatgattggagtggttaagtaacctgcctagtgtcattagtaagtaagagggattttctgaagaggtggaagtgaatattgatgggaaagggaaaggtgatcaggcagatgctatggtctgaacgtatctcccaagatttgtatgttgaaacttaacttgccatggtggagcccttagggatgggatgagtgcctttataaaagaggtaccagggaactgtcaccctcactttttgctcttctgccttaggtgaggacatggcaagaaggacctcaccagacaccaaatgccaacaccataattttggacttcccaacttctagaactgtagaaaatactgcccagtctcacgtattttgttaaagaaacacaaacagactgagacaacaaatgagtagaagttagtgtgaagggcagtaagaagaactggccatatttagtctgaggtatattgagttgagaacatgttacttatcttcagttaactaaattttggggcttatagttcttcttgcgtaattccaaagggaagaaaaatggtgagtgtatttttgcttgcatataatgatatagaggaaaatatacttctaggaagcagaattctatactcattttcaccccatccataagatgcccacatataagttttccgaagaaggacttattaattgtaattgtcataagatgactggataggatcatcgcagacaactttttctctaaaagtgtttaaatagacgccagactaattgcaaataatgttatagaaaatattagatttagaggtttggataaatagaccttagattctatgaaagtaaggatatagagcgtgttttaaaacaataatagttaaaaaaaaaatggtttctgagctgggtgccgtggctcacccttgtaatcccaacactttgggaggctgagacaggtggatcacaaagtcaggagttcgagacaagcctggccaacatggtgaaaccctgtctctactaaaaatacaaaaattagctgggcatggtggcatgcacctgtagtaccagctactagagaggctgaggcaggagaatcacttgaacccgggaggtgaaggttgcagtgagctgagatcatgccactgaacaccagcctgagtgacagagtgagactccatctcaaaaaaaaaaaagtttctgtatttatgtcctataaaatcttactgtgctatctataactttctaagtaatatccatttttttccgatgtgtaccaaacctttgtgaagcagtggaatgtttatgaagcagtatgataagcagctctccaggctgacatagctaatggttatttattgtaaatatacaattgtattgtacaaaacatatagccagtcagaataatcaaacctcttttttattccttgtcccatttttgtctcctaaattatctaagagttccggctaaagaagactttcagtggtgcattattcagggaactatctaggccatactttcagtaagaagttgaaaacaaaagaagttgataacaaacttattttcttctgttgtgggtttttagtacatattgatcacactataatatgagatttgaagttctttcaaatgttttcacgtcccaaggcatttgtgagaataaacttttttaatagtctctttttaaaatcagaaaaaggctagtaatgaagtgcaatcagaaggatgtttgtattctttctttaaacccacatgactttatgtcactggctacctgtagaatgacaccagcctcttagcacatttgcaagtgattaaacaacaaggctgattcaaaagacactcataaaattctgaccatttacagccatgcatatctgctggatggataacaaaccaacaaactttataagcgactatccaaattggatctcttttgttatttttagaacaagtgttaaccaagtatttcttttgaaatgttgaagcatttccttagtttaatttttacacattgaatttctgattggctttgaaagaagtctatataatgaggaaggcaattctcaaaatagtcagaagctatcttgaggagacttgatggaaacaagttaccaagtttgacctaaaactggagcataagtgttaaactgccccccaaatatactggaggacagaatgctcagggagatgctagaaggataaataaagaaaacagaaaaaaatggatggctgtggcctcatttttctactctgacagacaagcttaagtctgctaattgaggaaagttggacaagggaagatgatgttagggagagaacactaattttgtgtcttgttgggaaagacacaatctttgattatacattcttcacctttctaaatgctgtgccttctgatttgatgttttggaacctcttactaagcagtgagactgagtttttgagcacttgaagacattttcctgcttctgataaccagtgaacaaatacggtaatcaaacaatagacacatagacatgtactcagtaaggtaaagagcttggtaccttggtactatgggtcaatataatggatcacgataagacagaatgtttcatattaaggagaatatatagcctcagaggagatggaatatgtgtgcaccagagtttctctgtgtcctaatgtaattttttaccacataggtcatggctgattactctactaaattggtaacaaaataataggtttcattggggttttatcttaaaatgtgacatctgaaagtataaaatatttatgaaagttaggcagtatttataagtttgtggaattcttagaaaaaagaataaataaaatatgaagtccctttttctattaaattatattatgtcattttgatgtattttcacatttgacttttgtaacatgaaaaattttataaataaaaatacttgacagttctatcaaactaagggtagagtgcatatttcaattaagtatgactgcaagactacaatctcttaaataacactacaaccaaaactccacggtaattctaaagacaactaatctaagtcctaggtggaaatagacagacacttgaatatgtcttaaaaatgcaattttataaaggtggattaaatatgccaaagattttccagcattacaacaaaagggccatttaggcagctttataatcttatgtgtggatgttcatgtttattcctcgaattcttattaaccttgtaaataaatattcatattgtgcctaccgtcttgcagcaaaggacaagagaagacatgattgtggtctctggacactacaagtcttttatactttttatatcccacaaaaagtatccatcagccattatcatgctgtatttgtatattgagttcacaaaagatacagcttagccaaaatgtactctattttaggcctgtctagttgtctaaagcattgtgtttctctaggaaggtatgtcacttatttaagaactttatcctgttgggagcatcaagatattaattatccttattgcttctactcctcttatactatttttatcaaacatttggattgatagctatcatatcagtccaactgaactgctgcaagtagcagaaaatattcaatatggtagcatttgcaggagattattcttagagaatttggggtatggaatttatttatactaattttcatcggaacatatagttctttagatattgtttaattttagttatgtacccctcaaacacacacacaaaacaaagcaaatactcatacaacatacataggaaagctaaatccaggttttctttgaataatgaacaggttataaatcaaataaacagtcttcccattatgcactttggataacaaaatagtaatgatgaggtaaactcttaatgaatgatgaatatatgggcagttcctattatgtatacatatatcagatgaatttatcgatcccaggagacagtttttatttttttaataaaataagttttaatgtaataaattattatttattgaaaagttatgtgccaggcaccacacaaatgatgcacatgaattaactcatcatcataactttgagaaaataatggtatgtactatttttaaaatatatattatattataaaattgacatttggaaagggaatcatttagattagctcagagaaggagaatcagagtgatagagactcgtggacttattacaggggttagaccttacccatttatgggagccagtaaaacagtccgtgtaaggctgttgcttttgtatttgatgttgggcctgctgtcagcagagaaggcaataagataggaaagatggacataaagtggtgattggcaaggacagacttgactttgaggacacactggagaccatggggacagactggaatcaatatctgtctgccctgaacctctgtgatgcaggtaatctgcagtagaagcaggcatccttcactacatagctgcatgtgcacctaactcaggtttgacttgctgaagtaggagcctgatgacttggagacctggctgctgtcctgcaccaaaagatgaaccagcaggtcagtaacagtgttcatgggctgcagcagtatttgccctgtatcaaagtttacagcataaaagtgactaccactttgattctgcattcaaatcttgtaaaaatttccccttaactgacactaatctagaccataccaggggaagaattcttggaaacacattttcagtttagataaatagacaccctatatctctatagaaaggttaagcaacttagctagatcacacatttaataagccatagggccagtgtagtgcatagtcaggttgaatacatgggatgagtggaagcatcaaatgtcctaatgtcttgaggatgggttgtttggggcttggaaatgaatttctaggatatcctacaaagattccagaagtgtggtatcacacatctgagatgggaagtgaggaatgtgccagaaaccactgtgctagaagacatgaactcttactgcttattaattgtgcaaagtgaaataatttattcatttcttaactaaatacattgaaaaactatgtgtcaggcactgcaataagtatcagaaataaaattgtaaacaaaaaagacaaataaataaataaacaagccgtagggccaggattcacacccagttctgcctaacaccaaagtcttagatatcattaaccacagttcaaggggcctattgccttttactttgcaggtcaagagaatatattcaataagtaattcagcaaatatttgagaacttttttagtgttgaacactgtgggtaaacacaaagaacaaaaagacacagacccttgctttccagagcttattttaagagaaaatttggaagagctagaaaatagaagtggaaaaagggagtcagcagaaagctgatcagagaaaaacaagatcagagggcgggaagagagggtgcagatataaaggaaaagctttgtcctggttgtggtgggtgcacaatggttaactctatgctatccttgctcacaaggaactttctgtctaggtgagtggcttatactttagaggggaagaaggagcattaatgattggtcccatctgggattcttctcttagaaattgacccgtgttcctctgtggcagtcttactataaattatgagttcttacagtgttttcttctaaagatggagtcttagtctattagagctgctgtaacaaaaatgtcataaattgtatagattataaataacagaatcttatttctcatgtcctggaggctgggaagggcaagatcaaagtattggtagattggtgtctggtgagtgccaatttccacgttcatagaaggcaccgtctcactgtatcctcccatggtggaaaaggagctagctagctttccgaggtcccatcaataaaggcattcatcccattcatgaggactttgcccccatgacctaattacctcccaaaggccccacctcctaatgcccccatgacctaattacctcccaaaggccccacctcctaatgtcatcaccttggggattaggattttgccatacaaattttgtggggagacaaacattcagaccatatcagagccctcaagcctagaacacacacactgatgcagttcttagggaggtcagtacttcatatatcccagcattttctgtgaaaataataaatcatggtctctggagtaaatcctttctaaagtgttacaactatgtaggagtctcagtgttcacattattattcagcagaaacaccaaacgaatgtataataaatgtagcacttattcagtttacatatatgtattagaaataagcctgttttaaaaaattataatcaaaatgtagtttgaccttatttaaatattttctatctttttacttatatattaacagatattttccattttaatttccagtgctctggggtatatgatgaatgtccaatatagcacaaagcagtaaatttctctttattgttgttatttattgttgagacatgcttcattaaacagtccctgtcttgttactgaaacaacttagtatggttttgcacaactaatggttttcatcagcattcatcattgaattgttttccaccgaagaaattgggttggtgttttaaatgttgtctatgttagaatgggcaattatattaccaaaaaggtagatgggtaagttttaggaagaagctaatttaaatcagtcaataaaatggtctctgtagagagttgcatgatacttatagaaatctactgcttatgcttttatttaggaggttaaatacctattattttctctgcaacttgtcaatcagaaagaaatacaacattagttttggcttgcaatgattagaatgggcatttttttcttttgtgaaggaaagtgtaatgagctaagatccaggagtattatagtctagctgagttatctatgaccctccacagcctcatcaataaaatgacagaagggctgacatcttttctctaaatttccttcaaattctgatgctttatagttatgaaactatttatttttaccacaaaatatccctttcatatgttaaaaaggaatgaagacacacagagaattagcttaccaaaaagcattaggagggagtctcctataatggaaggagaacccagctgggaatgtgaagactagagttccagttttagctctgtcaatagctagctttgtgacctattcagtcttccataaagttattttcagttctaagattctgtgggctcaaccatgaagtaaaattcagcgtaaaggcatataactctacctgatattattaggaaataaactttggacgtaggaagatgtagggaaccttgggtgtgatgaattttgtttttttccttagcatctaccttgttaggtaggtgttaaaaactacatacatagctttctagattacttttgacatgactttgttgaggtttgaacaggtgtaggatcattaccctgaccccgtaaatcctctctgagtttggaactggttgagaaattgtcaagagtcagatagttcaggattaaatgatcagctattaacattggatttgtgtgtgagcttagatgcttcctaagtagtggaaaattgaattgtttctgtttttccttaagcttatgctttgggataatccatcagaacaacgtaaagaaggccaacttagatcgttactgcctcatctctactgaaccctagtagaggagacagggggataaggtgctccaagaaggaagtttgagccttgacccacgtatatttactacattaagtttaggatctagaagagaaggccagcggcaatgagagaagaggggaattcactacaaacaattgggatttgtggtctggaagaagtgtggatctgaatacagacctctgtaaagatattgttagttcaccctttcttggaggcctcaaaatatttgtcaccagggcctgttgccctcataaaagacccctattctctacatatcttagtgactataaaggggctgagccatacttccagtgtcttgttttaatctccccaattacctgtgtctctcctcctcatttaaaaaacacagaagatatgtgaggactctagaggaagtgttattccagaagccccttcttggaaacatgatactaggacattggcagttttccctaacagactttcttatctttctgcttgtggcagcaaatatttattagaaatacattttttcctattaacattaaagctgaatatactcaaggcaagctgatgtccataaacaattatgcatcagttagccagaaattttttttctgactcttgggtgttaatctggggaaaacatattaattcttgtttaaggattctatagaagtgttctggtcttctaaaaggtccttgtaagaatgagttagtataaggtttgctcatgaagctcaaagggctgtttagaaatcttcagatcatagtgagatttgtttctctgggggaactaacctaatacactgctaatcactgttgccctagtttctcctttacaaaagttttggactgtcatatttggttttatattagatcatgctagattagctttcttgcatgtagaagaaatcctgggagctttgatgatgatggcaaaaatacagatgccttggtgtagcaattgtgtaaatatggtgtagcctagagaaaaaggacagctctcatcctcccaaatgtccctttacctgtctttgtgaatatactttataaataatctccctcattctccttctatatacatcagaaaagataggattagaattgtgtcagagctgggcaagaatactaagggatgttggtgactagaagaccaggaagacaatgaaatagaaaggtatctagaaatctaaaggctagaaataaggtaaaatctaaaataaaactaggatttgtgctagcaaagcagagctgaccacgaattcaattaccaaaatctgtggctgttactttttgacgacactgaaaatctacacaagtagtcttgcagtgcatcaattaaatgcaaagaaaaaccgtaaagctaagtgctattccagatgtgtggaggatggagaagacaaagccctgtttttattacaatcttgagctggcttgcctgggttagaatcttggcttctcatgttatcttggataaattgtttaaagtattatatctgtgttttagtttcatcatctctaaaatgaggttaaaaatagtacctactcttctaagaatgtatattttggctggggtatggtaaagttagtgcagccgcaagagaaaacaagaacaaagcttagaaaggaatttattctactcacagggcccaatgaggtagtcaccacacaccatgcaggaccacagggggaaagcaccagtgtcagtcaagagccagaagacaggaacaaggggcaagtctaggccagagcctttcttgaggtttctgtgcgaaaaggaaggcagagcagagtaaacagtttaggattggccagtttgaatgattccagaggactttgggctataagggtgatctctagttgcctggtaactgggaagatttagggcaagggaaatattggtttgttgtgtgagagttagataaggagtttggggctgtagattcaggattggttggtttgtacgtgagagctgtgctctcagctaagaccttcgccgactctcagaattagccagctctagggaagatagtctctttctgggtctgtaaggccaccagattctagagcatcaagaactatagaaattaagaaaatgtagtttaataaagctggccctgttttgaatggatgcctcacagacgaatacagaatccaagaaatcacagcatacctaccttattgtgaggtttaatgatttaacacatacatagttgaatgacccagactggttgcatgtccccagtctaactgcatgagaggttggggcatagagaggagcacatagaatacttgaggaacacggctatctgtgctgtgcagatggggctcagaacaactatgctttgtagagcatataggagagtttggaaggccattgggatactttaaacaattggctgtggtgagtgctatattgcacagaataattaagttgaaacaatatatatatctacatgattttcaagcagctaattttataaaatgtgcttgtaagtatatagagcatcaaatggactaaaagttatatacagaattttaaacatttttactggtttgattggccttttgttgatatccaggatgaaaaacagggcacaaaagaaaatgcactaataagggatgttttattttacatcacaatagagatcagtagttactttggttgagacatgttggagacagccatgctgtctgtaggagggtaatgtgagcctttaggaagccatggatgtgacactatgaaggacaaattttgccatcgctgccaccacgcctgtgaaactgggttaaatggtggtggtggggaatggatgggttttggcctggaatctataagacctgagtatggatctgtctttgccacttcttaactatgtgactttgagccattccctatgtaagatggagacaacaatgatttgccaacctggtggtagggtttcaggagatgtttatgaaagtatttccagagagagctcatttccactctcctagttctgtttctatcataatggctgccccacaggtatcccaaatttcatataaacttcactaggaaagtagatatttcactcttgcaattcttatgttgtttcattgtatatgtaaatggataaaagtttaggctttgcattgtctgactttacttctctaagagttagtttactcatccttaaaatgatgatgataatagcatcaacctaatgggtagttacgataattaaatgcagttacacaagtaggacactcagttcctgacacataacaatcactcaataaatggttgctgttattagtttcatttcattacacatgaaggactttgatctacacttctgagatttagatgcaaaataatctatgactcattagcagaatcagtgagaaaataagcagaatgagtgactaatgttaagcagaaactattggtcaaaggaactgctatgaaaggacaaatgaatcttctatatcttcagcaagcctctactatagttcagggtgtttcatagagaaactataccactaataaaaagctattgacgttttgtaattctaaaaaaaaaatgccaccaaattccttacatatcttgattcacaatgaacttttattgttacattggcaacttaaagtaaaaataaaagagctattgtttcacttagatggaaattatttaagaaaaaaatactctgatgactgttcagttatataactaacaagcatctattcattgggcactgaagtaggtatctcaggagataaaatgtcaataataactaatatttgccatgaaaaaatgtattcaaagcaatgagaccaggctggtactgagagccccaaaacgttaattcttccttattcctcctgaggaaattttaagtgatttggagggataagacatatgaaaaataaggcttaatacaagaaacagttaaaagaaaacaaaaacaaaccctatcacttgagtagagcctgtagggaatggcataggatttccacggttcatcctcaagaaaagcttctaggggtggtgggattttaatgttcctgggagcagtagaaattgtgagataatgcctggtaattaccataaacttgaagccaaatagctgggaaaacatgttccaggacattgcagatcaaatcatatttctataaaaagaatctgctggatgttcagctgacagaatatcaaccataaaaggatagtttaatggatttcaatcattatctaaacacaaaatcacagagccaagtttatgtgcattgttaatcatatgctgtgaatccggtaaaagaaaatgtaatacaagcatcagatgagatgttttttcttttctgatttttaaatggtaacattttatttttgagaaccattaaaaaagagtgattgcttggagcagccatctaagggaagtccattctctttgtaaggaaacaaaatggtgctccagtggaagagctctggaaacagtgagtggttcatagagctactgaattccttgcttttgctaatactcaaattttaaaagaaaacatgtcccaatccaaggattcttgtgatatatttgtgttggtgtgtgtgtgtgtgtgtgtgtgtgtgtgtgtgtctaaattttaaatttatattttaaaccagcagtcacttttcccattttaaattatacaatcacttagttgtttcctgaactattttaaatcaacaagttttctttgaaaatatttttttaaaaaatagatcttgcagacttaagaaaataagagtattccttaaggtagatggtgtaaaataaataaaatcagtagatttctaacacgttcttgaatagaaaacacaaacggaaattatcccatttacatttataactaagcaacatttaatatctagaaatagtcttaagaaatgtaaaatgaacaagatatgtaaaattataacattttatatgataataaaagatttgagaacattacaaaacatttgattaagtggggagacacaatttagaaaaagtaggctttattttttaaaagaggtcaattctgtttgaatttattctatttgcattgtaatatcaatcaaaattctcatttgctgtgggaaggtggtgaggagcttgataaaatgatttcaaattttactttgaagaataaacatgcaagaacagctagaagaattctgaaaaacaaaaatatgaagaatgagccttgccttgtcaggtgttaagatgtaccacaaaaacactgaagttaaaacaatgtggaactggctaggaaatagatggttgagaaacaaaacatctaacctcagatccaactatgtatagggatatttagtatataataaagttagcattttgaatcagtagggaaaaatgcattaatgaataaatgcttatccaatatgtaataatttggggaaacacatcattcctacagtgttctttacataatttgtacttgttttaaaagcctgtaaaactaacagcagaaaatataattagattttaaatgtaatattagggtgggaaggcctttgtaagcataacacaaaaaaactgaaacaataaaaaacaagattgacaaacgtaaatataaaaattacatctattcacaaggtcaggggctcgagaccatcctggccaaaatggtgaagccctgtgtctactaaaatacataaaattagccgggcgtggtggtgcatgcctgtagtcccagctactctggaggctgaggcaggggaattgcttgaacccgggaggcggaggttgcagtgagctgagatgtgcaactgcactccagcctggtgacagagtaagactcctgtctcaaaaaataaaataaaataaaataaataaaataaaataaaataaaataaaatgtacttctatatcagataaacagtccaagtgaggttgaatgacagatgaccagtagaaaaaagcatttttcatgtatgtgatacaaagaggcctattattcttaatatacaaaaatctcttacaaatcaataagagtttacatctcaataaaaaatgtacagcaaaaatacagcatacaccaaaagcgctttgttcaagataattaatgagacaccaagacctgaagaggaggagaactaatattgcacttaagagataaaatataaatcagaattgttggtagtggaataatgaaatatttttgttatggtgaaaagtgtttcaaactttgctacattgtttacagaaatacctgtgttagatactgaatgtgattctaatcttcactaaagatcttttaaaattaaactttttttttaactgacaaacagggcatttttagttcatataactgaaaagtccagagaatatactactttcagacacaattgaatccagggtcacaaactttgtcattaagactaaagtctttgcatcttttggttttgctttcctttgtactacattctctgactggcacatttgatgtggtgggcctgttggttggagcttttacttaacaatacttagcaacttcagcaaaaagggcttatcctttcttatagtttagtaaaacccataggtttgagtatactgcaccaacttaaatcatatgactattcatgaaccaatcactatggtcaaaaagatagactatgctcattgatcgggtctgaattacaggtccacctactaagtccaaggttggctttgaacatctgaaccacatggactgaaaataaggaaaagtggctgcaagaaacattagggtgttgttataaaaagaggaaatcaatgctgggcagaaggtttttgattttcagataattgtagacttgtatgcagttataagaaataatacagagtgatccttttacctaatttttccccaatgataaaatcttataaaatgatagtaccatatcacaaccaagatattgacattgatacagttaagatacaaacagtttcctaatcacaagattctttatgttgcccttttaaagccatatccacttcctttctatccttatgccatcctaaacctctggaagccactaatctgttctacagtttcaaaattttgtcattacgaaagtattattatataaatagaatcacacagtttgtaattgtcatttgggaaatggctttttaaattcagtatgattctttggagagtcatctaggttgctgagtgtaccaatagtttgttctttttattgttgagtggtattctatggtatagatgtactgcagtttaactatttacctgctgcaaaacatctgggttgcttccattttttggctattactcataaagctactataatcattggtatacagtcttctgtataagcatacattttcatttctctgggataaatgtcaaagagtaaaataaaagtggatttaagtgacggttattccatcacaaagaacttctccaaaaattttttagacttcttcaataaagataattcccctttgactttagctgaagggctgattacaaagatagagttaagcaaccaaagaaaaagtatttgtagagtttctgaaatagtgtggatgagcaaacagttgaatggataatccctagctttaattcccttaatcattccttaagttgatatgctaaagcaatttcaagcaaaattccatgaaacataaagacttccttggaagctttgaggtttgacaaatgccagctggaccatctcagaactttcgatgataccctttaaagtaatagctatgtgaatgagttcgaaattctttttattatatgcttcttctaagtgcaataatttaaaaaatgataaaaaaaatctcctaggaatacttttaggtagagctatgatttaaacttagttttatatttaaaaaatcattttgccctcctttggtttacttgtaggaaagaatgattttttattttaggattgagaatcattgcagtctgataataaatgtttttgagaagtaatttattatagtaaattatgagtcttactttcctgcagttgaatcataccaatacagaattttaaaacacgtctttatttgagcagaacacattcctaaagagacccaggtaagctgactgacaaaccgtatgtagtttgcatccacttccataaaacaattttattataggatctcatacgcttcaaaaacagaatagcaagttgtaacaatgtcagggaacctaaatgatacccacagcagtattattataatttaatattggttgagcatcagcaataagtagacattttataaaacacagcaggagagctggttcctgtcctttagacaaccatcttgtatatcaaactagtattgaagtcttttgtttatgtataaaaacaaagcacaagaaattgtcatttgggaacatatagaatcattaagtaaaaactcaacatttaaatcaactgtagcattgtgccttacatataagtagaaagcgattaatttttgactgatttatctgattatggaccacttatttaaacttaacattttatcagccagttcatatctttcattttataaagtgtaataaatactatatgcaaagctaggtagaaaaaagatatgaagatagggaagtgtatgatgtttggggcaatgatgaatgtccaatgggactgcattgcaggcatgaagcagaagttattgaataggctgcgttggctgcaggtaataaagaacatgactaacagtggcattttcattttaaattatttatctaatgcaggcaaccttttaaaaattatactttaagttgtgggatacatgtgcagaacgtgcaggtttgttacataggtatacacgtgccttggtggtttgtgcacccatcaacccatcatctacattaggtatttctgctaatgctatccctcccctacccctctacccactgacaggccccagtttgtgatattcccctccctgtgtccatgtgttctcattgttcaactgccacttatgagtgagaacatgccatgtttggttttctgttcttgtattagtttcctgagaatgatggtttccagtttcatccatgtccctgcaaaggacatgaactcattcttttttatggctgcatagtattccatggtgtatatgtgccacattttcttaatccagtctatcattgatgggcatttgggttggttgcaagtttttgctattgtaaatagtgctgcaataaacatacgtgtgcatgtctttatagtagaatgatttataatcctttgagtatatacccagtaatgggattgttgggtcaaatggcatttctggttctagatccttgaggagttgccacactgtcttccacaatggttgaactaatttacacacccaccaacagtgtaaatgcgttcctatttctccacatcctctccagcatctgttgtttactgactttttaatgattgccattctaactggtgtaagatggtatctcattgtggttttaatttgcatttctctaatgaccagtgatgatgagcttttcttcatatgtttgttggccacataaatgttttcttttgagaagacatttatgttcatatccttcgcccattttttgatggggttgtttatttcttgtaaatttatttaaattctttgtagattctggatattagccctttgtcagacgggtagattgcaaacattttctcccattgcgtaggttgcctgtacactccgatgctagtttcttttgctgtgcagaagctgtttagtttaattagatcccatttgtcacttttggcttttgttgccattgcttttggtgttttagtcatgaagcctttgcccatgcctatgtcctgaatggtattgcctagtttttcttctagggtttttatggttttaggtcttacatttaagtctttaatccatttttcagttttctgcatatggctagccagttttcccaacaccatttattagataggaaatcctttccccattgcttgtttttgtcaggaatgttgaagatcagatggttgtacatgtgtggcattatttctgaggcctctatcctgtcctattggtctatatatctgttttggtaccagtaccatgctgttttggttactgtagctttgtagtatagtttgaagtcaggtagcgtgatgcctcctgctttgttctttttgcttaggattgtctcggctatatgggctgttttttgttctatatgaaatttaaagtagttttttctaattctttgaagaaagtcaatggtaggttgacagggatagcatagaatctataaattactttggtgagtatggcaattttcacaatgttgatttttcctatccatgagcatggaatgtttttccatttgtttgtgtcctctcttatttccttgaggagtggtttgtagttctccttgaagaggtccttcacgtcccttgtaagttgtattcctaggtattttattctctttgtagtaattgtgaatgaagttcattcataatttggctctatttttgtctattattggtataaaggaatgcttgtaatttttgtacattgattttgtatctgaaactttactgaagttgcttatcagcttaaggagattttgggctgagatgatggggttttctaaatatacaatcatgtcatctgtaaacagaggcaatttgacttcctctcttcctatttgaatacactttatttctttctcttgcctgattgcgtagccagaacttccaatactgtgttgaataggagtggggagagagggcttccagtttttgcccattcaatatgatattggctgtgggttagtcataaatagctcttattattttgatgtatgttccatcaatacctagtttattgagagtttttagcatgaaggggtgttgtattttgttgaagaccttttctgcatccattgagataatcatgtgttttttgtcattggttctgtttatgtgatggattatgtttattgatttgcagatgttgaaccagccttgcatcccagggatgaagccaacttgatcatggtggataagctttgtgatgggctgctggattcagtttgccagtattttattgaggatttttacattgacattcttcaggaatattggcctgaaattttcttttttgttgttgttgtgtctctgccaggttttggtatcaggatgatgctggcatcataaaatgagttagggaggagtccctctttttctgttgactggaatagtttcagaaggaatagtaccagctcttctgtgtacctctggtagaattcggctgtgaatctgtctggtcctggactttttttggttggtaggctattaattactgcttccatttcagaacttgttattggtctattcagggattggacttcttccttgtttagtcttggtagggtgtatgtatccaggaatttatccatttcttctagattttctagtctatttgcgtggaggtttttatagtattctctgatggtagtttgcatttttgtgggatcagtggtgatatcccctttatcatttttatcgtgtctatttgattcttctctcctttcttctttactagtctggcaactggtctattttgttgatcttttgaaaaaaccagctcctgtattcattgattttttgaagggctttttatgtctctatctccttcagttctgctctaatcttagttatttcttgtcttctgctagttttttagtttgcttgctcttgcttctctagttcttttaattgtgatgttagggtgccaattttagatcttttctgttttctcctgtgggcatttagtgctatacatttcccactaaacactgctttagctctgtcccagagattctggtacattgtatgtttgttctcattggtttcaaagagctcaattatttaagccttaattttgttatttactcagtagtcattcagaaacaggttgttcagcttccatgtagtcatgtggtttgagtgagtttcttaatcatgagttctaatttgatttcactgtggtctgagagactgttatgatttccattcttttgcgtttgctgaagagtgttttacttccaattatgtggtcaattttagaataagtgtgatgtggtgctgagaagaatgtatattcttttgatttggggtggagagttctgtagatgtctattaggtccatttggtctagagctgaattgaagtcctgaatatccttgttacttttttgtctcattgatttgtctaatattgacagtggggtgttaaagtttctcattattattgtgtgggagtctaagtctctttgtaggtctctaagatcttattatatgagtctgggtgctccttttttgtcattttttatctttgttggtttaaagtctgttttatcagagactaggatggcaacccctgctttttttttctttccatttacttgctaaatattcctccattcctttatttgcatgtgagatgggtctcctgaatacaacacactgatggttcttgactctttatccagtttgccagtctgtgtcttggggcatttagcccgtttacatttaaggttaatattgttatgtgtgaattggatcctatcattatgatgctagctggctattttgcccattagttgctgcagtttcttcacaatgtcaatggtctttacaatttgttatgtttttgcagtggctggtaccggttgctcctttccatgtttagtgctttcttcaggatctcctgtaaggcaggcctggtggtgacaaaatctctcagcatttgcttgtctgtaaaggattttatttctccttcacttatgaagcttagtttggctggatatgaaattctgggttgaaaattcttttctttaagagtgttgaatattggcccctacttacttctggcttgtagggtttctgcagagagatccactgttagtctgatgggcttccctttgtgggtaacctgacctttctctctggctgcccttaacatttttcccttcatttcaaccttggtgaatctgatgattgtgtgtcttggggttgctcttattgagtaatatcttagtggtgttctctgtatttcctgaatttgaatgttggcctgccttgctaggttggggaagttctcctggatgatatcctgaagagtattttccaacttggtttcattctccccatcactttcatgtacaccaatcaaatataggtttggtcttttcacatagtccatattttcttggaggctttgttcattccttttcattctttattctctaatcttgtcttcatgctttattttattaaggtgatcttcaatctctgaaatcctttcttctgcttgatcaatttggctattgatatttgtgtatgcttcacaaagttcttgtgctgtgtttttcagctccatcaggtcatttatgttcctctttaaactggttattctagttagcaattcctctaacttttttccaaggttcttagcttccttgcattgggttagaacatgctcctttagctcggcagagtttgttattacccacctcctgaagcctacttccttcaattggtcaaactcattctccatccagttttgttcccttgctggcaaggagttgtgatcctttggaggagaagaggcattttggtttttggaattttcagcctttttttgtgctggtttttcctcatcttcctggatttatctacctttggtctttgatgttggtgaccttcagatggggttcctgtgtggacgtcctttttgttgacattgatcctattcctttgtgtttgttagttttctttctaacaggcctctctgctgcaggtctgctgcagtttgctggaggtccactccagaccctgtgtgcctgggtatcaccagcagaggctgcagaacagcaaagattgctgctgttccttcctctggaagcttcatcttagaggggctcctgccagatgccagctggagctttcctatatgaggtgtctgctgacccctgctgggaggtttctccctgtcagaagtcacggggttcagggacccacttgaggaggcagtctgtcccttagcagatctcaagggctgtgctgggagatctgctgctcttttcagagccagcaggcaggaacatttaagtctgctgaacctgtgcccacagccaccccttcccccaggtgctctgtcccagggagatgggagtttgatctataagcccctgactggggctgccacctttctttcagagatgccctgcccagagaaaaggaatctagagagacagtctggctacagtggcttagccaagctgtggtgggctccgcccagttcaaacttcctggccgctttgtttacactgtgaggggaaaaccacctactcaagcctcagtaatggcagacgcccctcctcccaccaagctccagcatgccagattgacttcagactgctctgctggcagtgagaatttcaagccagtggatcttagcttgctgggctcccttggggtgggatcctctaagctagaccacttggctccctgacttcagccccctttccaggggtctaactttttctgtcttgctggtgttccaggcaccactggagtatgaaaaaatttcctgcagctagctcgatgtctgcccaaatgactgcccagttttgtgcttgaaacccagggccctggtgatgtaggtaccggagggaatctcctggtctgcaggttgcgaagaccgtgggaaaagcatattatcttggccagggtgcactgttccttacagcacagtccctcagggctttccttgggtagaggagggagttccctgaccccttgtgcttcctgtgtgaggtgacatcccaccctgcttcagctcactctccatgggctgcacccgctgtctaaccagttccagtgagatgagctgtgcacctcagttggaaatgcagaaatcacccaccttctgcgttgatctcgctgggagctacagaccggagctgttcctattcagacatcttgccagccacaatccaacagtggctttagtaaataaggaattattttttcctacagagcaagaagtaagaatatagaaaattgctggcattgctcccattgttcatgatgctgtcaaggatataggctctttctaccttgcattctccttccttcatttgctggctttttcccctttggctgaaggccccacggtttttaatatggctaccacaacaccaggcatcatatccatgcaggaagaagaagaaagagggaaggggagagtccagctccattggtctcttttattagaaaatatccctcctagttgcaaaggagagtgaaaaaatgactatatggcaaagggaaagaacattgtgattatcaccttagaatggttgttcatcacctcctagagatgagcacattgctcttgtatacagacaagttctgatagcagaaacaggggagattagtcattgattggcagtttttagtcttccactgtggaggaagaaaatggaattggtggcagtcttgaaggcctttttggtaggtttaggagtttcagctttatcaacaaatatgtagtatttagtatgtgtctccagtaattgaatgtgtgtgttgtcataaaccataagatatttcaagagttttaggttgagttatgtttataaaaattttttatcatattctagttttatgtactagaaaaaatacttgtcaaataggccttacatagggagggtttttacaacttacttagaaaaataaccagaaatggtggacctatttatccaccagaagccggatgtattctggagcagcctatatggttttagaatttcatccaaatttgatgcaaggagatgcaagtactctctacaacctggcaatgccaagtcccccaatacatgcccttagtaggatttgtgaacacttagccgacaagtatatactcagtgtctcatgtctaaatgtgacacaaaaacagcaatgagatacttttggaatgacatttcatctcatacacagaatttgcctgactatatgtaattatgttaatacttcaagtgttcatttaattatctttctgttaaaatgtatttaacttatcattaaagtaccaataatctttagaccaataaagtagatagtaggaggtctaaaatacaatgatttatactattttggaaaagaaaaatccctttaaggaaagtgttacaaataaaatttctttaactctttaatcaggtattttcctacttagtgaatatttatgtgtatggaaattcatcacaggattgcttttatgtctttgcttttaatacttggtgctaaattttagtgattatgtagattggttaaagttttgaccttttggaagtttgttttcttgttgttgttattgattttaattactttgtaataaattctagatctttgtaagatatgtgaccattattggcatcagtttgtaaaagctataagccatagtggtttccttatatgcaaatgaaagaatgcagaggtatacacagagcgattcagaggcatattcaggaaagggggagatcattacatcttaacctatttctattttaccatgttcctttcctgtgggaaaacatgaaaatgtggtgattcattaagacatgttaaccaggaagtagagtccctatggccatttcacatctagaagaaaaattttataactgttgctaaatagatttaatcaataggaactaagacttgagataatgacagataaacagaggtacaagtactagagatattgccgtcaaaaatatttggtgatttttaactgacctcaaagaccatctacaagcattttattaggattcctatgttgtcattctcatataacaacttgataccaccatttcatgtaacattattctgccatatctactagaaattaagaattgttggggggctagctaatgtgctaggtccagaatgtacatttttggagcaatcatataaggatctagctataaggattgtggatccatatgaattctgtaggtcatctcaaaatctctgcatatctaactttatttttttcttttctttctctctttctctctctctcttcctttcctttctctttctttttctctttcctctttcctttcctttctctccacagagtctaactctgtcacctaagcaggagtacagtggcatgaacatagcttgctgcagcttcaaactcctatgctcaagtggttttcctgcctcagcttcctgagtaactaggactacaggtgcgtgccaccatgcccagctaatttttgtattttttgtagagataagatcttactatgttacccaggatggtcttgaagtcctggcttcaagtgatcatccagccttggtctcctaaagtactgggattacaggcatgagctaccatgcctggccgggatatctaagttttgtgtgtaataaccttatttcttgtgttgaggcttttctctactattatatataatagtgtagaaaaaggatatatatatatatatatacatctctctctccttttgtttctgtgatgtatagatcactcacttcaattttctgtggacagttttttaaacacagatgtgtttttgtgactaatggtggctgttgggttgttagagatccaaagacagaataaaatcacagggagaaccttcaagtattacagagcaggaccaagtagatggtgtctttctccctacctccatgcttccttcctccctcccttctttcctttgcttgcttctcctttctgggtaggcatttgtaggaactgttttagcctctagaatcatacaatatttgacaaaagaaaaaaataaagatggagaggctcatagctgtagaatttgaattgctcacttttgactcaatgcactttctaacactgcttttaagtactaggtgacaaaataaaatgatacactactttacggacatatatagttttagaaagtattcgattgagttacagaatgttgtccaggcaattaagaacagtatttacctatgttctttatcttgtgactggtttaatgggtctaccctgagaatagttctatttgatgatactttcccttaaaaagatactaagatatttgtagctgtacaaagtaagttacttctgtttgaagagcactggattctttatgaaaggtgttcatcccattatgattgtataataaacataaagatttttaaatcaccgttgtgttcaagtaggtaaatggaaactctgcaaagaatctgcttactactggggatggaggtgggaagagcctttttggaatgatgtgttacagagaaactttgctctctggagtccatatatcatttacagcaaaaagaagaaacacattgcttatagacgagagagtcttggattaggaattcataatgtgctaggggatgctgatgaagcttctacctggaataatgaatgtgaactgtacattcagggtaaaaataacattagttatgagattctctaagttgcttgacatgacatgttctaacttatactttaagcttgactgccttcaaatatctcttaaatagcaaagctatatataaatgagcccatttattttggatgactggttataggagtaatgcatgccatttccatcatcttatatttctaatttagctggactgaaatgatgttcatcttttatgatgggattaacatttggaaactctgccagttttctagatgctggcattctgtggtttgtagagcctgtagaactgtcttctactggggatgggaggcgggtgggatggttcaggcttgatctacatgaaaatgcacatcacacctggtttgctctaggtgattatctgctagctagtgcgctttaggagctggttgaaaaggtggagtgtgtgtgtgtgtgtgtgtgtgtgtgtgtgtgtgtgtgtggaggggtagttttgcttgtcacaggtcatttcttgtttagttgggcttgttgaatctcctcatagaaaacatccatgtcctgtttatcaggtttctttaaagtcctttttctcattgctatccaaaatgcactactattttcctgcgtgtcaacatgccttcttttttcagcatggcaaacaaggcagcctcccttcaaatgtattccaattcctacgggcaaatattttcatcatcatttatgtgggtaattacaggtattccttctgtaatttataaaattataggaagtttaatttatctttgttgtgggtttcgattacagaaagttgtctagttccagcgctttgctctcaaatctgttgtaatatattaattttcgactttaaattaaagctttattatttctatcaccacaatgggaatagatggggtagaagaacttaaatttaaaaaagaaatgagggtccttcaagcaattctgattttagtgtggctgaagtgtttgtttttgctgtttttaagtctctctaccaccacccctgctccctgccactgggatttaggaatgactagcagtttacaggtcttaaaaaatattcattgtaataataagggctaggttatttttctctattttcctacagtgtgttagtttataaacaaaaggatttttaaaaaaacaattaaaatataagtaaagaagtaaggactaaattttaatcatgctttgtttagaaataaggtttttctttaatgatagtaacatgttttccttctcttgaataatttacacattttgttatcagaatgtcttctgcataaaagaggttaaaataaatcattagatgattttagggaagtcaatgtaaaattaaatatactatttgaaacagtctaaaagtgcagacactgtgtgtatttaaatttcccatgtaaggagtcatcaatctttggcaataaatttttctgagtgtagcaaaatatggcttctctacagggagcaaaagtaaagaaatttaaaacctatacaagtttctctgggattctggccaaccaagataagatgatataatgtaaagttgataagaacattttccccctaattaaaacaaaagaaaaaggacgaagaaactttctctggcacaaatataaatgaaatgtatctccagactgacccaagaaaagaagagagaggttgttattgttgttgttattattgattttttttcaggaggaaatcttcagaaatactttaagcaggaccagtttttttaatcaaacagaaatataatatttacagtctttctgcctaaatctttcctgtagaagatgagaaaatgtataacagtatcagggccaggaggtcctcatgcggtctttgttttgagcggttcctgcctatcattttttcatatgctcttgtagcttctgatctcttctagcacaaataaaattttctgtatgatatctttttagcctgaaagtattaatgtgcttccttttttaaaccaagcttatctaaccttcgtggcccaggatggctatgaatgtttcccaacacaaattcgtaaattttcttaaaacattatgagattttttttttatttttttagctcatcagttatcgctaatgctagtgtattttatgtgtggcccaagataattcttattcttacaatacagctcagggaagccaaaagattggatacccctcctttaaaccaatagtttattctattttattcttaaactagattatatataagttaatatctatctaatataatttattatagtagtacttattaagattatgtaattttttccctcaaggaaagctgtagagtaagttatgtttatggacatggaactgggttttgtgggttcaattgcttaagccacccagtgtaacgtatttttgtttaaaaagcagatcaaactgactaagacaatataactttggaacaggatattattatgcaatttccctgggctcagggatccaagacagaggcaaccaaatgacaccccctggcatatctttggtacatggagcttagatttttggcagaggaaagttgggcagcctatttacatggatgttatataggagatactatacaggaaagacttttaagaaagaaaccccgactttaagatattttttctttttagtttaaaagttattaaaacctacgggatagactgggtaatgctgacctagtcaagatgtcaataaagtgcaaaaaaaatgctgatatgataaagaatacattaagaggatgtgactaagccaaccagtgaatggaaaaatgcatcaaggaaaatttggttctggttctacagatagctttacttggaatctgtctaaaccgtattattttggtaacccatttgcctaatagaagtggatgtatccgtgaatgcaaagagttgcaactttgggagttcaagccaaatttgacacagttaagaactccttacctaggccaaaatctgagctggatgttctggcaaaggtcagagtagatttctcacttcaagtccatctctgtgggttgccttggctctcgtggtagccatgatagtgagcaaggacataaggaaagccaaatgtgatccattcaagaggcaccttcaggttatgttaggcatggacaccaggtcttcagcattgaacacaagacagtaaggaggatctggaacaaccagaattgagagcagtcatgtagacctccagcctaagaagggacatttagttttggatctattagcaagatgaaatcaaacagtgttgatcctttgtacagaagaaacactatggggataattggatatactggggcaaagaattaaaaaaaatactggaaaacttgaaattgtactttgaaatttttctgcagagtaacactgtatctcaagctgtggaagaagaagataccagtgacatgctgatactcactgtcacatacaaaactatattgtgggtgatttcctaaatcattcaaggtttttcagaatcatgcatttgaataacttcacattagttcatattatagatgtgagaagacacattttctaaggtgctcaatatggaacaaatgagaaaaacagacatatcagaatccagtcccatagtgtacatagtgaacagaacatagcactggagtctgagacctgtgttcaaatcctgattatttttatggctattttattaaattatttaaactttcaaagttttcaaattatttaaacttcctgagcttcattttcttcatctgcaaaacagtggtaatcatatttgctttgcaggatgcctgtggggtttaaataaagtaataaaccttaaagaacataagtaacaataggcaaccaatacaaggtagctattgtaatgtgttctgtgctggtaaattattcaacttctcttttcagtgatgcttaaatttctatcattaatgtggcagttaaataaggcacaggctttttttgatggtgatttttgaaaatccttcctatgtttaagagaaaaatgcctaaagaaaacagaagacccaaaaacaacctcctcctttgacaacatcattctccaaagatcatttgcacaattgttgattggcaacattgcattggcttacaaaaaataacactataaaagtacaacatgttaagtaaacaaactgtctttacaacactcagaagttcatgtgggtaataccacaagaaaaatttttataacataaacgatacttattttgatcattttgttttttagaatttgtttacacatacactattccttttaagctagatttccaaattataaagtagagaagataattaaaacaattatttgaaaaacaaacctctaaagaaaaggacattcatggttgacagaacaaagatggcccttggcgtggcatctgtgagctaggtttacttcatggagaatgtttgtcttttatccagagttgtttgtttattttaaaggacaagtgaatttagtattgaaataccgaatagtatattttttattgactgagatgtattagcatttgttttaaaatttcacttagtatatttttattattataaaggtaatatattttcctggtagagaatttggaaaatgtagataaataaaaagaagaaaataaaaccatctatgatcctgccaaagataactactcagcatatttctccttttaaaaattcatttactcctatatacacacatgtataaaacaaaaacacaatcacatatttgtaatttacattttttaacctagtaatatattttgaacatttgcctatgttgcttagtgctttttcatttcatttttaatacttgcacagattttcattgtataaataaaccatagtttattaaaccattcttcttagaataataaataattattagtagtaaatacattttactctggtaaaaataaatttctaacattttacctttttactaattttcatccactatgaatatttctacaaacaattttgtggctcactctctacaccactatgattttgtataggatgaatttgtgggtcaaatatgatatgcaaaaatcttagtgttttatacgtgttctatattgccttccaaaagaaagttaaagaataacatttctttctctggtccttcagtgcatatttccacaaatcctctacacggcttatttctttaaaaaatatttactaaattgttggtagaatggatacaattttatatttgtccttattatttgtgtgattggataaattcatttcttgtatgtatttgtctattatttgtaaaggatcccaaacaggtgtgcaaaagtattaaagtttagcattgagtagagataaaggatatgtcacttgctttccttacttaagttaaggctttacttcttcagtccttcttggtatagcatctcatacaattccttaagtaaagtcgtcatattttaaattacagggaactgaaaattgatttgacttggatgttcaaatgatagatcaaatctatgatttatgctatgtagaaaagcgcttgctaaaaatcaaaactccataaacgcacattacctcgaattagtcttgcacctttcatctacagacctggtgggactaaaaaagaataaatataaatattattaattgtcattcagaatctttggtgaatgaaaagggccattactagattctggttctggtttaccaacctagtcagttcatagaggaagctggggcctgttgaggcaacatggtacaatggaaagcttttagactctgcccgggttcaaatcctggttctgccacttacaaaatgtaaatagaaggaaaatgtacttaatttcttggagctttatttttacgccatttctcagacatgtgagtgttagtgggttctttggattattgtgaggtcagttcctctcattttaaatgactttcccagggtcacttaactaattaggcagagtggactagagtgtttatcccctgatggttcatcatatgctctgttcagtataccatggctacttttctagctaaggattttgaagcatgccatattaaggcacatcattttaattataaatagactagaatgaaacaaaggtgtgacaaatactgtggtttggttgatccaatctgttgttaatgtcatccagctaaagaccaccaggaacatacctgtaatcgagcaagtctgacttattaatagatgcaagaaaggagaccacacaccatgggaaatgtggggcatttcagtaagagggtgtttggaaggattattacaggatctggtctcaggtgatttttggggagggcttaagaaagtggctttgctctgaattggatgctatcaggaattgggggtaaatatatgattgcttattttaaaaatcttatctataatatgggaaaaataaagtgaggctaaagaatcaaactgggaaagaagcagcagctactgatattagccaggctatgaaggtgcttggtatttttgtggtttgcacaatgatcttgtttatgtgcttagacaaggttatagagtggtcttttttttttttcagttcatcatggtcactgatgttggtgatttggaagcttgtttatgttcaacaggatatcatcaaggcctatttatgaacatagctagcttttcacaacatcaaggcctagctatatagctgcagtttctgaaatgtcaaaagctgctcttctttttctctctgcatctcttttctctccagccacctttctgcaaggactggctccggggcaaaattatagccaaagaaacatacacagaagtttcctgggagcttcctaataaaacttttactttcaaatattggtaccacccattctccttgctacatcctctttcttcttgttggaaaggggatataattgtagaagccacaacagcttttttgtaattgtgaggacaaagtaaagtgatctcagagtctttggcatcattgatctgctgaaccagcccagcactgctaaactctggatttctcattatgggagaaaaatacttctcatttttttcaagccactgtagtcaggcttcctgtttgttacctgttgctgaaagcattccaaaaacattgggcattcaccttcattatttactaaactagatactcttctggcagccaaatttttatgatgactcagaacatattccatttggaaatagagcttggcaattattctccccttttaaaaattagtcttaagtaaatgaattactgttctttctgcttcataaggtttgtcattattacttcactcagatgcaattgctttcagaaacctgaataagaaagaaagctttagaaaccttccagattaagttctgcaggaagaagtgtgggtacatttgtagacttgattatttaaagggtggatacagctataaacctaattgctagataattgtgacttcaccactgcaatttgttgggtccctattcccattgtgatttgtcaagcttcacagtgtattggttgtttttaatgatcattgacttagaggtgaaaagaactcctgttttcctaggggataattccctggttattctgtgctatagtggttagaaggttagattgcatattacagaatcaatgcccactggaaaactaatagcatgtttggaagtgatgatgaggacaatagctaattactattaactgtgtaggaaaactaaactgcagggccggtaggaatccagcgcctgctagatgctggatgagagttcttaacaaaagaaaagtgaaaaggttcagggaaacttcatgtattgacagctgggatttgtacattaaaaatcttgtgcctgtggtcagaataaattttactctggtcaaaataaattttttctctacccaccaactggtaattattttacaagtgatagttttttatttttttaaaaaatctccttctgcaccttacacataatagatacaaaataattactgttcaagaaatgcttgaaaatatattaaaattggactctaaagaatagtttaatttctgcaataatgacagtaataatttatcaaaatgttctccataaatagtaaattatttagcagatcaccattcatatataacagatatattactgaataaaatatattaatgttcactgtggttaacataaaatatccagatgggagggaatttaataatttatggggatgattcttgtccacttaactaagtaggatgtgaattttgcataaagtgcttgaccgttccatgaaaacttgtcactgtttgagagagaccaggatcttatttttcaagaaaaacttaatagtaaattacaacaaaatagtttcacaatataattttcatgtcttacacttcaaatgcttacaaaaagtctgctttttctgccagttcttgtaggcatatggaataaatctatctaaatgatgtgatccatataaacttaatccactggtggggtattggttgtaggtctatgttgaaattacagttactatacaccttcacatagttttagtaaatttcaggggtttggtaaatgaggaacatgcagaatcatagttttatagccatattgagtgtgatgtttattacatagccttctcagagttcctcaccattttgtttctctagaaagcatgctctttgaaatggatggtagatatatgttggaagatctattggaaaaaaggggggtcgttacaagcttatccaggttttcctattttgggatttttttaatgatacgatctatcttcctgcagattaagttctggcaaagtatatgttttaattaacttattttgagagaatgaatgaatgaatgagaactctcaacctttatttaaaaataaatttactaggaacttctctctaaatctgttaaaagccataatgaaggtggggaaagggacaattgtaattcagtaaaataaatacaaaattggatatataaactctgcaatgagaaatacaggagggaatctaggagtggacttatttctctggagtgatgtctgagataactcttgagagagaagtcattgttttctaggtagacaaggagttgggagggcagaacaaagtttcatactgtggccaggaatgtcctaaaaagtgccatggaatactgtggaatcttagaagtttaatgagttcgttatgttagaagtcttatggctttttttttttctgacagagaagagccaagagatggtgttatgcaggtggtttggagttagctcatgcaggcactaaaggcatgctaaagagttttaagttgcgtcttgcagttgctatccgctaagctccagtacagcagcaaccatgcctgcctcactcaagtggcaatccagagggctgggagagtgtctgacacattgtagttgcttagtgtgtttttattaagtgaatgagttagaagcgattgaaggaatttgagaaaaggaataacccattaagatttgaaatttaggactgtcactgacagcagtacaaacatggaagagaaaggtgtatggtttcaatggctgctataacaaattgccacaaagttagtgacttaaaacaccaatttatcttatagttctttaggactgacatccagcacaggtctcactatactaaagtcaaggtatgggcagcgccgtattcctttctggaggctggaagcgacaaaatccctttctttgcctttcccagcctctagaggctgcccatttttcttggctcacggctctcttcctccatctttctccagccacattgcgctctctgaccagtcttccatcttcacatgtctctaaccacagaccagaaatgttctttgattttaaaggctcatgtgattagattgaggctacctgagtaatccaggaaaatctcctcatatcaaggtccttaactttaatcacatctgcaaaagttcatttttttccataaaacatattcaccggttctggggactaggatgtggacatttctggtaggctgttattctacctacctcaaggggcctgaggggtgctccatataggagactagtaacgaaagagtgtatgaagggataaagccagttcccggttcaccaaaccgttttgctttcctctttgttagagaggtagactgaattttgttccttttttttttttgagacagagtcttgctctgtcactcaggctggagcacagtagcgtgatctcagctcactgcaacctccgcctcttgggttcaagcgattctcctgcctcagcctcttgagtagctgggactacaggtgtgtgccacctcgcccagctaatttttttgtatttttaatagagacagggtttcaccatgttagccagactggtctcgaacttctgacctcaggcaatatgcctgcctcggcctcccaaagtgctggtattacatgtgtgagccactgcacccggccccttctttgtattgttgtggctaatatgaccaagctctgtgcagtaggagttaatgcgtgccttatccgggcccctaaaacacttctcatgtaatcctccatgctttttcttttctctcttctactggttgaatgtagagggatctggcacagtacttggaggcactgcgggatggcagggtctctagccagaagcagctagaaccctaagaggagcagagatccctaccaagcacattgcactccgtttgcatgagaaataaagcttttcttgtgttaagccactgaaatttgcaaagtatttgccagagcaaacactctaacatgacctttgaatttcaatgtggtggtagggtgttgatgatataacaaaaatacaaatcagtgcaggtggcattgacttagtgtttggcccatgggcaggacccttctattaggggctggaaataaactatgttataaaggggagcaatttttataagttgttgtctggaataacttggaaggcagacattatgcctaaagatctctacagtttaacacagtgattcttaaccttggctgcatttcaaaatcacctgaggaatttaaaaaacttattcctactcaaagaccactcccagagattctgatttaattaaatggtttctgtgtatgtgttgaggggaaggcggcgttagtattatttaacagctaggattgagaaccaaagctgtagggcaaggatcagcaaactctttccgtaaaaggccagatagtaagaattttaggagttggccttgggagtaatactatctctgttgcaattatttaactctgctattacaacatgaaagcaacatgacaacaggtaagcaaatggttgtggctgtgttctaaaaaaaaaaactttataaaacaggcaatgagctggtttttatatgcaggccatattttgctgattcatatctaggacagtgattctcaaactttttattctcagagctgttttacccttttacaaactattgaggaccataaaaatcttttgtttataagttatatctagcaaaaattaccatttaaaattgaaataaacatttaaaaaataatgaattgaaaatagtaagtatcatgttaacataaataacattaaagaaaattaaaattgtcataatggatatatttgtggtgtgcatagtgatgttttgctacatgtaaagtgatcagatcagggtaattatcatatccatcatctcaaacgtttatcatttatttgtgttggaaacattcaatatcctcttcttagctatttgaaactatatattattgttaactatagtcattctacagtggtatagaacacaaagaacctacttatcctacctggctataattttatatctttatataattttatatacaattttatatcttttatataataaatatctatcccctctccccctcctcttctagccaattacttctgtgagatcaacttatttttttactttcaacatgtaagtgagaacatgtggtgttcaactttctggtcagcaccagaaaatggtttatttcacttaacataatgaattccagttgcatcgatgttgctgagagtgacaggatttcattctctttcatggctgaatagtagtccattgtgtgtgtatatatgtatgtatatacacatacatatacataccacattttctttatccattcatctgttgttggacacctaggctgattctgtatcttggctcttgtaaatagtgttgtaataaacatggaggtacagatgtctttttgatacactgacttcctttcctttggataaatgcccagtagtgggattgctggatcatatggtagttctattttagtttttggaggaaccgccatactcttcttcatagtggttggactagtttatattctcaccaaaagtgtataagaattttattttctctgtaaaaatgtatttttaggataattatatttgcaaaataaatagtaaaaagaacggcattgttttacatttttgcaaaactctatattgtctagttaatagaggacatttagattcttacttgcttcttcatccattctgttgtgatatgttgtcttaattgaaataagtgaagaaaatctagtcccatatagatgtgtaggtatttcttgttggaagaacaatactccttcttttgaaggaatattttaatagtcttttcacataattgttgacattcttttatattatatcatgactcaaaagtgaaaattttataaaagtatattgcaacgtggaatctgaaaccgtatcaataaacttttcacactctagtacattaaatccactttaaatggatcctttacctatgcatgattttataatatcttgtattgattggaaaatattatttcactgagttatgtaataggcacatttccttatataatattttttaaaataacatttgttaatatcaccatggatctcataaaaattctttaagtattcagaagctgtcaagctcacagtagtggatacaagttttccaaaattctaattttcagttgaaagctcagattttatcattggcaccaaataccgtcaggttgtttgccttcaagtgacaggctcacttcacttattttcaagaaaatgactgccaaatatccaagtatgaataaccatattttgtttatcacttgttctttcaagcaaaagtggtattccacgaaaaagagacaagttcagtttgcaactcaaacaatcacacattgcttttcctcaagacaaccattgtacttgggtatgcagcagaagtgctttatgtgttctttccttgtagtcccacagaatacttaaaagatttgtaactcaagtgttgagctttaagaaaatgcataaattttaactgtttcattagggtattcttaagcaaaactttttaaacctgtgagatcatggtgatgaaagtgatgcaatgacataataaaatgatatgatacaatttggtaattttgccttgatttatgctaaagaactgatatggttttgctgtgtcacaacccaaatctcatcttgaattgtagctcccacaatgcccacatgtcatgggagggacctagtgagaggtaattgaatgatgggggtgagtctttctcatgacagtgaataagtcttatgagatctgatggttttataaagaggaggtcccctgcagaagctctctttttcttgactgttgccatccatgtaagacatgacttgctcctccttgccgtctaccgtgatttgtgaggcctccccagtcatgtggaactgtgagtctattaaacctcatttctttataaattacccggtctcaggtatgtctttattaacaacatgataacagatgaatacaagcaccaacagttttactcaccattgctttggcaccattggtgcaaatgtcaatacagtagaaaaagcaaatacatcttaatattattatgaaaataattttgacctcatggatccactaaaagagtctttgggatttccagaattgtgcagattatgctttgaaaactgctgcttgtggggactggttttaaaagaaccacagtgttactgtgtcatagctcttattggcttcctttggtaaggtgtttcaagaaagagatgaactcagacagaaatggctagtttccaagccagatggaaaacaatagaaagtatccagacttgagtgaacgatggtggaaatccatctgcttctagatcccacacagaaccacaaggcccagaaagactttttagctgaacactatgacttagatacagatcagattaatggccaaagagagctggagagagagagagagaaaaaaaaaaaaggagaaaagacctgagaattgtacatagaagcaaatacaacagaagcctaccaagattttgaagaacttgtattgtcaagaaatccaaaatatctgattaaaacagctttgtctgacctttaaaatcacctttttactttggctacactcatttcagctgtgtccaaaaggaataaataaacaataagaacttctaaagggaaaggctgagggtcaaacaagaaaaagacaaaagacttatttccagagagcagaattaaaatctaatccacaaatttatcctctccccaggctaggggacatctcgaggcctgccaaacaggattgtagaattgtagtggcctagtgaacatgtacatcctctgattcccttttttgaatgggaattttaattgtagttacgctgtccctgctccaccactgtatatacagcaagcccataaccaaactccactctcccttccctcacctgcctgccagatacaagggtttgggggaaattttaagctactagggggtggtataactactagaaggaagaagcctggtcacctgaatgaagcagatcctgtccaccaacctgtgctggattgtgacatgaacaagaaatacatgtttattgtgctaaaccactgagattttggttccagcatttgccacaaacattctttatcacaacactgagaagactctgaataatatggaggctattccattgatctgcccggaggaactgaactatggcagtggcagaaataagaagaaatacatattttagaggtagaaccaataagctatcactagtgggatagcagagcagaatgaggtagagtaaggagtctgggatgtgttccagctttctatcttgggttaaagtgggtggagttttggatggcactcagaacaacccagtgaatttatccaataggcaggagcttgggacagagatgtggaaagcaggcacatatagggcaatcatcagcttataggtgatggttgaagccatgaggcaggaggaatagtggataaaatattttgggaagacagttcagagggagaagagcacagaggtcgcttaatgaacagcagagagagcagtctgcaaaagagtgaaaaatggacccctagaaaggaaaaaaaaaaggcagaaaaggataggtcacagaaaccaaaatagaattaaagagcactttaaaaacactttaaacactttaaattaaaagaacacttttaagaactgtgaaatgataaacaatcaaatatgtcaaaaaggtgaaatataatcagagctaaatatttatgaaattttagaattaaaagagtatgggtgatcttcatgaagataatttcaatggagcattgatacaaaattcagatcattatgtgacaagtgtcttttgattttatagatgaaaaaacagaagtgttacatcttgaccaagattgacagcacatgttggagctttactttgaactcttgcgtattcaacaccataacccatgctcttccattcttccaaactgaatctgaaaaactcacttaagtataagatggattcagataaaattttgattataatcttgctaaagctgggtaaaatagaaaggtattgaattcataggattgatattttcagagaggaaggtgtagagaggtgactaatgttctatcgtatttctgagaggtttctttttctctctcccctccctctttttattctcttcagcagattctattgataatattggtaaccagcagttaagttttgtaacatgaataggttaaatgttatattatgaatatgatttttatattcataacatgaatataaaaatcaactatttacgactatttaactggcttggggacaaaggtggtaagagctgttggccacagctatcttatttttaacaatagggctattttggttttagaacataggatgtatgaatcttctaaaatcacttcttcctaaaattataaggttgcagttgactgatgaaatttttctctcttataaaacgaattgacaagatcaaaggctgcaagagtttgagcgctaccttcacatttaccagaggctttggtggcaattcagtatttaaagtataatttccaaacaagctaaaaacagagccaaacatttttaggagatttatcctatgatcttcttttcattaataaacataaaggttaatgttaccctaaatgttatcataggacactatttcaaaataagcgcattagcaaattaaatgaaagacatgtcaaaacctgaagcagcatttattcttgtgagccaaggtgtctacaaatcttgtgcaggaaatgtaacttttcttcatttcatacaatgacattttgtatgtgctgaaattttgaaatactgtgcactgacgtgtttcacaatgagcattacagaattttgaggcatttgaggggacacatactcagtagttgtctgggtcattactgccttagtgagaacatttgcacattctcacaattgtaaggtttccccactattttcatgaccaatattactgtaaaggtatttgtttttttgcagttcacagggtattgataagctgcagtactatgtaaatttaataagtcataaacagcatttattaccttggtatattattaaaaaatgaaattttgtatgaaatgaagaaaagtaattggcattatttgaatccattatttattaaattttaccatttttgtacaaatgaacctttcttggcatgtactgattttctaatctagaatgcatgctaaaatattttcattttggtagcgaagtaccttccaatttgggactcagaacattcaatttagagtatacataaagtcaagaatacatacagtcagcattattaaacataaaccttgatactgccctactttagttgcaattttttgacagcataattcagtatttgtcccctttgcatttctatagcaactatttctgtgaaagttatgtgtttggttgaaattttctagagcagaaaagaatcatttgtaatttttatttgaaggttgtgttgcagtgatgaggaattgagagatgtccttcattgtatgcaaaattatttttaaaagccctctaccctacacatacacgtgtgtgcacacacatctgcatgtccagtgttatagatactaagtaccatctaattactcacattctcttaaaacagggtagcagttcataggtaatcactttttaaaaattagttaattgaaagaagacaatctaaaaagacagaaaaaaacacctaaccccattctgaaagttcatgttatttttaaattgcatatgagaatttttgtaaaagataggttgaaaaatgtacctattacctgctgcttacacatttaatgtcagagataaggcaacattttaagggacgctatttggcaatacgcactaccacacagaaaatttaaagaaaacaaaaaaagtttaagaaaaaaaacaaaaataaacttaattttgtttccaaatcaagcttatttctatagcagttttaaaacattttatttggttgttctcatcaagactttctatcctattctaataactaagagaatcctaaagctttctacttttgtaatttaatatttgaagagatagatttctagagaatattttccaaatctattataggctggaagaacagtatcatagcttctgaatttcttctcaaatgtcagtattgtttaacacatttacaaaggcaatgaaaatagaaaacttatatgctgattttaagttctacatatctgaaattcttaagcaataaacatgtttgtagacaggtaaactaacaaggctaaaactttgatttttaaaattagaacacttatatcttttattgtcattagttatatatattaaagtcaaatgaaagagctatttggtaattttataatactgatttcattcattaatttaacaagtatgaattgattatttactctgtgacaagatattatacctatatccctggacacagaacaaagggttagccattcaatagtttctgaaatgtcaggattaattctggctgtcattataaaggaagaccatttggggagtaaaattttaaactgaactgagtaaaattttaaaaagcacataaaacaaaaactgtatatcaatgagtaacaaaaactactatttaactgggttgggtcaaaggttgtaagagctgttggccccaactatctgaaaagaaaccaaaatgtcaagttgacctcttaatggtgactgggtaaataccaaggttcagtggtttgttcttgatgcacatccaaacatttggacatctgtccaatatttctagctagttttttcttttactaacgtagttttgaaaaatgtaaaatatgtgacttgctatagaacattcatggtctatttttgtcatattaaacaaatgaaaaagttccatattttgaaagcatttaattttcatatgttcacaaatacaagtagcatgacattagttatctatgaatcatttttgatagcaaaaattctgtattgtgaattcagaactgaagagtaagagaaaataagattgttacagactgtgatgcagtttgtgaaaaagcgaaatggttggtgtgaatcatagtggctggggttggggtaggggtgggaaagaggtcaagaaggacctctgtgaggaggtaacatatgagctgagatttgaaggatgagccctgggaagaaccagggaaagattcttgcaggtaaagagaaaaaaatgtagcaatatgaggtgaaaggaacttcattaagaaaaggaaggaggaaatcttaaactcccctgaataggatctttccgacatagattatttcgtatcaggtggagagtgctctgctatgcagcaggacagcctaggtcctgcaacagtaatcgaccatcccccaattccagatgctctaaaccactaggttcatttctcactcactctacgtgtccattgcaggttggctaagtgctgtgctctgcatcctcctctctccaggacccacgcagacagagtagtcactatctggaacacagaggttttggtgacaaagcaaaaagagaaagcatggcaaattgcgtacaggctcttaaaggttctgaaaacttccattcacacttcattggccaaagctgtgacttatctcaagtcagcaaggaagtgtaattctccagtgtgcccggaagaggagtagaaccggaaatacgaatgagcgacagtaacatctcctagagggggtctgtgagcaacctggaattgtatgtacatttgtgtgtgtgtgtgtctgtgtcggtatgtgcgtgtctctggggagaagatccatttctttaatcagattttcaagggatctgtgacatgacaacgattaaaaaccactggaccagttgaaaactgccatgtaaacagataattactatacaagacaatttgcagcatgagtgagaggctgaaatgattaaagaattgtgcttctgtgtgtgtgtgtgtttgcacacatgcatgctcacacatggtgacaaggaaaaagctgagccaatgtgtagactgaaatgtagaaggcagagttcagagagtgatagattaaagacaccaaagtgtgaggggacatgcctgatgtaatgaggtccctgaagatgcctgaggagatggtgtccaatattctataacttcagggatttgaagagattactcttctttgacttgcaaaaaaaggagggaaaagctaggtgtcctcatgggtcagtttgctgatggaggggaagaagaggagctctattttgtttgtgataaatgagcaaggtcatctgcttagaatgaggggattgtagagcatgttaatagtttggaacagctgtaagggaaatctgaaactgagctgactggggagaaataaaaggaccgccagtagcacagagggcccagctgatactggagaacatagatttgtcagagtgccagtaaatggagttatgtgatttttctctgcccatgctcagctgcctggaagcgggagctgagaaagttaacagttggatggatgcagggctggggattggcagggcaggtgcagcaacatgttttacttataatttgaagttcaagagtctgaacaggcaaaagagctaattttgcctccaattttaaaagataagttggtaaataatggtgataatggtgagaataagctgtatatatagctataacctgtagttatcctttgtgagttgctattcttgctccctggagttcataactgatgcaactactataactatggctaaggataagtagtgtagcttatttcttattgcttaagtaaaattaatcatgcttcagccacatgagtttttttttatgttcctaatactcccttattcttctggtaaaatctggcagaaggaaggtaagagaaaaaaattaaacctctgaaaatgtaattacatactcagagacagaatcacttagctaagcatcttgctattaattagtacgttgtaaattttgctgccttggctgatactaagtcattgtgtttagaagagccattaaatgaagacaaaagaaaaacacctggagtagcttagctccaaagtagacctcaggctgaaatagcattgtattgcatttctcttttcccaattgcctgccaaattccccattttccctgatttctgtgaggttacatcataaacatttgataaaaaataatgttgctcttcataaaggctgcatatgcacactgaaggcaaacacagccctgatagtaattctggattaagctctgtcattttattttccatttcttcagaacagaggtttcttctctcaaatattgatgactgacagatgaggtgagcaagccaggtgtgatcatttagaattgcatttagggctgaaagtaaatgtgacttttcacatccttcctcaacacaaaggatttagcaggaggcaagcatgttaaaattctaaaaggagattattgctgcaaatggcttttccccagaagaccctctctcagaatttcagttgttgataactagcaggttttatctctaagaactaagatcattttctcatcacttctggcctgccaacttgtagactgtcttcagctgaagcagtgctgccagaatgaataactggagaagttactcaactctatttattttagagtatgataatttgagggaaaattaaaattgtcagttttccattacaccctcaagctctcagtgctggttatctcatcagacttaaaaaacatactttggcggaaaattgtgtaaacagacggaaaagccaagaaaaataaggaactaatgtctcatcaagggccacatggtatgtttagggcagagctgggcacctgaacatccttactgacccgaggacttcttgctctagtcccaggacagggagatgtgtagatgctgagtatctgaagtaaacactgggcagttatctgaggtctggttatctaagtggcaagggaaatggatatttaaatgttcaaattttgacctgcaatgatctgtaccagaggcctagagactctgagcgctctgagggcaaggacactgtagagttcatctttgtctacctggctccaagcccagtggctggcataagactagaaagccaatcaacgtttaagaaattctgaataaattcagatcctttaaaaatgttgtcggccgggcgcggtggctcacgcctgtaatcccagcactttgggaggtcgaggcgggcggatcacgaggtcaggagatcgagcccatcctggataacacggtgaaaccccgtctctactaaaaatacagaaaattagccgggcgtggtagcaggcgcctgtagtcccagctacttgggaggctgaggcaggagaatggcgtgaacccgggaggcggagcttgcagtgagccgagatcgcgccactgcactccagcctgggcgacagagcgagactccgcctcaaaaaaaaaaaaaagttgtcggataacctcatttctctactcagaatgctgcagtagcttctcatttcactcgaggtaaaagtcaaagccctgacagatctggtctttgctgcctcctctcccttcccgattctcgcccccacacaccctctggtggctccttgttcacaggaggcagctccctttgcaccggctgttctttaagcctgaactcttactctacatacctaacaggctacctcccttattttctttaaattttgttcaaatgtcacttttcattgagtaatatttccactgtcctttacaaaaattgcagctctgttacaccccccgccgttcacactggcgatcctgcttagcctgctacatcttttcataacacttatcactttctaactctaacttaccataccgtttactattagtatgtttatgttttgttgtctctctccttctaacaagggcaaggatttttgtcacttctgttcactggtattcccagtgtttcagccactgtctgacacatagaggatgctttgtaaataattgtatgaataaatgaacaaagctggattagtgaagcaagtgagtgtacatgtctcatagtgaaagagatgcactcttaaagacaggcgtaaaggttaaaggggccattagttttggtaaatttataaaggtgtacactcattttcatattcaaaagcccttgtaattctggataaactttgccaacctccagactcaaaactatggacttccaacctgttaactgtgaagttttcttggtaagaacgtgtggttcaattcttgatgaattcagacagtgagcacatgtgtggattggtatttctcaaagtagacttatgaggcccctgccttaggaacacttaagtactgtattccaattccccagccctttccagtttactgagtgattagatctccaggtgactcaaatccatgctaaaatttgagaattatcagtatataaaaatctgccaaaggtgatgagactataatagaacaggattgcccctgttgtagtataattattccacaggatgttgataagattgcagttagaaaaaaagtgttcgttaaaataataaaataaggtaatactgaattaaatgggtatttaagtaacaggagttcacagaacctttaataagctgacataattgtgcattcccaagagtaggctaaagtatgtagcatcacagatttattccatcatgaacatctctttttaggcaactcattagcttttggggagaggtgtttttttttttttcctttaaagaaaaagtctgggcacttctgttatacataatctctaatatttattcctgattctaacactgtataattctctataattttgttttctctcttgtcaactccccttagtttatagtctagttgcagctttttatacctaagaaaaaatatgaaatagtatttctatatttcatggtgtctaggactcatccttgcaaacaagaaaggtctttctgtgtatgagacatacacacacgtgctcacacacacacatacagaaagagagaaagagagagtgagattgtgaatgagaataaggtaaatgccagtccagagaggtgacacaaagaagcctgtacatggtgtacttaagtgagtgaatctgcttgttaaaagtaaaatttagtagatttgtaagtgagggttttgccttttatgtaaagtggtatgttagtgatatacacatataaaatcccactgggtgtaagcacatgtggggactggtttttctgtattgattaccattaatctattccttatgtcactttccattgctgtggcatggcccgtggaaacaagataggtatgtgcctggaataaacatctttttccctttctgaaagccgtgtgaagtctacagcacattacatccttctgtgtaatggaagtatccacacatggacaatcgctgtctacagatgtaatgaaccaagtgggaggtaatgagaagtgactgtcatgccatccctagggccccctttctcccaccacacaattacactgtgaccctagaggaaccaagaagactgtaacattctcccctttcctaatggtcttaaaatcagccctagcttaccagggataactaaaatgcagcattattcaattggcagtccagaggatgtccaaggaaatatatgtttataacatgggaggcagttctgtttacactcatacactgtttcctcagtgtggacttggcctcttgcctgaaagatgccagcacacgagggtcccttcctgttttcccttagtgtgtgattttggggtaagagctgttgctgtgtttgtaatgagagtccagggaggaggctggtggtcagaaccacatttgttaaatgtgtttaaaaaaaaaaaagctcctttaaataatgatgataagtgcagtgatagcaatgtatcacccattttatttctgagttttgtttcaaggagagcattgattacagcaaccaattttatgtgacttatgcttgtggtgagagggagatgtcagagctgaggaaaggtagagggttgcccactgagtcaacttgaagagagcacacaaaaaatgcaaaaaggtataagaattaaaattcttttctttgtcttcattttgctcttatagctgaggcttgcccacattctgggggaagtctgccaactgttccctgaatggtgaatggaaacaagctggtctgctgtgttgcttggcaaagacagaatagcagcacaggcttgctgctggctggacgacaccattttccactcctctgctcctctgcctggaggaagcccccaggtggcattagggagaattagcgtgtaaattacagggcctcctaatttctcaccacttcattagttgacagttcagtgaaagagctcccctgccattcacctcacgtctgtggcactgacacttctcatcagcagaagcagagttcagtcgtgttgtgttgacatgcttgtgacttttcggttcccctccttagtgtgtgctagtttattctctgaccctgttactagcaattatgtccttggatgtccctgcaacatctacctcaaaccttcttttggttcaaacttgattcagtgtcaccaggaaaagttagaaattgctcttgatcctgtccataccgttttacagaatgggttcaaactatgccacaaagaaaggaaaaataaaaataataccctatataaaaataaactcttctccataatattcttcatagctagtattttttgagtgcttattctgtgtcaggcattgttctaaatactccagagactgttaaatcttttttttttccttattgtttgtttcattcaggagaaatctgaggcacagagaggttaggtttattgcctaggacacacagcttttgaatattggaagtttggatccacaacccacactctaagtactggagcattttgccttacttagccaattacttagttaattcctgaattcattcaacaaactttcatgaagcaccagctatatataacttactatgccagagtttcttagtctatcaatccttccatttccattggtgagaagctatttgttgagtacttcctatctccccagggatatgctcatgtagatacaagagaaatgcaggatgggaccttaccatcagagaattgaagtacacgtagatagttgacaaacttttctctctaaagggccagacacaaaatatttttggctttggaggtcacgtggtttctgccccaacaagtgtgaagcagctgcaaatattatctaaatgaattagtatgtctattctgataaaactttacaaaaaaattagcaccagagcatatttggcccacaggctgcctgctgtggaggatagaagaagcccgaagaaaaatacgggaccataaatactgacggtacgactgagagtggagcttgtgcattattgcctgtccacatctgtgaggtcagtgaaataaggtgtcagggagcaagaacacctgtgtgcattttggtaattaggcaaattatttctagaggaggtggagcaggagccttccctcaagaatgggaagtatttgacatacacctgtgaggttgttaggtgggtgtcaccaactgccatagttcttattactatgtgtggcaggcaagttggttacgtaatgtccattttcctctccttccttgttaaccccatttttgtttggtgccactacaggttcagccctaagcaatggctcatagttgataacagtacatctcgataattgtgttctcaatttccctgcctcttttgcggttgaaagtggtcatgtgacctagttctgaccaattagaagtaggtttgcctgctgggtggagtcaggagggactcttgggaagacttttgcttgtctgatcaaaggaacagacaagttaatgtcacacctcccttatattttgttgccacaagtttaaacatgaagatgaactgggacagacatattggggccttgagggaggaagccaacgtgttatagatggagaatgtggacaaagaaaaagagcctggacctctgatgacaccagggagctactacatgggtgctgctgccaccctccagccttctaattttaagagtttactacttttattattattattattgatttaagtcactgttagttgaataacaaatgtgtctttaaaaatatttcgggaaatgtcaactagaaattacttctagaaatgttccatcatcttagatatttcagaaaattgtaccaaatcaaatgagattgtttctaatttctttcactttcttagtaatctttcttcacagtatactactaaggagaaaaaagtacattacagataaatattagcctatttttcatttaaatatcataaatgtcttaaagtaagaacaacaggttagtagtggttgtgtctgggtaattgacactagctgttggaattaggagtgtgtttattgttttgctttatttttctaacttttctatagaaaacatataaatgaaaaaatttaaaatcatactaaaaaatcaaactaattttatttttaatgcaagtttcttttctgacttatactattttcctaacctagtttttcctttggctaagctcatttccttttagttttctttcccatattgttttttgttcattagttgtgtactgtgcctgcttgcctgctttcctttcttttccctctcttcctccctccttcccttctgatatggtttggctgtgtccccacccaaatctcatcttgaattgtaactcctataatccccacacatcatgggaggaacccagtgggaggtgattgcattatgggggtgggtctttcctgcactgttcttgtgatagtgaatgagtctcatgagatcttattgttttaaagagttcccctgcacaagttctctctctttttgcctgctgccatccatttaagacatgcctttgctcctccttgccttctgccatgattgtgaggcttccccagccacatggaactgtaagtccaattaaacctctttcttttgtaaattgcccaatcttggcatgtctttatcagcagcatgaaaatggactaatcctccttccctccttcttttttctttcaacaagttcttgctttgtcactcagtctggagtgcagtggtgtgaacacagctcaccatagccttgacctcctgaactcaagccattcttccacctaagtctcccaagtagctaagactacatgcacccaccaccacacctggctaatttttgtatttttaatagagacaggttctcgccatgttgctcaggctagtctcgaactcctgggctcaagtgatcctcctgccttggccttccaaagtgctgtgattacaggtgtgagccaccacactcggcctatatactgtctttctacatttttttttttttcatttgaatgcagtctgtggtatgatgctgcaaacttcaagtttgttcttgaagtttgagccttatgttactaagtttcatcaaaccatcatcttcattcatttaataaatgttgttagtgccagccactatatgtgctttagaattaggaggaatgaacatcggaaactgtgctcttttctcttcctccgctttccttggactgacatacatctcgttctgtaagacccaatataaatgtgatttccttcataaaacctgaagttatcaactcaatgaattattaacccactcctctacatttctattacactattgtttctaactctattttcttatttgatagtatttgatgatatgtgtgtttattagtatatattcttgcctagactgtgggtttatttaggaggactactgcatcattttatctttgcctggtgtccatccctgtgttgctcctttaggcagccatatctgtaggaaagatgataagccacataaattgcatgcttggaaatgagctttctgagaataatatcctgaacctgacctatattttgccacaccatatctcgattgtcagtcacttctctcggactccagtgccactttgtggtgtcctttattttctcccctccttcaggtatacatcatcccttgtctcttctagactttctcaatcgtgccccttccccagcttttttactttgacacagctttttcttggaggttcagatcctggagaaagatctggagaccagttacattttatactgagcaagctttcaattgttagtctattcaataaataggtgggtaagcaagtgaatgctcagaggaaacagacatttaaaaacttaatgctttttatagtaagtttggggtgaaaggcaataaaaaacaataccattggctgtttgtggtatttattggaatgtgggaaggcacacaatataggcctgaaaacttcactgtggcatgtggccagtatactcctggtcacccagtccttctgcgtcaccattcttgttgatacagtaatcctctttaaataagggggaaataagaaaaacacaactctttgaactcaagttagatcaggaaattgtggcaatttctggaatgtcaagagtaaaaataagaaaggaagaattaatcctgctagcccaaaatgagaagctgtcaccatcaaagctgtaactctctaaatgaatataacacctctgaaaactctcacaactgtgccaagtatttacatgttctctctgaatgtggcatctacagcaagtggttttggtcgtgaagcacaccatctgtgtgattacccaccccttgctagagtactctgaactcagcagttgtacaacagatgcatttaaatatacagtattcctgctctcatagttcagaatgggtgttagaaactgagggaaaacaaccagcttccttgaaaactcagactccatctgacatttttccagacaccttttgtaaccatgctccatgctatcctgaaagataacaacattatcataatagatttacacatagttaaaccaggtcagcctgacccagaacatcagcagctgctgtcataatcattaatgagtcagttaatccagaaggtgaaaccagatcactgtttggttttcattcaagtgaagatcagtgtagtcatgggaaaaacaagggtacaggagtcagattataagcaatccagttagatgaaaaaaaatagttttactataattcattactatgatgtattagtagatgtgtctttgaaaagacaacactagatggtttttgaggaacttacacaattaagaatgaaggattgaattccatccccctcttttatgtttgtttaaatactgcacatgcattcaccaaggtgttttattcagggatgaattcatcctaaatgcaggactgagatctaaagttgcattcatcagaatgtgttccttagtaaatgctgttgatcccttctgaatcatggcctctcttgcctccaattgatgcagtaacataatgttctttcagctggtcatacgccatgctgaatgagggacggatatttcttacataaatagcataggtttttttttttcttcattttttcctgtaggcccctctcctgttttccccatagtagtggtgtatgggagacagggatagggtcaacattgaaaaacagcacatgccaggaatggactgatatcaagaatttaagaggagctacggataaaagatgtattatgcacatttatgcaataaaagcctgaaccgtaaatttaacatggccagaaaataaattgttattaacattttcctgcaaattctgggtaagacttgcattgtggtcatcatcatgaggcacattaacaatcttgggaagactcattgggaaccagtgttcacaggtggcctgatggttgaggaagcattgtaagtgatgttgtaaccatcattgtgtaaataataaatttaggaaactgcagaggcaagaagaattaaattgtatcaatacagactccaaagagccttggtattgtgagtcataacagcactgctactttcttctctcagtggaaaaaataagaaaaacacgagtgtttttgaactctaattaggtcagaaactggcagcaatttctggaaatggagaattaactctgctagcacaaaatgaggagttatcaccataaaaagaacatgacaagatgtttttcggacctgaacaggaagagatggtgccaggaccctatgaagaatcttcacctgccccaaatgagtgataaacaaatatgtaagtccctctcctctgcccattgttttaaatctccatcaatacattacctcacatgggactatggattctgaatacaattttgatcaaaatagttgtatagacagagactctgcacaaaaagatttgccacccaggactgcatataccccagaggtggccctggtctggaaagccagattaggtccttttaactgtttgataattaataagtaaaaactgaaataatatttagataatgtaacacaatcaaattttatttcagaattgtactatgcagagaggctgtgtgagatgagttaatagttgtgaaaggagtgatcataggcatgagaataggcgggaggcaaatgcaactgtcctcatgaggctgactcacattcaagtgaaggaattgagggtccagacctggcaggaaatgagatggtcatgtctttaacagaattcgtgatgtctgaaagagaaagatgagttttgaggggaaagaaaatatgtttggaattttacattttagaacattggttatttcatttgaattttgagaataatgacaatggtggaatatctgatgaaattttggttacactgaaatccaaaggtcttttgctataatttctcagaaactgtaattaaaccttgtagtaattagaaagtgtattcagacattcagcagacctgcctttatctaagcatttccaaattagttaaattagttcccaaaacaagtaggagagaaatggtttggttttctctgtttagagctaccttcatccttatctatatatagcacaaatttgagatccaatagaaggctactggtaaaaaggtaaccatcagttttgacttatttctgctgaggaaaatacaatttgaaatacatcaccaaatgattattcagtaacgatccttgacttccatactgccccagaatggaaacaggcccaatcaatattaacacatgggtacaggagcattgctaagagtggaagagaggtgtttagaggtaggggtgtgtgtggtgtgtgtgtgtgtgtgtgtgtgtgattagcacaatgtctcaggccctcaccagatggaaagtacccacagtggcaaacaattcaatatcaagcaagaatatgagagataaaaataattatcaatggttatgaaaatttgactaatatttatgttattgtaataaaggtcccagacagtcttggtgactaagattttcatagaatatttgttgtttttaccacgttgcgagttttcatacatcatgattactttggcaaaattcgaagtgctgcatactgaatgatgtggttcacagcagtggcagtaaaaggactctacctacaatcaaagagtcatactgggttattttggatttaaaaagatttagtaataggctaacattggaataaaattaaaatttaaaattaatgtttttgaagaatttgtaataacaatgataagttgtttttttgaagtttacaaaaactttctccccagcacttttcttattacatgtgtaagatgagttaatgggtgtgaaaggagtgatcacaggcatgagaatgggtgggagacaagtacaactgtccttatgagggctgactcataaacaagtgaaggaattgaaaatatggttgataaaagtaatgttttgatgatgagaaaaattaaagcacagagtttaagaaaatttgataaacttaattaagccaaaggcagaaaaaataagaactagaacttccaaccccctctattcacttttctcaatttaaaatttcatctttagaaggtgatgtttatcagacataaaatccaaatcaattagatctaaatgttgggaaccttgaaaggtttagtcattctactgtttaagttctgtaatgactaagaacgtatcttttccttgtgttcatcttcattgttcctattttacccagagggaaacattctttgagtaggtttatagtaagaatagacaaacaatttaaaactcagcttgttatactaatgattgacagctaactatgttgtataatgggaagatgtgttggctagataacagaacttattatagaccagtactcccattatctagttaagtgttttaggaaagactttctttattccctctccccatctcaccactctccttccctctcccttccttcttttccttctgttctttaagaaccccactgttctcacctgaggaaagattgaggataataaggcctaccacataactaactgaacctccatgttagagagctgttgggacaattatatgagacatgtaaataactttaccccttttttcctgtctcagtaaatactaccacaatccttccaggtcctcattaaaacctttggagtcatcctgttttttttcttctcccccaaacctatccaactacaagtccgttaagatgtaccccatatttactttctccttctccactgctaccattccatcgtaggccatccagaaaactataatcacctctaactggttaccttgcttcttctcttgtcctcattcaatttattctctatctagcagccaaaatgggctcttaaaaacaaaaataaaatcatgtaatttctctgttgaaaagtctccagccatttcccataacactcagaataaaatgcagattacctaccatggcctctgaggcaggttcaagatggccacagattctgtgacattcccatagaaaagagaagtgtctgactttcttccctttgaatgtgggctggccttaatgccttgtatgattaaccaaaaagggcaaagtggcaggagtgatgttctgagacttccaggagaggtcataagaaggcgtggagcttggatcaaggcctgctctgggggaaaccagtcatcacataagtctaacagtagttagagacagccacgagaccgccatgatgccaacttgtgagaagagcacgccatgtggagaggccctagaataggagatgccatgtgaacaaagagcaccaagggaacagacattgaatgaaatcacctagttttgcagctttagctgccccagtaatactacccgcatcagagataaatgtccagaagaactttcccatatcgctgaactccaaattgtgagcaaaataagatgtttgttttaagccactaagtttggagatatgtcacagaaatggatagccccatagcctctcatgccataaaagtgtaattctttcccctatcttggagttcatccccttccattttcccctttgcttgctgcccctgagctgctgtggcttctctgaacacgtcaagcttattcctgtgccaccaccttgacacgtgtcatagtctttacccaaattcggaccccagaccttttcatacttgtgtccttgtcatggagctgaagtgttaagtatcaatgggactttctgatcactccatctgaattagcctcaccatgcctacatcgttctacttcctcagtgtactttatttttcatagcacttataattccctgaaatgattttgttcctttatttatttcctactaacccttttgcaaatgcaaagtaaactttttgagaccagggtcttttctgtgtttttcacaaatgctatttatagggctatttatattcagtgctatttatattcaatatttttcaatgcatgcatgtaaaagtgcttcaaacctaaacaagttttattattattgcaccacaagaaactattgcaaaaaaccattgagagctggagaaatattgactagaatctgctcagacatgttctaataagatataccaataagatgtagagaattaaaaatatccaacaacatcaaactttaagtccacttgagtcaatcataacagtacattttcatgttaatatctcctttagaaaactgacagtttggttgtactatttttctattctcccttggcacatggctcaatctttagtttttttttttcttttaacatctgtcctttaataacaatattaaaagtaaggtgttttggggtttagccatccataaagttatgggacaaagagtccatgagactgttaagtgtgttaatcatttaatataggaggcactgacccctttcaaagaaggaagaataaactcacaatctgatttatgtgaatttttgttttgctttacattttaacacccagtgaccacttagggagaaggctatcaccaatcaatagtatttaggctactcaagaggagagataacagagagagcctaacatatttgtagaaagagcatctctacaaggatttaagagacaaaaaattttgattctgtttcaataaacttattggtgtgataaactgtgtaattgtcagtatgtaccaggagagcaagtttaatatatattacagtagtacacattttaatatagtcagccagagaaacttactgactagtaagaaactgaaatgttaaaatgaaaatccaggcgttgagattcctagaatctctgaaaccatcttgcatctctctctccatctgcctgtcaacgtgactttctgaaataactaatctcaaaggaagattttagaaaaaaaaatcatgtggatgtgttttttttcccctaataaatgccaatcttaggcagtgtttttgtcaggagtctctgttcaagctttaaaagccaaaagaaagatgaaaatgaatacaccaaaatgtaatttaaaatgcaaatgaaggatctgcagaaaagcagcaaaggctaattgtagtttttcttcatgcttggctctgtagacaaaatgtgttgatgttaccttcctcctgctgggaatgcccaggctgtagctgtattgccacactctgacctctcagattaaatacacttgatcttaaaaaaaaacccaaaccccagtcagaaatcagtaggtacttaaccctgtataggaataggtggagaggcaaccatatgtgacagtgtggttgttaacctctgaggaatagaatagaatagaatagaatagaatagaatagaatagaatagaatagaatagaatagaatagaaaacagtagtttcatattataaagaaagggcaactaatctatatactccaagggctcacgtagtatagatttttaaaaaatcgagtcctgaatcaaggacaccatttgtttttaaatgaccaaggcttcagaaatactttagattaagttggagtcaattctaaaatgtgcagttgtagcttctttcttttttttcagtcctgtcatacctggacactatgtgctctacattttgtggtgagattggataaatgcattacttgcagcaaaaccttgttcactcttttaaaatcttagaacttgtccaattaaaaaaaagcacaaaataatttgtaaattccaacttttactttgctttttttcttttcctggaatggatggatgttataataaatacaagcaacattttatcacaaatgtgagtggtcttgcatatgtgcattaagacagcctactcaaaggtattacataaagtcctggagaaagaatggatttaccaaataaaataactgcttggaaaagtttaggtccaaaaattataatttagaattatttttaatagctctgggactcaagtgggatccatttctccattatatgtattaattagggccacagaacctgtggacagaagagattgttttctaattctcattcttcactatcaaaactttgaccaccgttaatagagttctactggttcttcatgctatttcctgccctccagtatgggtaatactgcattagaaattggtcagatggaaacaagaaggagcctataaagggaagagtgtggataattgtatgaaccacaccaggacataatgtggtctcagatgtctccacatatgccaagattgagaggctgttgggatcctaagttagggaggacacagagattcccttgtacagcttaagacagcacaagggcttgggactcacagctattgtattatgttgctttggacctatttcttcaatttcttcgtcttccaagatttaccatctgtgtcttatcctgcctgagagccatggctccttttagtaacacatacttgtacacgttaagaggaaaggaagacttccttgttaaactctatcaattactctgttcagggaatcacatccacctgtttgcatgtctgatgtggtgtgtttgagggtttggccagcacatgaagaagaggaaaaggagttgaagttcgcttctgaactttgtgggacatagtttaaccacatgaagaacaagatttaaagcaagtttataggtccagtcttaaaatacgcaaaactgtattagggttcttcatgcataactggtttattttctctgggatttcttgcctttggttctaaagttttgaacccattattttttcttttgaggaggggaggaagtgaactctggtgtttccttctcagaagccacatgactgagttcactggtgtgaaaataaaacccttttataacaacactcagaaatacattgttttcttctagtaattatttttccatgaatattttactttgttttataaaattaagactagggctgtccttaactgcctctgatgaacagaatgaggagacattctaaacacatttgtttagttgtttatttacgatgtgttataaatatgatacatatgacatcaaattgaaaaataaaatcaggggaggtaagagaagtcctaatgcagaaggataacagaaggttaatcagaaaataaaatttttatgaaaaggaaaattttatgaaatgaatgaaatgaattttatgaaaatgaaaattttatgaaaatgctcataaaaatcccactttagtcctctcgttaatctttggttgtcagtgttgctttacattgacagttctcacctttctcaagtgcttgaatgttcccttcccacccgaacgaaaggctaatttcctacttttctcagatagccagttgttatttctaatgtgaacctggcagtctgaataacaacaaagataccttattttaaagtctacaattattggctacaaaatatccaaatatccttttctgtatcactagctcaggacaaagtctatccaaaataagtaacgaatctaagatattaagatattatttgatttagcctctacatgattgtcaaatgtgttttagtatgtatgtttctctgaattcttccttccttaggaccctcacattaaagtattttatttatgataatctttcccttatgcacctccatagaatgattttaataactgtagtaacacattattttccttaatgattgcaaacactatagtattactatgcattaggcactatggtaaatactaattgttaacccatttatactttaacaaccctggattataaatactatgactgtctacattttacaaattaggaaactgaggcacagaggaattgattagctgaacaaagacaacacagccagtaagcttggaattgcaattcaaaagcagccggtgtgggtccagaattaatgttattaaccacattgatgtgctttttttctataataattactaaaacttgtgtgtttatcatcaacagtgtaatggaagagtaaagtaatatatctccactgttattatagtagtggtattattggtagtgtagcacttactctacctagtatctacgtgatgccttgaaattgaggtgccaaggaaaacagattattttcagccactgggaaatttgtatagggttacgtggctatgcagtgtgttttagattcctagatctgaagaaataactctgtgtcaaaggtggtttgcacagatttctggatcattatgaggagccctgtgggagcacagcatctgtagtggggtccagctctggatttagttacatgactttgggcgagttatctgatctctataaaactctgattctttctttataaaaaatcagataattatgatccctcaggatgctgggaggtgatattaaaaactgacaactgtcatgtgctgtatcaataaaagttttgctagagttttagcagagaaaaataattgtagacttgaatcaccactttgcatataacagttaaggcaagtagaagtcaaaggaacctgcactgtagaggtttccacattgtaagtaggcatatccaatgtgtgtcattcttgtatggaccaaatggcaatagtttattagcagtgaatgtgctattgattatattaacagatgcattagatttttataatgcagacttaaaaaataaaacatatgaccgagattgatagttcctacttcagtatccattttcctgtcttgccttagtaacaaacctggcacattgtggcctagaaattaaaaatgtacaaacaaacgacattacccttctttctttgcaactaggtatcactatgtgactaagttttggaaaatataatgtaagtggaaatattttgttgaaattatgggaagattgtttaaagggaaccaagtcagtagggaagatttttttttatccctttatatttactccctcttttgccgtgactgtggatatgatgtttggaactccagcatgagcttcatgggctatgaaacaaaagtgaaagacagctttcttttccatcttgcaagatggcagacgaaaaagttgataagctggatactaaggaggaaaaacctgatgccaagaaggctgatgccagtggtaacattaaaaaggctaaccttcaggctaaaaagtccaagaagaggaaggcccactgcagccaaggtcctgttctcatcacaggaattggcagatatttttggtctgccatgtattcccaaaaggccatgaacaagaagtactcaactgctaaatacagaattgaaagattcttgcaactgttacaaaaccagttgatggtgacaagaatggtggtaacccggtggttaaactttgcataatgtgtagctatgatcctattgaagatgtgccttcaaagccgttgagccacagcaagaaacccttcaatcggcatgtgagaaaactataggctagcatctttcctgggaccattctgatcatcctcactgaatgccacagaggcaagcaggtggtttttctgaagcagctgggcaatggcttgcaacttgtgactggaatactggtcctcaatctagttcctctatgaagaacacaccaaaaatttgtcattggcacttccacaaaaattgatatcagcagtgtgaaaatcccaaaacatctcactgatgtatacttcaagaaaaagcagctgtggaaacacagacactaggaaggtgagatttttgaccaagaaaatgagaaatacaagactatagagcagtgcaaggctgatcagagagctgtggactcacaaactttaccaaaaatcaaagcgagctgtcagctccagggctacctgtgatctgtttgccccaatgaatggagtttatcctcaaatattggtgctgtaaatttcttacaaagaacccaattaaataaccaatatatttttaagtagaagatgggatttataacaatggagcagaattatagcagccagaattcttgatgatatcatgggttccttgtatcagttatgggctatttcaagatttcttttatgataagaatattaaaagaaaaaaaactaaagacatttaaataactggtattttgatatcaattaccaaatcagtcttaacttgcataccatattactaatcttcaattaaattaagtaaaaatttttatatagttattgagtgtacatcagcttgtgaaaatacattgttattgagttttgattgaatctaaggtctgactatcctgaagtagcaaaggaatcttaaagttattaaatatatgtacttaagttaaaaaggcatttttctgcattagatcactgaattcagaaaatttatatatagaatcagacttgaagctgtaataatatctactatttataaccaacactttggttttagtaaaataacattatgttaaattaagttgataactttattatattcatagttttgactacatctattttattatcaatgttgtttatctctaagcataagaagtttttatttaatatgaaaaggagcttccatgattattattttcttttagaagggaagaataattttttcaagtttgaaaaataacacttctgagtatgacaaaaattatattactatattagctataaatcaatctgaagacaatagatagaattgatagagaacagagaattcagctacaacagtttttgctgaagtatccctgtcctgaatccgtctccctgtcctaaatccagaaggtttttttcctgacttactaagaaatttatatcgtcactttatttaagcaaaacaaactctaggattgcctgagaaatgtctccatcattgtaatagtaactttaaaaattagcccctttatcttcatccaactgtctttctcttccaactatatctggcctgttccagactatattctctcttgtatttacttttaattcagtcttgaggtctcctctggagagtggctataagctctagccttgccctgatggggttccaggagtgaccatagttgatgtttacaatatggctttcacaggattcttctttatcctggcggatggcctaacacctaagtatctgacctgtgaccaggcgtccctctcctgggaaacttgtttatgccatcggatgcactgtggttcttctctaatctgtgcccagtttatccctaccaagacagccaccttccagaacagcactgatcagaaggagagttcggttcagatgtattagtcaggtgagacagaggtggcagcacaacaaacacgtaaaataacagaagaaatttttactacttaccaatcttagagaaaagagggcaatacgtcttgcaggaccagtggggtctgggacacacatgctcaactagcaggtggggagcaagagagagaggagggaccagaggaccaaagcctttattggggttcagggtgttacccaaacaggtttcccagggcaagttctaattggtgggtttaaagcaagcaggcacgtgttccaggacgtcatgctatgactgagaagtggtcagtgtgacatatctgaacagagtgggaggtctgtggggacagtcaagtaggttggacctagctgtcccatgtggaaagggtcaccaggaagttgttgttgcacaaggcaaacatctggatcaatcacattgaggaactggtaggaggcagagaattggaaactgtcaagagtgactatgccctgtttctgtataagaaagtccaacttatacttaaaatgaatacggaggcaatataaaattataagaattcactagatcctgaattccagagccatttttttctggtaagaaacaagccacttcttgattagccatgcatgggggtattattgttatagtagcaaacacaaccatgtgaaaataattaagattcaccctcaatggtggagaatggctggttgcttcataatgcaagctgtggcagaaatggagtgaacacgctgactctcaaggagagctcaatggcccttataacttttctggaaggaacaccataatgtgtaatagaaccaacactggctttggaggaagaaactcatgggtttgaagctccactctgccacttagttctgtatgtctgttggtaaataatttgccctctctgaacggaagtttccttgtacataaaataggggtaataatacttatcttggaagactgttgtgaagattatggattgtatggacttatgggcaaaatgctaatgcaggacctgacaccgcaggtgttcagctcatggtagctgttattattaccagcctcgattgtgactttcttatattgtgatgaagaaatgcaatgaaagcctcaaggtctcaaaggtgaaagaggcaaaaaattaagaaacagggcaaagtaataataccacagtgaatcaacttatatccttgtcatgttcctgttttcaagggaggatgttgtctttttctccccttcacaatctagcccatgacaagcatcctctaaggtggctgtgtataacatggcactatggtggaggaaaaaagtgctaccaatttattaccaattacagtttataatctgggatgaggttaaaaatacttgataactgaatagcagaagcacctgtgttgcacacaccaactactagcctatatcagcctcacttctttccaagaacagtcagaatgaacacttagactatgccagcgtggaccttttcactaagtaagcagctgttttgatatattaggaaatgcctgaataagaaggaacacgactgtaactacatgactttactactcttatgcgagctgcttggagacatactctgtaaaatgtatcaacttttgcttggttttcactttcaaaaattgtttctgtcaacaaggaaaatttccagttccttaacaagtggaaaataatcagagttttaatcttgcacctcatagtaatagcgtagtaactggtattttctcagtatgcgcaccaaatattaaaaaaaaaaacttgagaactttcaccttggcaaatatgtaattttaaaagatcataggcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaagatcataggagacagagtaaccaaatatccaatatttcaatttagtctaaaatcagcagtaattcaagtaaataggaactgggtggtttttttaaatatgaaaatgcgactttgtttctaaaatttggcttggagacatgttaaattggtctgggaagtttctaagaatccctttaccttcaggctgaggagaaacatttagcaagctcacactaacagtgttggaaagggaagaagtataggaaaccaaaactcagtttttgattagcactatactcatgatacttctaaagacaaatcggttgtttccaaatcctttggctggtcggaatcctagggaatttgcccattgttggcactgtggtctttggagtgtatttgtatactggaaacccaaaggatgcaggaaacgtgggttggttacatattctaaacctcttaagggtgacaaaaaagcacccacagctctgcagggtatggtattttaggaagaatcattgcttgtactgtgctgtattcccatttaatgtacgttaggaatgtctgaaaggtattcaaaacctccagattcactttctattgactagatggaccatactggtagagctcctggtacgctgattctcaatctgaagccaagggtacagctagggctgtgttttctctgccagtacagtgaattaatcgtgggataactggcagaattcagctctgggtcaattttcagtacaaactctattactgtgtctaacaaggctgtatgaactgcctatttatgtatgcagaaatgctctatatagacaacattatctggtataaactgaactgcacttgtgccaagaaaatagctccacatgctgcagacatcttggctctcttctgctgcttttcaggtggtgtgaattctggcaggagccaaaagtcaaactccaggatagagcctgggtctctggcccaccagctatggtgggcagcttcatagagcacatgaggcagctccagttggcaagcagccccttccttttaattaaagccattggcaccttcggtaggggagaaacagaaatgggaatgagttggtcttcactgtacactgagggtgtcaaaactgatatcttcattaaaatagcttaagctgaacttatctgaaaatatcaaaaatttattacagggagtctaaagctttattatcatcatcatcattggggagggatcaggggcagacttatataatatcttgaagactcctaggctcctggagtgaaactgttatgacttggcaccaatgttgctagaacatcttgtaagcaggtacaatgccaaatgaacacatgtgaacaagaatgctcagcaaggaggaaatgtttattttatcagtgagtatcataactagaaataggatagaactgatccatctgcttcatggacacagccatccaggcttcaagacaatagataactggtgcagaagttggtggcaaaaagaaaaaaaaaaaaagattgtgcatctgtcccctagtcaagcctactaaacaagcattttctaaggtctaagcatattttacctgcccatgctcccagagaagggaaacattggaaatcaaatctgtatgctttgctgctcattagacattgttattctctgggcaagtagggagaagagtggctaattgttttgctgccttttgcatgtatattattgatgaagactacatagtttcattgatagttcataaatttgcagataatatgagaaggaaaaggaaattcagtgtgtgtcaagagcagacaacttggtttatttcttcttatatggtaccctaacattgtctttggagagagttttccttttctttcctttttaaagtacaactttattgaaatataagtgacatacattatactgcatatatgtaaagtgtaaaattgataaggttatgtatctatccatgaaatatcacaagtaagataattaacatattcatcactcccaaaggttttcttatgccttgttgtaatcctttcttcctgttacaccccatctttctcactctctttcccttttcccaggcaaccactcagctgctttttgttcctatagattactttgcattttctagaattttatctaattaggatcatataaaatgtcttcttttttgtctagtttctttaacttattacacttattttgagattcatccatatgattatgtgccaacagttcattcttttgtattgtagagcagtagcctgttacatggataaaggaccatttgttttttcattcacattttgatggtatttggattttttccattttttttttactattacaaataaaactgctatgaacattcaagtacaatactttgcatggacagttgcttttatttctcttgggtaaatatctaggagtaaaatggctgactcttatttatttaagaaactgtctacctgttttccaaagcggttgcgctgttttacatttccatcagcagtgtataaggttctagttcttccacattcttatagacattagatatggtaagttttaaaattttattcatcttaataggtgtgtcatggtacctcaatgcagttttaattttcatttccttaatgactaatgatgttgaacatcttttcatctgtttatttgcagtcagcatgaattctttgggggaggtgtctgttcaaatattttgcccattaaaatttttttcttattgagttttgagatttctttatgtatcctttaagttcatcctttatcaaatatatgatttgcaaatcttgtcttcctaatctgtggcatttcactctcttaatggcatttttaaaagagggggtttttaattttgatgaagtccaatttctcaattttgttttgatagatcttacttttggtgcagtactcaaggagtcttagcttaacctaaggtcccgttcttctacatttcctgtttctctctctttttattccttggtgcctggagcagaagtggcagagctggtttgtagatgtgaagagattcctgttttctgcattcaatagctctgtgcaatctggctacttgccatttggatttaaagcattagaaaaaagacaggagcaggagacttgaaaagtttctgtgaaacctcacattataactaagaaaagaaagccactaattgctttcagagaacttgtcaagaaggtttcagatgtactcgcagtcggtttttccaagaaaaagcaaaagcagttttatacggtattttgaaatgttaaccagatttcttaaaacttgtgttttgatagctaaacaataatagaaataaaatctggtaaaagttgttacctaattcagtgaacttttcaaagtttttattttcttatttttatggaaaagaataaccaaaacattcacagagtgaaaagtctgcaatactagggcaaagcacttgtttggcacaacaggaaaataactgcatcataccagagtgggaatacatgcagctcttctctagtttctaaatctgaaagcagcattattatcaggtggtgattacatttttggagtgaaacagtgaatttgtcaaagcacttatctattctgcttttggtaatactagcttatgcttttttcttttccaaatgctttttatataaactatctgatggcattctcatcactgacattactatacatattagagaagttaggaacttgaagaaaagttaagtattttgctcaaggtaacattgccagttagcagaaaaaccaggatataaacattttctttctctaatagtttctccgctgttaggtgctgctccttaaaaaaaacaaagcacctctttctgtcagtgggatgtttaactgtacccacttctgcttctgttaatatccatcaatagatgagagttaaaatattctttctcttactttgtgttctctctaatttagattttatatttttgtaatatgagcttagagaatgactcaaaataaacaatgttggtactgaatgagcagttctaaaaacttaaaatttaattcacttaggttataataatgcagatctcaatattccatttggtcacaattttaggaaatatttgttattaattataattctggtataaactacatttgttgaaattgctttaattcaaggcagcttctataggatatttttcaaaacatcccagtgttctgagtgaccaaatacagaaataaagcctgtcccttaagacatctaccttaaaggaaaccttataactgtgaaaagaaaattatttgaaaagtttccatttaacttaattaaatatttatagagcagataatctaaaagagttgcttagttaatgctaggtgatccttttactgaatatctattttgatcttatcactcatattgctcattacttttaagacttttgatcattttacagaagacttgggtcttctgtgttctgaggtttaggtttaaaactatgacactacaccgaggagggtgtctattgctaaagctggtttaaatagtttaacatgcagtcagaaaatttgttttgcattgacaatataaaagctagctgaagggtatggaaatgctcatataggagggagggagagaaggttaaatttcttgccatgggccacgctggagcaactgttaacaatttaaacaaggattttttttttttaaccaaaaccgtgcaagcatggtttctttccttgaggcaggcaaaggacatggctgggctcatacatttttagcagctggcatgttaatgagataatttctattgaaatgagctaaatactattaccatttgtggacttccagctgattctaaggcatttattgaacttcaaaaagtgctccagaatcaattcaaagtacatttttagattcatgtgtatgttggtacctatatacatgaacagtcaatgtttatgcttatgtgacttggctcatgaagtgtccagatttcttaaagcttgtgttttgatagctaaacaataatagaaataaaatctggtaaaagttgttacctaattcagtgaacttttcaaagtttttattttcttatttttatagaaaagaataaccaaaacattcacggagtgaaaagtctgcaatactagggcaaagcacttgtttggcacaacaggaaaataactgtgtcataccagagtgggaacacacttgagaatttcagatttaaactcattatttttaattataacactgtcataacaaagcaccatagagtttgtggcttaaacaacagagatttattttcttacagttctgaaggccagaagtccctgatcagtgtctgatgagggcttttttcttcgctttctgatggctgccttctctgtgtatcctcacgtggccttccctcattgagtacatgtggagaaaaagagagacaccaagctctctggtgtctcctttttacaatggcattaatctcatcatgagggcatcaccctcatttaaccctaagtacctcccaaagatcccactccaaataccatgacattgggggttaaagtttcaacatatacatttgagggggagacagacattcagtccataagaaatggcatatgtggcatccatatgtggggaagttgtccctcagctgttgtaaatgtgggtctggactcaagagtgagatctgatgtggagttagatatatcttgatagatatagatgagtttcctctgcaggtcactgtttccccaacttctctttactgtgagtattgtcaaggtctcagccccaggaattcttacttctcatgctactacaacactccctggcaatctcatacttgcttatggcttctaccaccacattcaaattggttaaaaataatgcaaaacttcccaatctagtgtcctattttttctgacatttcttccaactatatcctaaacatttccttctaaatgtccgtattggtgtctgacacttgagaatttcagatttaaactcattattttttctgaaatatccaccctcaataacaaataagtaaactttttatttcctctgcctaaaataacaacaccactcatcattcaggtgaccattcagtgatgaagccctgtctccctgtactcgtttcctattgctatcacatatcaccacaattgtagtagcttaaacagtacaaatttattatgtacagtttggaggtcagaagtctgacacgtttctaactgggctaacataaggtgtcggcagggctgtgttcctttctggaggctctgggggaatctatttctttgccagctggaggccgcccacattccttggttcatggcctttcttccaccttcaaagtcttcaacatcaagccgagtcattttcagactgccgtctctgtttcttcggatttcctctcctacttttaagtataaacttgtgattaattgggctcacccagataattcagagtaaccatgctattttaagttcaggtgatcatcttccttaattccacctacatccttaacttatctttgtcatgtgacataacatattcacaggttctggggtttaggacttggacatctctgaggggccataattcttcttcccacactctcctctattccatatcccatgaacccacaaccccttcaacataccttatcctgctttatttttcttcattgcatttattattatctaatgtatgattatagatttacttattttttgcttcctgcactggaatgcaagcatcacaaggcaaagacttcgtcttctctgtggctgcatctagagccatgccagagacatagtaggtgctcaagaaatatcctttgaatacatgaatgaaagaaaatctggtttctcactgaagactgtcagtttgacctagatggcgtgtttccatatccattcccttttattcatattcactgtcctttgtattatttcactttttttccctcaagaattttcaccattttagtaaattaatagacagtgtacttcagtttctatcctgtttctaaatcacaaatctgttcatcttaaccttctacttaaaacccttcaatggctctttggcaaagtttatgagattatgtgtaatccgcctctgcccatcatttcctcatattcttctttacactacatactccatgttccagagattctggaatatttgttcatgtttcgtatcttaccttctttgactatataaagaaatatcccttctccacattgagttcctctttttccataatttcagtggaaatctctgcaaaaagttaactacttcctcctttgaggctatcattgtcaggaataacaggaagggtggctcagactgtgaacatatatgagatattttggatatttcttaattctaaaagaaagatttaaatttagattctgctgatagaattcagattattgtgttattactcatattgtgactttatttatttttttgagatggagtctcactctattgcccaggctggagtgcagtggtgtgatctcagttcatcgcaatctctgcttcctggggttcaagtgattctcctgcctcagcctccctcgtagctgggattatagatgtacaccacaacacctggctaattttttttgaatttttagtagaggcagagtttcaccatgttggccgggctggtctcgaactcctgatttcaaatggtcaggctcagcctccaaaagtgctgggattacaggcatcagccaccatgcctggcaatattgtgactttttaaatcattctttttctctccccaactcccacggacatacatagcctactcgggtcttttgagtttgtgaggctcattgaatttcagattatgccattgatatttaatattcatcattttattgtactagacattatatatattacaagtaaatatatttttataaattatatatgtctttatttttttttactctgtgggctcttatgtcagtttttctgggctcaaatgttaactcttactttgccagctatgtaaccattgagtgagtgagttaagctctctcagtctcatctttttcatctggaaaatggagataataatagtctcattttataaattgattggtaaataacacatgtagcatgcttaatcagtgctaggcacatgtgcctaatatgtgttagtctttattattattctagaaggtgaattttctgagggaaaatactatttgtaattcacctctgtatcctcataatcaggcataattttgatacatagcagacaatgaatacatatttgttgagcaatgaatatatattaactattctcagagtgtcagaacatagttaatgtatgggaaaccaatccagaaataagccttatggtgaaaagattttaaaaattatgatactaatttccttctttctttttcccctcattctgtgaattagaattttgacttagatagaatgcatcaatatataattagatggtgttatcgaatgtgaaatttaataaacaaaaactaatttgttggaattatttgttcagtaaataaatatttatcaagggactagtacatgtagggcattcttgtaggtactggagtcgcaatgttgcattctttgtaactggaatcagacacatttttctacatatttctaagcagagtaaatgacggggtctgctaaggcctggaatctgctctgttttctcctcattaagccttcagggacaaacttagaccagagtgaaaggggaacaagctaagtgtgctgttctctgtcaagtcccatgttgtttgtaccaggatgaccttgactttgtgggaggcatcatccagactcccctgctcagctttctgagcatggattgctgcaggactaggtgtcttccctctctctgtttcttctggttcttagccctattagcctcccttttctcccccaacagaaaatctctttcacagacatggtccaaagtgactctggtaattttcctgattttcaggcttttaaacaaggttggctcttgaagtactacttcagaatagagtgcagctcttggctggctagtcctcttattgcaagccatttccatatctttggcatataatcgacatttgtaagtaaaagccggcttatatgaatcccggttcatctttaattactgactcctgagatccctaggactgaatatctcgccatatgcccattccagaattgtatagtattcttctgctatgcagttgcaatctacccaagccttagagtagaaaatctgattatattctccgtgtactttctctgtcaggaatagtttaccctattataatcttctaaccagcaccctctatgggaaatagtctctctaatatctgagtatggctatgtaatctgagaaacgtcatatagtgaaacttacactgtttaacagtcctttccctgattagcaacattaatcagcaactcagccacccacccctacttatttctgtctcagttgcttcatatgtagaaggagagtgatactagtacctagcgcttaggcttgctgcatggataaaatgaattaacatgtgttgtgcttagcatgcttccagcactttgtaagtgctcaataaatgatagtttttatggttcttattagtattattacatagttcccaagggacaaaaagatattagttgtaagtgttcctaatatattcttttatttaattgggatattgtagattcattaaaaaaacttttgagaacaattttagatttacggaaaagttgcaaagacagtctagagcattcctatgtaccccacacccagtttctcccattgttaacaccggacattactatggtacctttgtcaccactaagaaaccaacattgatacattactatcaactccatactttgttggaattcactggtttttctctcatgtctccatcctgggctcccatgcatgatactaggttaagctcagtcattatgtctccttaggtccccccggcagtgacaatttctgagattttccttgtttttgttgactgtcagttttgaagagtgctggttgggtattttgtagaattctctttgttttgaatttgtcatgatattttttcatggctagactggagttatatgttatcaagaagacagtggaagcaaagtgcccttctcatcacattttatgattaatacagtacatactattaatctgacttatgttgatagtaaccttgatcatctggctgaggtaatattatgtttcttcatggtaaagttaattttactttgttttaaaagaaatttgtcatagatctttgggaggtgtgcaaaatataaaacatctcacatgtcaaatgtaagaataccaaaggcttactttaatagagaagcagaatcctacctctcatttggaatatattccttgaatcctatcagaaccaactattgtgatgaaaagatagaaagcacatcacctcactactgcttccaacatgcttttttgcccctttcttcacacagttggctggaaagctaggcaggtatgaaattggtggtaggaattaaaggagaacatacagcttagaagatttaaataatggcaaatgggtcaggaagaaaattgtgtggtaaacataattaggatgtcagtgaaggaggaatgtctcagggatgaggcttcttactgaagaaatggggtactatgaataaggagggcttgaaggacagggttatgggttaagactaaatgaaatgaggaaacaaactatgtatgaaatggggaaagaacatcctaggtgcaggcatagcaagtataaaggcctagaggctttgctgatgtgttctaagaatggtaaaaatacattctaattgccagtgatttctagatgcttcttaggaacttactctggttatgaactctgcagaaaatttagcctggttctgaactgtgtgaagtcatggatgtgtttttggaccaaaatattgtcatactgtcttaactttgaacaggctaaactcattttttctttcttgacatttttcccaaatgagtctttggaaatactaagaaaaaattaatacagcaaggatttgacttcattgcttactcctggaaattctctaactccccaggaatatccgtggagattttcctctaaaatatattgctctctaaaatgtttcattaactctcagctgtgggttcaatcttgtgatcagcgtgtccagggaagccagagaagcttttgttaagcttgtttatttgtagcaggtgtttgaatttgacatttgatttgacttaaccatattttgggagactgcaaattaagaaagcttctgaaatatgcagaatctgttatgcagaaacatacttacagatatatgggtggaattaaaggaaaaagctttcaataaaactcttctttttacttgaggtttgaaaaggcttgatacttttgtaatgatccacagccagctgatttcagttcaggaggctaaaagggatataataagaaacccgttcttgtaaaatttcagtctgtctgaaacaagtctgagcaggaaatgtttgtgagaaacctgttctctcagagtcttccctcctggttcctcatttcaggaggcttcttccacacccaaatgaatatctgaaaggttagtgattttttttcatccatattaagactattaatagaaaataggctggtgggtccaagttttcaatacagcctagtgacatagcatttcttgtttgctcctgatcagttcaacatggtttcatcattcttgaaagctgactttgatattcaaacttaggaaaactgtaagcatttcatgtccctctctccgttgcagaccctgttcattggcactcccctctaagctgtgaaagcagaaccacatctgtcttgttctctactatgtctctccctcagagaaatgcctgccacatggaatgtgtccagtgaaaatgtattaaatatatgaatgactagtacataacaactgtgtggcatctaatttggagaactcaaaagccataccaggctctaggaattctttacccagaattcaccatctcatgtctccagcattcatgcaattttcatcctaggaatgactcaaattaattactcttaataactcttaaggtaaggaggtagataattttataaaaattatttttatataaatccattaaaacaaaagaatgtcacatgatgtgtttgcaatcagattattactttactactaattttatgttcataagaattatattgccaataagattggtaatagtaataacaataaataatctttagtccttaaaatttaaagccatacactatattagaaccaactaaatattaagtactataatagatgctatggttgaatacagaagaatctaaagaaatagatgtttaattctgagtcatttaataataataataatatttgctgaacacctatcatgtgacaaacactgaactaaatctatacattaaataatttagtcctcataaaaggtctatgagctagttactactggtttccacattttacaaatgaggaagttaaggtttgggaagattaagtaaattgtccattttcaagctaataggaaatgatgaaagtagaagttgaacttgcttttttgatatcacaagctactctttttccttggacatttaacttcattgtttgttcttcaagtttatattttagttgaggattcagaacatacacatgaaatagtacttgccaaacaatacgtaaatgaccatagtaactataatacagatttccaaaacccgagaaggtatgttcaactgaaaaggaaattcatattggaagcatttcctcaagaaagtaagtttgaatccatatgggaaactgggaagtaatttttgtgtaggtgaatataagagatagaccgcaactaattaggttaaaagataagtctttacttttcaaatttataattctaggctcctggttagataatagtaacaacagtaacaaaaataataccactttatatctgtataacatgtaagggtttaagcagacacaatttgattttatttgtagattaatgatccttcgtatgctatgatcctctttaatattagaaaaaagcaactagaacaaacttcatgataaagcttggaaaagcacagtatttgagaaccttaacattcaatatatgctgaagtaatgaaaaccatccatagtcttgccatgaattccttttaaattgcttatgaaattgtgagagtcagcctgcaaattcttcccttctctactccaccctatcccatctcacccagttcccagcacacacacagttctgctatttttgaaaagaaagaaaaaagtctccacattattggtgtggtttctatgatcatgggcagaactgctcagaatattcaccaactatgggagtatacattatctgactcaattcaagtctggtctttgccagtaggaaacccttgtgttaatttctatttctattattgtcaaagatgacacttccacttctctattttatttttgcgtctttcatatttacgaattcaaatttcatattttcttcagaggaggtacatgtgtttgtaataaggaaagtctccaattcatgaggactccttttgtctactttccccttttcagaaaagcgtgttaaattaactaaagaaataattggagaaaaagcaagttagaatattatagaaaagaataaaatgatgaaacatatgtttcattttatttcttttttgagacagagtgagaccttgtctcatatatatatacatatatatataccttgtcatatatataccttgtcatatatatgtcacatatatataccttgtcatatatgtatcagacaaggtctcactctgtcacccaggctggagtgcaatcatgtgattatagctcacttcagccttgaactcctaggctcaagtgatcttcttgcctcagcctcctgagtatatgggactacaagtgtgcaccaccatacctagtaatttgttcattattattattatttgtagagatgagatctcactatatttcccagggtctttttttttaagcatgctgataggatatagataggaatgaaaggggcaacagagatttgcctttacaatgatgtaaaatgctaccaaaccttcagtaataatattcagtcattagtggaattgagtgacagtataaactatgtgtcatagatttctgcattaatccacagtgagtcttagcatttttgtatattttacaacatataggagaaaatagatgttgttaaagagtatctcctgaatttacaaaataataaatttaaaaagcaattgtctatccactccttctataagacataatgaataagagccttgtatgatggcacaaagcaaaccatcattagacaggggtgataagaaagaaaagagtagctttaagccagagggagaaaatagtgaatgagaagaccaagttttatttcaggaataaactggatttataccagaaaaattatttgttttgatatgaaaatcatacctttgggttaacacctctcctagtaatctagattaatttaatatccatttgtaatacattttagtgtccttcataaatgctaaaaataagtgtacttacacatttaccagtgtgtggtcccccatgggaaggaaagggaaataaatagagggattagaagtcacttctgggtcacgtgttccccaataccattttattcttgatcctacatacctactggtgttcacagaataataaaaaataaagactccaaattcctttctaattctagatgcattttttaccttacatgtggtatatttaataaacttaaatatcagagctattccacctcttaatataatatttacatttgaacctgcatagcaaggtggcccttttcattgtattagtgtttagttattttaataaatattgaaattgagtaacagaagcaataacaaaaaatgaatattgaatatatacttattcccactcaaaattaaactaaaatcagttgcatcaagctttcagtcatatttgtgtcaaacatttatgtttttcctaaaagcagtaaacaaaaactaagggtgccaatgtttcttaaccgaaaccttaaaatattatctttatatttggggagatttagaacctgagaacaagatttctatgcattttaaagtgaggcctatttattcttaactgccaaaagaacttatagtaaggatttataaatttaggacaggttggcagtggatgggtaggttaaggctataaaaatgttcattaaatattttttaatgaatgaaattaggtaatctaaattcattcattaaaaaatatttaatgaatgttttctatgctccatacctctttgctaaatcctagagatgtccataatggcgaacaaagccagacccatcctgctgtcttttagctagcagtctagaagggaagaaaatattagttcatcaacaaacgtgtgaaaccgccactgtgagaagtactctgagggggaggtaagtgctgtaatgagtggattttaaacagttggggtgtcagagaagtcttcctcaaggaagatgcctaaatgagatctgcaagttgaataagcagataggtgacaaggtgtgtccctgacagtgaaagcaggagtaggagaacagtgaattgaaaccgacaacactcagacaaatgggaagcaggggctggggacataagtagaaagcagatcatacaggtccttgtaggccacatgaagaatttatctttattctaaggtaggtgacttaatcaaacctcctgccttgcattttgaaagaagcactctagctgctttgtggtgaattggttatagctagtatggggtagttaggttagagggaggcagtcccagcaggcaattattaggcaagtccaggcaagtgatattgtgtcaggggttagtgggagtgggtatggaaaaggtaaagggattcaaaagatctataagagataggtacattgccatggctagatgatagagcggttatgggctctctccctctttatgtatgaattcacatatcatatattactcatattctccatcgacattatataatacacatatactatggatatatgtagataaatgtaaacgtgtaggagtgtgtgtatacatatatgtgtatgtgtgtgtgtgtgtatatatatatatatatatatttatttatttatttatttatttatttcagagtagtgcctaataaaggatgctcaaatagagcaatactttatggttaatatctcttttacagcagatcttcacgctttctcttatttttccctactaagtacagtagtcaggaatttcatgtaaacagacaatatgggataattgagtgaaaatagacggatacattttgtctttattgaaatgattttgaccagtttaagataattacagcacacacattatactttttcacactgaattatgccaagtttcccaaaaccactaatcaaagaagtcatttaaataatgactaaattatgataatgtattacagttgaaatgacaatagagaagaattaaaagtaaagaatgctaaataatgcttaattgccattatctaggtaaaacacaaatgaaatagggtcagcctgaagaatgatattggaaaagtgactgggttctggaattgaggcttaaagttactaaatttttttgttgtattgatttttccctgtcatgatcatacctttctttttgatgaattttgcaacttttataattctgatttgtgacatagttttaaaaaagtgtaaagtataattaaagtttccatgtgcttctcataccaagttttattcagctagctgttaagtaagtgattaccctataagtacaactttaataccctagtcacctgtatgggttctgccactggatgttttattgaagaatttttttgggggtgaatttatatttctcttgtacagggctcattgtttattgaataattggaggtgggttatatctagctataggagataccaatgtttatacaacatgagcacttagatcttttgcatgacatttggatataaatgaaatttccttttgaaaataatgagcaatgggaaatggcatgcattttaaaggatgaattaagttgacacaaagcgctaagatatgttaagattttatggtatgatttactcaagtagggctttggttgactaagatgaacagatcttgtcagcatccctggtaagtgtttgggatgttttgctgtggtatgttttctaaattgtatcactatactttcaagactctaaatgaagcagtgtgctgtttattactgtactacctcaacctgctcatagcagaaggaacattttaaaacacattacaagtgctctctcactcagtctttcatcttctgtccattattaaaaacgacctataagaaatcacatggcaacctagagtagttcagggaaatattgagctttgacttcaagtgtgtcttccttgtaatacaaatagccattttcagttgatatgttctatcctgaatgatttggcttgaaatgtctttctatattaccattaatattttttgtttgtttctgaaacaaatatgaaatggaaatgtcatggacagggaaattttaaatggctacttctgtgactcacagccattttagcttaggcttcctatttgcaataccttcctgacagcagtgtttctttctgcctttttgacaatattatttctgggaaatcaagctaatttctatttttcattccctgttgaaaggattactcatatcctctctcttactcctcatgtgtccttatctctaattaagatgatcaataataataatccatgagactcttttgaaattgtttttcctttaatgaatgctattaactttttcccccatttaactctgtatattgatttttggttccaattctaccacttttatgtaccttttcttttttccaattcttctttcaccttggaatattctttaactctaagaagataaattaattcaagattttatatgtttacagtgttacttataacacaatttatgttatattttaaaaagttttataaagtatttacagactcaatctcatttcatttttttttactatggtagaggtaattgtccttattttggagttgaaaaaatcagggcttagagaaattaagtaagtgacttgcccatggtaatatttttggaaaatgacaaagtcaggacataagctaagcaatattattactttaaaaatatacagcctaatatttagtaaatcagatatgtgaagcaatgcccttggcattggggatagggtagagctaattccacaactgggtattttgactcgatttgtttcaatataaatacaaaacccagatgacattgcttatgcaatcagtttatcaggagttacaggcatacctcattttattaggcttgacctcattgtgcttcacagatatggtgttttgaaggttcgtggcaaccctccttgagcaagtctattggtgtcatttttccaaagtatatacttactttgtgtctctgtgtcgcattttagtaatgcttagaatatttataactttttctcattatctgttagtgtgagctgtgatcagtgacctttgatgttattcttgcaattgttttagggtgccatgaaccatggccaaataaggtagtaaacttaatccgtaaatgttgtgtgtgttctgactgcttcactgaccagccattcccctatttcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgccattcccctatttctttccctctctttaggcctttctattctctaaggcacagcaatattgattttaggccaattaataaccctgcaatgatttctaagtgttcaagtgaaagaaagagtcatgcatctttcaatttaggtggaaagttagaaatgattaagcttagtgagaaaggcatgtccaaagctgaaataggctgatagctagtcatcttgtgtcaaatggtagccaagttgtggatgcaaaggaaaagtttctaaaggaaaagtgctattctagtgaagacccgaatgataagaaaacaaaacagattattgctgatatggaaaaagttttaattggagagaagatcaaaccagccacagcattaccttaaatcaaattctaatccagagcaaggccctaactctcttcaattctgtgaaggtggatagaggtgaaatggctgtagaagaaaaattggaagctagcaggaagttggaagaagaaaacctcacaaaaaaaagttggtttctgaggttttacggaaagaagccatttctgtaacataaaagtataagataaggctgcaaatgctgatggagaatttgcagtaagttatccagaagacttagctagctaagatcattgatgaagatggctacactaaacaacagattttcaatgtagttataaaagccttgaaagatgaaaaatcttgaaagaagatgccatctaggactttcctagatagatagaagtagaagttagtgtttggtttctaagtttcaaagattggccctcttattaggggctaatgcagctggtaactttaagtttaagctaatgctcatttagcattctgaaaatcctggggcccttaaaaattaagctaaatttactctgccagtggtctataaataacagaacaaagcctggatgacagcacatttatttacagaatggttcactgaatattttaagcccactgttgagacctactggtcccttgagatggagtctacacctgagggagatgctatgaaaattgttgaaataacaacaaaggatttagaatattacagaaactgagttgacaaagtagctgcctaggttaaggggacagaatccagttttgaaagaggtattatgtgggtaaaatgctatcaaatagcgtcacattctacagagaaaactcttgtgacaggaagagtcaatctatgcagcaaacttcattgttgtcttacttgaagaaattgctacagccaccctagccttcagcaacccctaccctgatcagtcagcagggatcagcactgaggcaataccctccacaggcagaacagttaagagtcactgaaggctaagatgattgttagcatttttagcaacaaaatatttttaaattaagatatttacatggtttctttagacataatgctattgaacatttaatagactaccatatagtgtaaacataacttttatgtgtgcagggaaacaaaaaaattatgtgactcgctttattgtgatatttcctttattgcagctttctggaacagaacccacaagatctctgaggcatgcctgtccttaatttaccctaatcatggaggtgctttttatttgttttaaaagaaaggaacatcatattaatataaccactgaactcacataaatacaatatgttcttcaaatttctctacatggaataagaatagagcttgcaattttttttttgtatttaactgatagtgtttatggatagcatttaactgatagcattttcagaacaatgggttgagttgaggggtgctgtggcaaccattatatggagccaggctactgatctgtacacagaatggcctcctagtcttggcaaagctttgaacctcatgagtgggccagctaatagaacacgccaagagaccatagtctagctgctgctggagagcttatattgactgctgacgttgataattattctgttaacttatatcgagaaatacttcctctctaaaacccctaacacagagcaagaattataatatctacatcattttagtacattccacaaaataacaagtcatgtactgtatgagttaactgttccatgtcctctaagcacttaggtggaaacttggtgacccccaaatatactggaaaatatttttttccctgaacttttctgtaagaattcttagaaggtagagtgtctgattaatattctagcatagcaatacaagtttagagcccttagttgtgtggaaaatatcttaggagaaaactgtcacagagatttaacccttgggatagtatttagagtggaaacaaaataattacctagagtgttagaacattttcctgatcttaagtttctttgaaaataatatattttgaggtcagtaagtcagagacttctaagaaataatcgagaggacccaagtttgatgctcactggctgttgcttacaattttaaacaagatagtgattaagctctgtacaaaaaaatataaagctatatcattagaagaagctttgtcttgggttcgtgaaatgttttgaaataatgtttgcaatgagtaaactagtttcatattggcattgtgatataaagccttctttaaaacaaataagcaaacaaacaaacacataccccttaggcttgatacgtgtaaatggtagtttagaagatgccttccttttaaatcctatttggccagagaaaaaggctgcagttctacacatttccagcaggggtcaatatgctttcatcattactgaatgctcagtgagcaagcagcagaagtgttgatcctaattggagcagacacaaggatcttctataatcctctgacatccttttcaaataataattcttaggtgggtggtgggctggtggctgcaatgccagtgcaggcttctctacaatgaagcctaaccattgtcaattatttttgatgtatgctagcttaacttaagtctcttcttcctggcttttccaacccacagaagggtattcttcctcctaattattgtcacagtacctaggatggtcagaacaagtgtgttattttggcttgatgtgctctccaaaacccattcctttcctttcctgcctctctgtgctcttcctacaaagtacgaagagcaagcatatactttcagtcaaatatctgaggagtattttacttataaccttaattgccatagtcattggactttaactcattaaatgccagcatttggaggcaactggagatatgataatgagtatatatgattatagttgcatatatatagcttccagtaggttaataattgggactaaatcctcctccacccacacactttctaataatttgttcaggggctctgccagccagtgatattcagggaacaaattgtcatcctttatgtgcattttaaagactggcgtttgctggagactcacactgtcgtgcagaagcttgagttctctgagtcaaaaaaaaaaaaaacaaaaaaaaaaacaatgtatgtcctgccccacattcgtaagctcatattttactctccttggccctgactacagccctttctgctgagcggggaagcgaatgtctctgtgtagagacattttcagaaatccgattctggagagctgaggagtgttgcggcaggaatgtattaccaggacacttagaaggtggttaactgcttgagtgctgctgcctgcactagagagagaagggagggaccgcagttgtaatatagctccagctccactcagcttagccaaagtggggttttaaagcggtgccctcatatatctctgtaggtagtcgggggtgggggtgtcatttgcaaggtaaaacataggtaaaaagtaaggacagagttagcacggcaaaagcagcagttatttatcttgaactaggttcacagggattgagataattttccacttatatagagcttgagaggctcctaaaaataaatattctatcacagatttcagtcagatagaaaggaatatattcattcctacatgtaggtacattttaaatgttctctttaaaattgtggagatttcttttgctttcagagattaccagtaccctttaatgaatcaataataaaaacaaattcatttatctctgttatttgcaaatcttgctttaaaattcatatttaagcaaagcaagtgatgaaattctttgatgggactactccttatctcctttactttaattctatgtttactttaaaaacaaaacttacataccttcctcaaatttagagtaaggtatgaggcataaatgtaagttgatggagaggacagcagctatttcagcttgggtctgacagccatctgacaggtgatactctatgtctctgacggatagtcaagagaagctgggaggaattttgagctcattcttggcagttgcagcagcagattaatttattttttttaaaggtcatcgttagcatgaatggaaaaatgggttggatgcctaataatgcatctcttaaaagaagcatatatttatttagtcaagacgtatttattgagtgcctactatatgccagacactgatagaactattgggctatattgatgaataagataggcaagggctgtattctcatggggcttacattctgcttgttaaaatacacatgctttgaaagtgtataagtatatgttctaaaaaaaacttcagtgcatttttatttcctcatttcacacatttgcttcttcatatttaaaatgtaggctgaaacactccttatattctttgaaggtgaaaaaaatatatcactgcagggtgaactacagaatttcagtgactacagaagtgcttcaaaacctaaattgggaacagagtggatgtaaaatggtttacaaataattagcagattaggatgctttttagttactgcgtccattcataaaactgagcaaagtgtgtctggagcagctgacaccagagttcaaggttgcccatctcctctgcaggaggtcgtgataactaaacatgaccatttcttgttctcacagcatggcttcaggaaaaccaaatggtctctacactcagagtcctgacctcatgaattagaagaagtgaaagaagatggcttccaaattatgtttgaaaacttgtgaggatttaaactctctccatagaacttaccattacacactgaagcaaccttgaatcagaataaattgatgtctgtttcatttatttattcaaatatacctctatactcaaaaaataatcccctaatagaataatttttaggaaaatgtttttgaaaacttagatgaaacccatcatttaagctatgctatctctatcttggcaaatttttcaaggtgtctgggaagcgggaccttgggcatctagcctctatgtaatgggcatgccaatttttacaagcttaactttgaatctttactatccactcacttggagaggaaaaagtccaggaccaaagatcagatccagttttttcttttccctatgaacctttgtcctaactttcatttccctctacttttctcctcaaaagatgtgatatccaacattttcttgttcacagttagcttgaactaataaatagtcacaaactttcagatctccctgctttgaggacttttttactataagaaatcagccaaaatttttaagagtaatgttgaaattttcttttggaaggtgttagaaaatcaggtactctcttatttttgagactcttttaagaaaagaggttatcattttcctaaagcacattttctgtttctagacttattacaactccttgatagataatgtactcttcacaataaatagagagtttaccaacagagaaaatattattgcttctcttaagagttctctctctctcccccacccccttatctttcccctgtccctctcctccctctctccccccacccccatctttctgtctctaaaagactgcgttaatgtttgggcatttattatgcgtgagtatttctctatttcttacatgattgttgattttcttgattattgcaaagttattaaaagttataaatagattttgaaataaaaggagttggttgtgatagagtttttcagaaactgtccaggctgtaattttctgtggatgctaagataaatgtctaaggaaataatcattgcagaaaattattctggtaggcaacttttaagataatttttggttttcagcttggagcagaatatttatttttcactataaggaaacttgcttttattatagtgaattctctccttctctacgaggtgtgagatacaagtgtcatgtaaaatctgtgtattctattgaggcccattaacctgaggcagtgggcagtagctcagaccttaggctatatcttgaaaatgtagtatctccaagttctaattcctcttttacattgttacttgaccttgaagaaaaacagttgaactatttcctttttttttcttatttactaggaaattcaaaccaaatttggaaactatctgtagcaattatatgccttaggaatgcattttgtggcttatgttttgtaactctattttactttttaaccttttcttttcttttgattttattttttcctgttgaattgtatatgtgttcacatataccatctcaaataatgttagaaggaaattagcttataagtaagtacgtaaaattatagttacatttattggtttcttgctagttgttagattttcagttaagcattttatacacactaccacacatgatatacataacaaccccattggtaccatatcagttagaaatgcattcgtttgccagtagctgaatatctagtgaatagtaagctaaataaagaagggagtatttatcttttaacctaacaagaagtctagagaagagtagcagttgacattgatttgaaagctcattggtgtcagatctagcatcactgagattcatttactctttgcttcatgtacttaagatggtttcagtagctcagaacataatgccagtatttaacaaaagaataaggtggaaaggttagaaaagtcatgtgtgttgcttttatcaggaagcaaactttctcctgaaatcttcctctagcttctgcttacatctcatggccagaaatgtgacacatggcccctcttagaacttagaaatagatgctagcaaaaggaaagtgatttgacagtggatatggaaaaggacaattttaaaaatatttaacaactgctacagcacagacactaagaaattagaatggacacactggctataaataattggtagaaacttactagtgagtgtatacagaatataaaccctgagtgcaggattaatctgcagctatttttatccaatgtgctacactgtgtatcccaaaatacatacttttaaaaataatatacctgtatgcatactgatattatattagcactaataaaactagacttcccaggacacattctggtcttgcttgatacctactaaaatgaacacacataatcacttccaaaatatattgaggtaattcagcttttgatcatggcagagcagcttgtactgaactagccgtggcatagataacaattataaattctgggtaaaccttaaatcactagtaacaagtatttgaagactgaagctagagggaagccagcctttgaagataagatggtgcattgggtgagaagcacttcatataaatcaactccaagatgtcacaaagggtatttaggaaacaaagactttaatgagattattaatttgtttaactccggtaatcatttcactagtacatgtatatcaaaacagtgtgtggtatgcctttaatatattcaataataaaacaattatagtcatatttaacagacaggtaggacatcacagccaagaatgaagactataaataagaaccaaatggaaattttggaactgaaaagttcagtaactgagattacaaattgtaatggaaggcttaggaggatattggaaacagcagaaaaaagattcagtgaacactgagatacatcgaaagaaattgtccaatctgagaaacaaaaattgaaaataatgaacagaaccttatcacctatggaacaataggaggtattctaatatgtgcaattagagtactagaagctgagcagagagagagaaaggaaaaaaaagataggagcaaaaataatatttgaatacataataactgaaacatctccaaatttggaggaaaatgtcttacagagtcttaaagttaagcaagcactaacctatatataaattaaaaccccacatggtccagctgccagaaacccatattgaaaacaaccagagaaaaatgacaaattttatatagaggctggtaatatgaatgatggctgacttctcaacagaaataatgacaccaaaagacaatggagaaatgtgtttaaaatgttaagagaaaaaataaaaaagaagagtcagcatacaattgtattcccagtgaaaatatccttaacaaaagaaggtggagtaaaaacattttcagacaaaggaaaacaggaaattcatcactagtagacctgtcttgcaataaatgccaaaaaaaacttcttgaggctgaaggaaaatcacactagatggaaattcatatctataggaaggaatgaagaacattaaatggtaaatataaaatacattctatcacttaatgtcagaatgacataaatgtgtatttcctaacaaagactcagaatacataaagcaaagctgacaaagggaaataaagacaaattcaccattattattagattttaacacactttggcattagtttgggtcttggagaaatagaatccaaggtgggattagatttattgagaaagagagcaaaacaaggagggtacaagaagagaggatgtaagcccaacacctgtggaaagagagaggcaggaaagaggactggagagaagagtaatacaatacagttcaagaaagatttgccagaccaatgaagagctcttgaaccaaagttgctctttggaacagttctctgtcttgccagaaagggcctgcctcagtcctctcaatgtgctcagtaatcagctgtgagcaacctgtagaagcaattttgatgacctgctggaggctgagtgtgcactaatgtgagagtgagaaacttttggaggctacacacttttctaggcttctctttaaacagtactgccaggtgctcatgggggaatatcagagaaagagcctctcatggctctggcagggagaaggaaagaaccagcattaaatatgcccaaaggattcttcatgaaaaggtcctcggaaaaagactttgccagagtccactaccgaaactttttcccagctgaacttctccatattcccattccctccagccttcttgtctcgccaggggaaaagaaaaaaggataatagtcaatagggtgttaggtttcttcttttttttttttttttttttttttttgagacggagtctcgctgtcgcccaggttggagtgcagtggcgcgatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatttcctgacctcgtgatccgcccacctcggcctcccaaagtgctgggattacaggcgtgagccaccgcgcccagccggtgttaggctttaaaaaatagattgataacactacaaccagggaagggagtgcagtgcaagcagaaaaaaactgtaccactggagagactcttctgaagattatagcctcaagatacaggcccactggatgactgaactttaactgggatattatagaatgtcttccctcctcaatgtcttattaccacattaaaatggctctagtaaccgtggattacagttgaaagagctgcaagacacagtctttttctgagcagcagtacataaggaagcccaaaattaaaggggagacaaaaacaaggactctagatccttgcccagatcagtgttgtggagcttttcccttatgttttcttctaatagttttagttataaatcttatgtttaagtctttaatacatttttagttgattttcatgcttcataaatgtaatacaattatgatttgtcaatgaaaaataatattaatgaaaaaggcatcaaaggaatatatgccaaaataattaatctatggcaaatccacagccaacatcgtattgagcaggcaaaagctagaaataaaaaacacgtgaacagaaatgaagaatgcctttcatggaaatattagcagacttgacgtggatgaggaaggaatcaatgatgataaagataagtcaatgaaaatttcccaaactgtgatgcaattagacaaaaataaaataacatccaaacactgagggacaatcttaaaatgtataccatatgtgtgattagaataccagaagaagaaagaaagaatgaactagacaaaagtagttgatataacaatggctgagaacttttcacaaataataacaagcaccaaactacagatccaagaagctcagagaacaccaaatagaacaattcccataatataaacagaatcaacaaaaccctcaaatatactcaggcatattgtagtcaaactgcagaaaatcaaatacaaagagataatattgaaggaaaccacagaagaaaaataaccttacctatagagaaacagggtattatagtggatttcttgtaacaatgtattaagtaaatatagcatgtggataaatgaaataaataacagcagtatcataagacatgagagagaaattaggaatactttgttataacatacttatactatatgtaaagtgctattgtgctatttgaatgtggatttatataagtttaatatatatattgcatatagcaaactctagggcaacaactaaatttaaaaaatgtataattgatatattctaagacactagataaagtgttcaattaaaaccagagaagatagaaatggtagggaatggtggtgggggaggggacaaagagcaaattaaatgcatcgaaaacagttacaaatacggtgcatactaatccagatacatttgtaatcacttatgtgaacagtctacatacatcagttacagagatggacactggattaaaaaacaaaacccaattatattttgtctaccagaaacccactttaaatataaagattcaactaaattaaaagtaaagggatagttaaaggtataccatgccaacactactaaaaagaaaaataaagctgaaatagctatatcaattttagacaaatgagactaaagaacaaggaggagtatcaagaatacaaagggaggttatgtaatcatgaaggagtccattttccaagatgatctaacaatcctaactatctgtggacctaacaaccaagctttgaaataaatgaggcaagaactgagaagagacatagacaaatcatatatccactattacagttggaaactctgtctatatttgatagattaaacaggcagaaaatcagtaaagatagaaataactgaaatagcactgtcaatcaacttaatctattcaacatatatagaatacttcatataacaagagcagagtacacattttctgaagtccacttggaccatatgtcaagatagatcacattctgaaccagaaaatacaccttaacaaatttaaaataataaaaattatataaaatacattttttccaaccagatgaaatgaaactaaaaattattatcagaaagatatagttcagttttgtttcttaatccactgtgacaatctctgtcttttttttttttttttgagacagagtctcactctgtcacccaggctggagtgcagtggtgctatctcggctcactgcggcccctgtctcctgggttcaagcaattctcctgcatcagcctcctgagtagctgggattacaggtgcctgccaccatgcccatctaattttcgtatttttagtagagacggggtttcaccatgttggccaggctggtctagaactcctgatctcaaatgatccacctgccttggcctcccaaagtgctggtatttcaggtatgagccaccacgcctggcccgatctcgtttaatcaatgtatgtagactattcatatataaagtgattacaaatgtagctggattagtatgtaccatatttgtaactgttttctactcatttaatttggtctttgctccttcccctactaccattccaaattctaaactattgggagactaagccataaacattgaagtaacatatgagttcaagaaaaattagatattaaaaatattttgaactcaatgtaaaaatacataatgttatagcatgaaatacatatattacaaaagaagaaaggtctagagtcaatattaaactaaatatcacctttggagtctaggaagagtaaattaaagccaaacaaaaataatgaaagaaataataaagcttagagaaaattttaaaaaatgaaatttggagccagctgaaagagctcccaatggccaaagctggaacaatttgaacaataaaatatagtagttatgcagccataaggaatgagatcatgtcccttgcagggacatggatgaagctggaagccatcatcctcagcaaactaacacaggaacagaaaaccaaacaccacgtgttctcactcgtaagtgggagctgaacaatgagaacacatggacacagggaggggaacaacatacactgaggtctgtgcgaggggtgaggggaaagagagcatcagaataaatagctaatgcatgaggggcttaatacctaggtgatgggttgataggtgccgcaaaccaccgtggcacatgtttacctatgtagcaaaccagcacgtccgtacatgtattctagaacttaaagtaaatctaagtcatatacgtagtagtattggattataactgaaaatacaaaataggttcatgctgatatacataaatgatgaaataaataaatggcacaaatagacaaatctgtgtggaacaatttcagataatttatgcacatacttcatcctcaaagaagtagcatattacttccctttccttaagtgtgggttggacacagagacttttcttcccaaatactttagtataaaaaaggagaaaaaaaacaacaagctctagcttggccaggtaatcaaagtaatcaataataagtcatattgatagtatatacccttgatgtgatatgataagaatgtcatttacctctgtcatctccctcctaaaacacccataaccccagacagattatgataaaaaatcccaattgatagatattctacaaaatatctgaccaatatttctcaaaattgtcaagatcatcaaaaacaagaaaagtctgagaaactgtcacagccaagaagacgtcatgactacatgtaatataatatcctggacaaaatcttggaataaaaaaatagtattaggtaaatgtttattaaaaaatcttaaactgtgggatttagtaaattgttctttaattttaacatatgtagcatattaatgtaagatattaataaaggaaaattacatatgggatacatgggtattctcactatcatcacaattttttataggtttaaactattttatttaaaattattattattttttgaggcaagtatttcattctgttgcccgggctggagtgcgttcgtgcaatctcagctcactgcagtgtcgaccttccagggctcaaacaatcctcccacttcagctcccaagtagctgagactacagacgcatgccacatgcctagctagttttttaattttttgtagagacaggaatttgctatgttgccagggctggtctcaaacacctgagctcaagaaatcctcccacttcgacctcacaaagtgttgggatcacagacgtgagccactgtgcctggcctacaactatgttaaataattatcgtttaaaaagtcataaggagcagcttggagggcttcccattggccaaacgtggaacaaattattattaaaatacaaataatataatggatatgatccattgaataaaataaaaatacacgagttcttactgatataaataaacaactaaacaattgagagagaaaggaatccctttacagtaaaatatcaactaatgatgtagaaagagttatggaattagaatattatcaatggattctaaaactagtgaatgaatgtttgatgaggaataggaaatttacatgttctcaaatattgccccacaaatgactaataactacagtggaaaaattattaacttgataattgagaaaccaccttaaccacgggaccaaagttaacattaccaatattggtctcattgctatcatgtgcttcctgctgtgatatactgggaagtatttatcatcatgtccatgatatacctgacaaaaaggaatcatatgaatttaactatgtagaagcatcagacaaacccaaattgatagaagttctacaaaaacaagtcagcacagtagtctccccttgtctgcagttttgctttccctggtttcagttacctgttgtcaactgcagtctgaaagtattatggtattttgagaaagaaagagaaagagaccatgatcacgtaacttatttacaaattatactttatcataggtatgtatctataggagaaaacataaggattgggtactatccatggtttcaggcattcactgggtgtctgggaaggcgtctcccatggatagagtgggacaactgtacttttaaaagtatcaaggtcaggccgggcgtggtggctcatgcctataatctcagcactttgggaggccgaagcaggcggatcatttgagggtaggtgttcgagaccagcctgggcaacatggtgaaaccctgtctctactaaaaataaataaataaaaaaaaattagctgggcgtggtggtgggtgcctataatcccagctactcgggagactggagaggctgaggcaggagaattgcttgaacctgggaggcggaggttgcagtgagctgagatggcgcccctgtagtccagccagggtgacagagcgagactcatctcaaacaaacaaacacaaagaaagactctcatgacacttaaaaacctttctaaaatgtaaatattctctatctcatgatcacaaacagtatttcacattctaattgatattgccagctacacgggaggccgaggcaggagaatcacttgaatcctgggagccggaggctgcagtgagccaggattgcaccagtgagccaggattgcaccactgcactccaggctgggcaacagagtgactgtctcaaaaaaaaaaaaaaaaaaagtattgaggccataaacaaagacaaactgtgttatgggttaaatgacactgaagagttataacaactaactttaagtcatgatactagattggatcctggcctggaaaaaatagctattaaatgtattattgtgatatatgatgaaattgtgtatggactatgaattagacaatagtatattaaacgtactactatgctaaacattctgattttgatcgttgtactatggttatgtaacagaatgccctttttgggggaaaatcactgaaatattttaagagaaaaaggtacaatatttcaatctattctcaaatggttccaaaatattattcatatttctgtctctcattccattcacctatctatcatcaatcatctattgagaaaattataaagtagattatgttaaataatagtaaatttggataaagaatgtatggcagttccttgtgccattcttgtaatgcttctgtaatttggaaattatataagaataaaaagtcacaaagtaagttctgtggggactctgacctttaggcacttggtactcaaaatgtggtccatacaccattggtattgccataatctgtgagcatttctaaatccctagtctcattccacacccatgatcgactctagcagaatttgcattataaccacatcaccagttaattttaattaacattaaagactaaacagcttgttctttgaaactttatttctgtaaaagtattcagcaccacctgcaggtgctgtagaaattcagaatagtttgtcattaacccttttgtatcaccagattggccccacggatgtgccacccccattgccatttctcttcttcactcatgttcctttctggtgtacatcctacaataatgcattcagatatgttccattcagtgaaatcagcttaatgtatctcctgcctttattttatctattctcatttaagactcggtttgaaccttacctcacccataaacactttttaaaactccttagacatctttaaacttctgtgacactgtaagtcttaagaaacaatttgatcttttactttttattgtgtgctattttattgttcttttcatgaattccaaatggattgtatgtgtcctgcagttatggatcagattttatgaactagaacctgtccttctggttctctattacaattatctccacaataaaacaatatggtgtttattttctaaagtgtgaggaaaagcattcattaggaagagaaaaaatattaaagtttctggttgtttatcaaaaatggaaaaaagaatatattttattagtaattgatagattgacagtatatatataattcatagttttataaaatatgtttagagatataagctcaatactttttgctgatatgggcatgtaattgaaaaagtttggagaccactgctttagagtgctatagaaaatattcattatatactttgtattacatttagtaatgaaaaaaacactgaaggaggaggcaatgacaatcagtgtttggcctgagtcctcattatggatactttgggttcagagactaacccattcattaccagctaggaatatggctatgggaataattattagatgacaatttactaaaattactataataaattagtattcaaatgtctatttaccagtggcttctcattttattaatatattgggcatcctagcacaacctggcatcaaatcaaataaactcagagattttatggttgtaggaaagatgaagcatttttttgtaaaatcttttatctagtttcatattcaccttttataaatattagcccttaaaaataatacactagagctaatctcattaaattttatttgatgaagtcctgatgtagctccttgttgactaagagatataaagcagaacttctgtcattcctgaaatctaaagaccctttgttagagtagatggaaatagctaatttgagtgattgtatctttgaaatatttgacatattattactttcaagacacaaattaacttagattatttctaattttgagtagaaattctgatttgggacatcaacaaattatgttatttgcacatgaataggtacttccagttttaaaactagttcttttaagtaaacattacaaatcaacaacatctatcttagactactatcacatttacactcaccgttgtttcttagtgcatttgcaaactttacacttaaagttaaaattaaatcagtaatttaaaaagtagtatctaaagatctcagtatctaagtaagttttgtttcaccagctgtaacttaaactgaaagtcctatcttttcagttagatccctacagccattttccacaatgtctctcaatgccctacattttcatcattaaaaataacacctttatgaacacacacacacacacacacacctgcatcccccctacccccaacaagacaggacttctgatatgccttttaaaaatacactaagtgatgctattcactgaagtttggccctgcttaatccaagtttcaaacattacttacatatttgattcaggtaactgaggagtttaaaactgggtttaagagcagttgaaaaagcagttatcttttaagaaattttctgaaatagctgctgtatctcaaaaaaaagagaaagtttaatagtattattagctttcttgtaaagttaatattttgattatagttgataattttttttccttatttgtgtttataatcttaaaatcaggactctaactcatctgttaatgtttatttttcatgtatgtgtatatatatatatgtttgtaattttatatatatatatacacacacacacacatatatccacatagccatatatgtatacacatgactgtccagtcatgtgtcacttaatgacagggatatgttctgagaaatgcatttggtgattttctcatcatgtgaacatcgttgagtgtacctttacgaacctagatggtacagcctactatacacctaggctatatggtatagcctattgatcctaggctacaaacctatatacatgtttctatactcaatactataggcaattataacacaatgataagtatttgtgtatctgaacatagaaaaagtacagtaaaaatatggtagaaacaatgatgcccctctatagggcacttaacatgaatggagcttgcaggactagaagtttctctgggtgagtcagtgagtcagtggtgagtgaatataaaggcccagggtattattatacactactgtagactttataaatactgtatacttagactacattaaatttattaaaaatttcttcaataataaattaatcttagcttactctaacttttctactttacaaactgtatttttttcactttttaacttttttgtaataatagcgtaaaacacaaacacatttgtacagctatacaaaaatattttctttgtatccttattctataagcttttttctattttaaaattatttttatttttaactttctacacttttttgttaaaaactaagacacaaacacacacattagcctaggcctacataggatcagaatcatcaatatcattgtcatccacctccacatcttgtcccattggaaggtcttcagtggggataacatgcacggagatgtcatttcctataagaataccttcttctggaatactttctgaagaactgcctgaggctgttttacagttaacttttgtttttaacaagtagaagtgtactctaaagtaatgataaaaagtatagcatagtaaatacataaaacagtaacatagtcatttgttgtctttattaagtagtaggtactgtatataattgtacctgatatactcttatatgactggcagcacaataggtttttttataccagctccaccataacatgtgagtagtgtgttgtgctacaatgttaccctgactaccactagataggaatttttcagctccattataatcttatgggatcgttgtatatgtatccatcattgatgaaaacattgctatggggtgcccgactatattcataaagtgtacatacacttttaaaatgagtaaatgaaagtattattcccataaaatgtcattgctccagcataggtgccaaattaaaatctcttttgttattgccaacttaaggaaaacactaagtttttggaaatttaggatttttttttttttttttgtagttttagaggtaggacttcatttttatgaaaactactgcactctattggtaattgccaaaaattctcgaggacttaaaattttggcttcgttgttgcacctacaggacaaattctgttatgtgctgggtcattctgtctttcaaaaataattagcagtggcaaatgcgaccccaatggtcacagatgccaaactagtgcacttctgatttcagttcatactgtggagttatctgcactctgaaaccaaaatgatttgattaacttgttattttgtcaggcagaaactctattaggagctgcataataattgctgtattttggatatatgttttattacctcatttttccagctttaaaatacgcttaatatttttcttttaaaaactttaaaaagtttttgcttattaaagtaaaatatgctaaaattaaccaaagctaaagtcctcattaactctcttcattttatttatgtactttgagaatcttgtacttccttgggaactctttctgcttcagtcaaccccacctattcccatttctgttgcagaataggtctctttttctgtttttgtgctattaaaatttttttctctacctgagaagaagcctagagaaaaaaaattcaactgtttattgatctgtatgctaagttgtatactcgctatgagtggcatgttgtatgtttgtattgggtagaatgtgggaatagaatgggaatatataaagataaataatatacggctgtgatcctgtagtactttatcttctgtaggcagagtcaaaaatagagaattacattaagaaactctgtgaaaggagtaataacatacaatgaatatagcaggagagagcataaggacaaatagttttgatgagtaaagaggaaaattaatttgtataaaaatatttaaatatttgagtggcaactatgttaaaaatattttatataggagctggggatagagtgaagaataagaatgttctctgaatttagggagcacacattctagtgaggggacactgacaataaacaagtaaaaaaaagcaaacaagttattttagacaatggtaagtcccactgatgacaacaaaacaggaaatattggagaatgtctgggagcttctccaggtaagatggcagggaatgtgatatggtttgtctgtgtcccccatccaaatctcaacttgaattttatctcccagacttcccacatttccacatgttgtgggagggacccaaggggaggtaactgaatcatgggggcctgtctttcccatgctattctcatgatactgaataagtttcatgagatctgatgggtttatcaggggtttctgcttttgtttcctcctatttttctcttgccaccaccatgtaagacgtgcctttcaccttcttccatgattctgaggcctccccagtcatgtggaactataagtaaaaagcaaaatccctgcctgtcttgcgtatgtctttatcagtggcatgaaaatgaactaatacagtaaattgctaccagtaaagtggggcattgctgaaaagataccagaaaatgtggaagtgactttggaaatcagtaacaggcagagactggaacagttcaaagtgctcagaagaagacagggaaatgtgggaaagtttggaacttcctagagacttgttgaatggctctgctcaaaatggggatagtgatatggacaataaaatccaggctggggtggtctcatgtggagatgaggaacttgttgagaactggagcaaagttgacccttgttacattttagcaaagagactggcggcattttgcccctaccctagagatttgtggaactttgaacttgagagagatgatttagagtatctgacggaaaacatttctaagcagcgaagcattcaagaggtgactttggtgctgttaaaggcattcagttttataagggaagcaggacataaaagtttgggaaatttgcagcctgagcatatgatagaaaagaaaaacccattttctggggagaaattcaagccagctgcagaaatttgcgtaagtagcaagaagcctaatgttaatccccaagacaatggggaaaatgtctctaggccatgtcagagacctttatggtagctcctcccatcataggcctggaggcctaggaggaaaacatggttttgtgggctgggtccaggatacccatgctgtgtgcagcctagggacttaccctatgtccccccaggcactctagctgtggttgaaaggggccaacgtacagcttgggctgtggcttcagagggtggaaaccccaagccttggcaacttccatgtgtcattgagcctgcgggtgcacagaagtcaagaattgaggtttgggaacctccacttagattgcagaaggtgtatggaaatgcctggatgcccaggcaaaagtttgctgcagggtggggtcctcatggagaacctctgctagggcagtgcggaatggaaatgtggggtcgtagcccccacacagagtcccgactggggcaccacctagtggagctgtgagaaaagggccaccatcctccagaccccagaatgccagatccactgatagcttgctccgtgtgcctggaaaagttgcagacaatcaacaccagcccattagagcagccaggagggaggctgtaccctgcaaacccacaggggtggagctgcccaagaccatgagaacccaccttttggatcagtgtgacctggatgggagacctggagtcaaaggagatcatttaggagctttaaaatttgactgccttactggatttcagacttgcatgggccctgtaaccccttggttttggccaatttctcccacatggaacagctgtatttacccaatttctgtacccccactgtaactaggaagtaactagcttgcttttgattttacaggctcataggcggaagtgacttgccttgtctcagatgagactttggactgtggacttttgggttaatgctgaaatgagttaagactttgtgggactgttggggaggcatgattggttttgaaatgtgagatgagatttatatgggccaggggcagaatgatatggtttggctctttgtccccacccaactctcaacttgaattttatctcccagaattcctatgtgttgtgggagggacccagggggaggtaattgaatcatgggggctggtctttcctatgctattctcatggcagtgaataagtctcctgagatctgatgggtttatcaggggtttctgcatttgcttcctcctcattttctcttgccaccaccatgtaagaaatgcctttcacctcctgccaggattctgaggaccccctagccatgtggaactgtaagtccagttaaatctctttttcttcccaatctttggtatgtctttattagtggcatgaaaacaaactaatacagaagccttcatttagggggtgacatgagagctatgagtgagttgatattcattttatcttcccttctccacttttcctcaaaactaagttgatatctggtctcccagaattgctgccctatctcctaacatgtcttcactgtcaagtttctggaaagtctagttgaatcaatttatcctccatattgatgatataaacatctaattactagcccaggtctgactcctgaatgacacagcaaagatccattggaattatccacttggctgtctcaaaggcaaattgaatgtcacactgcataatatactcttcatcttgtatagtccatcttggttttggttacctactacacaatgcttcaagtcatctttgactttcccccatctagtttgtgatgaatacctttcaattctgcctctatcatatgaccttcttttttctatgttctactaccattgacatggccttagttcagacacttgttatatctctccctgagtctactagagccttctgaccaatctctgtattttcaagtatgcttccatactctttttatttgcactgaggcaggtataaaaggagttataatccaaaactcttaagcatatttccattcttcttaaaatgtatcaatggctctctttgcctctaagatgaaatccaaactctttagcatcaccataaagcatttcatgtcctgagccctgtatatctcccagacacatgtctccattcttccccattctccattcctgaactctgtgcagtgatgagctgcaagagatggttctttttttagttcttgttctaaacacgcaagttctttcttcatttcttattttcaaataacatataataccataaattctattttaaacaatatttactttgacctctatgggaactaaaatatgatatttatgaaataaaattaatatactctagggtttactaaagactgtaatttagtgttttattacaaagtcttgttaccactactcatgtgcacattcagatagaaggtccacattttgagaagtaggttctattagtgggttgtctttgttgtgagttagtagtggttttccagctgctgtgattctgacttggattgtctttattgtaagttttagtattcctgtggattattttatttaacctacagggttgtcttaggccatttttgcatttctataaaggaataccagagacagggtaatttacaaagaaaagaggtttaattggctcattttctacaggctgtacaagcatggcactggcattggctcagcttctggggaggcttcagggagcttttactcatggtggaaggtgaagtggaaggaggcacttcacatggtgagaacaggagcaagagagtgagagggggaagatgccacatacttacgtagctagatctcacaagaactcactatcacaaggacagcacaaagggcatgtctgaagtattcatgagaaatctgcccctgtgatccagtcacctcccaccaggccccaccttcaacactgggaattacaatttaacatgagatttagacataacatccaaactatatcaaaggtgcagtagaacaaatctatatggccgatggttttttaaacaccaatttctaagagagtttaaactatagtttatgtgtgaaatatttatattttattactaaagctagtgtatatacatagtttatatgctctaaatttatttgtacaataattcttcatcagaatgcactgcctgtgaatatgcgctatttaaatgattttctaagtgatacaatgtctgcaagccgtattgcagacaaaagtctcatcttcctaatatataaataactcccataaattgatagaaataaaaaagaccaattactgcattaaaaaatggacaatagatgtgaacaaacatgtatgggtaagggagtacaagtgactcataaacatatggtaagacatataaattaaaaccatactgaaatattatgtatcaaccataaaattagtaaaagttctaatgctcagtaatactttctgcttttgagaccttggcatatacatttgtgtaacctgtatttaaggcaacttggttataaatattaacataacagtacttatatattttgatctagcaattcacttggaaaactattctagatatacttgcgtatgttggaaataatgtatatataatgccattaatatatatatagagagactttcactgtatagatttgaatttaaaaagtaactatattttcaaatttataaccttatgagttatttattaaaattaatttataatagcgtgttcttctctatgcatatcaagcagctcactttttattatgtgatgtttatcattatcaaatgattaagttagcgcatgtcaactttcttcactgtaaagttattttttcttttgtaattaatagttgctagtaggagatactttatgaataggtaaattctgtttctcaaacttttgtccacaaattttgtccacaattttttgccaaatttgtagatgttgtctgcaacagtttggtacagaaaattgtgtggtgttcgcctaatgttgattttttattttctccttttaattcattaagttgaattttcttgcaagagccattctttttcccatttatttacttactcaattatttatgtaaatatatacttatgattttattttatagattaaaattcaataccatcattatttgctgctcatatccattcagcattggtcattaagaccattaggtctttaggtcattaagtccgactggctcctgtgttctttcaaaatgctcccatcttcttctgagcattttcttactttcccacaccaccagatattccagtgttacctaggattttctctgtctcagccctgcaatgaactacttaaagtgtccctagaggcatcatattttgtgccaatcatgcaagaaatgtgaaatattctaagcgtgagaaaacattagacaaagccatattgagggaaattctacaaaataactgattagtattcttcaaatatgaaatgaataaaaaacaaggaaagactaaggagctgttacagactggaaggcagaaggggaagtaaccattcagtgcaaggtaggattctgaataagatcctggaatagagacatgagtggaaaatttgctgaaattgaaataatatctatggtttaattgataatgtaacaatctttatttcttgtttttcgtaattacagtatagttatgtaagatgttaacattgtggaaaatgtggtgagagatacaagaaaactcttgtagtttcacaacttttccatgtctaaaattaattcaagtaaaaagttaaaaatagtaaattaaaaaagcataacactcattaaagtagtctggaaagctctccaaaatatattttaattttgggaaagaaaagttcaccaactgtatatatgtgtggaaatatatctgtttgtgaatgcatataatacccttggaaggacacacaggaaactaaatatatgtaacctctgtggggatattgggagacagggagtaaaacttaatttttttttcttctttttttttcaatcatgtgcatgtactgcctgtacaaaaaagcaaaattaaaaaaactggcattatattgctaaaataagtataacgatttacagagttaattttaaatgtgtagattattatttaaacatataaatatatgcagtaatattatcatattaataaaaagaatacatgttaacattaaaagtttactgaaacttatttatttcatatcttttaaattttttaatcacttttttccctaaggagaggaaatagttgttttagaagggctgtaaatgacgagttaatgggtgcagcacaccaacatggcacacgtatacatatgtaactaacctgcacattgtgcacatgtaccctaaaacgtaaagtataataaaaagaaaaaagaaaaaaaaattgagtactatgcttagtacccaggtgacaaaataatctgtacaccaaactcccaagtcacaagtatacctgtataacaaacctgcacatctaaccctgaacctaaaataccagttaaaaaaaaaaaaagaataaaataccaaaacagttaaaaagaaaaagaaaaaagaaaaagaagggctgtaggtcttggactccacccaattggcctgtaaattgtaaaatgcttgatcaccactgatgtaaagctctgctttctctcaataattgattctttttcacagctattctcttgcctagaatgccttcctgacctttttattacctggctatctcctcttctttgaagctcaacttacatattatcttctccagaaagctttttctgatccctaaaccccaaatttggacttgaaaccaatcttatatgcttccattatactgtgtgtttatctctgtcataacctccactgtattataattatttatttttgtctctttgttagattatatgcaatttaaggtagtgattagattattatatttgtatctaccattcataattcagagaatgacagtcttgcaattaatgtaagtttaaaatacaaatctagaaatctcatgcttcctggaatgagcagatcaaaacaggattaagtcatgtatatgaaaacagagtgaaatcacaaggtctaaggcctgaatacattacacaaaatttaaataaaatagtagataatagcacttgcagtaatcttagtgatgaacaaccagatcccactttttattcttgtaacttgctatctatgttagtttctttggactttgtgaaacagattcaatcagcagaagaaaagcttattctgacatttcagttggggtgataagtgtgcaaattagaaggcacgtggaccaaattcatgaatcctgaaaggtgctcctttgtccacgccaccataacactaaatgtaggctgtgtatcactgctgtctcccagcctggtcctgacacttctgcaaaaggacagcccttacaaacattcaatgtggtcctagacaagagacattaaacgtcacaggaacctcagaacaattagatacccagaagataagttcggatccactgtagtactgggagcctagtagtaagagtactgggtatccttccgataactctccccatgctgtctttctcagtgtgtctgtttgcttctactcctattaccaataggctccttctaatctgcatatattaaaaacaaaaagcagggcaaaaacattatctcacagcttctaaataaattttgtgatttatcctaatcctgactttgaagatcctcatggcctctacttggggtttctctttatatatagatttttcagccttagttctcactacctcattctccttctattttgcagttttgtttctgtagacagtataaccgaacctgctcatttattgcatgtgtatgtgagtgtatgtgtctaggttatggattcttggcttatgaaatagctactttcgaataggttaggattccacatttgatagtctcagttatagctagaggagggggttgggaggtgagatggggcttctttttttcaaatatgacctcctaaatgtgacacagcctacttttagtgttatggtggccagcattctgaaaaaaaaatcaaaatcagaaaatataatggacaaaattaagattacagttctttaggcattgctggtctatagaacaaaattgagttggaaataaggcaaaaataaaatgttaggttttaaaagtcaaattacatagatgttgcacttgtttgtttatatacatagtaaaatgaaagtcctggggatcaataactgctgtggatgtgttaagtttaacaccttatacaccacggacattccatcaatattgaacaagtgttttaacagctggagctatttcacatgatgcattttttttctctcttttcctgttagtgttcttaagcttgcttatacttgttttaataaatatttcacataagtttctagaactccaaatttaatgtctatgaaaacatcctgaaatttaaacatctgaacctcatttaaggtatttttagatagttattcattaattttttctttgcaatgaagtaatatttttcaaagttattgttatttgaaaatgcacaagcaaaccaagatattggtgctatttttctctgaagatcttaagatttctttctacagttatttaaagaatatgctaaatcattccttttctttctttttccaacatctgggacagaattcttttatgatagacctcaatagttattcaataatctctctttctcactctcaatgtagcaccagaagtatagatattatttgggttgggttcacgtctataatatagtatatttaaggtgttatagaaaaaagtccacatatgcagattttatacttgcaacttcaagaaatgtaattccttgtataaatgaaagtgattcaaagttcacagctcctagcaaaaattttagatgttgtaaataatgaagataaatcttacagacttagtgtgaagaaagtgattctcaagtagtaacgctgtttgctaattgcataccaccaagtttaatccacttaaaaatggttatagcttcaggcaccatttctatgctgttggtttccaatatctattttcaattgaactcatttccctaagcttcaggcccatataatcaagtgcctactggacatttctatttgggtattctacaaagaactgaataaaaattgtaccaacatatccttgtcagtttgccatctcatttgcctgggttcctattttattgaatgacacgggcatctacttagctcttcaaagcagaaatttactatcttcctttctttcatcctcatattggatatgtctcccaaataaccaaatcttggtttttctacctgagaaatatttcttaaatacaagttttctatttatttttatgtgtagtcctcaagctaccaatttctttcattttaaatactgcaattattttaacttaaatactgcaagtaatgtctctaacctcattttgtaaagtttttttcctctctgaagccagagtgatttttctaagatgtgaacctgggcatttctctttactgcatgctctttaacaggatctctctcaccctcacagtatattttagctttcctgaaattattttgttttactgactacaccagtctcacactttgctctaggcctgttcgcttactgcctgtttatctgagaaacactttcttagtttctttgtctggctaatccttaccaatgctttggccatctgcttcaaagttatttgtgtagaattcttcagttttacaaggttaaatatttcacctaggaacatccagactactctcttatgattttgaactaaaattgtttattcaattgacgtttgccttgtaggttataaatgttatgaggatgtaaaccatgtctactttcttcatcctcttaactccaacatctacaagaatttctgtacctagtaggtttcaatagatgcttgttaaatgaatgaatgatggaaagtgttctgatttaacatcttaaatttcatgatagtatatgcttaattgattatcagataacacaagtcttcccataattgctatggagaggacacttttttcacaatcctaatgattcttgccatgtgaacaattcctttcacataacaatcatggcctatctccccatcataacatgctttttttctggagggactgagtgggttatgtgattgctgtattttggaggaataagttgaatatgctagctcagtcatttcttttttgtatttctctttgggtccaaacctatttacagagagcatgcagtctgctctgcttttttatgtgtaaggctgacaaaagcagaatctcatataagaaggtctatggtgacttagtgctgcctgtgtctaggttggtgtctgttaaaatctaggttcacaaacataaattctgcttgctacagataagtctcattttctcttatcagattgtttagcattaacagcaatatctgtattaagttttctatttccctttctctcttttgttttttagctggttcagaaaaaaaaagaatgttatatattgggcctcattgcatcccaacattgtcacgatagcattactgcattctaagcttatttcattcatgtattcatttaggcagcacatacttattgtgtcactactatttgccaggtaatctcaaggaagattaatttttccacttgagctttaaaaactagaaataggcattagagagttcatgattccatttccactggaatataaacttcatgttgaagttaggttggctagtattggagttcatattctaaatgaatttcaaagtatgtacagtttagtttgaaaatattctgtttgattgttcatcttagggaactagtttatgtatttttttcctttgccattactcctcttaattcttctaggtaagtagaataaactgttctttaggctcctaaatgtttccaacattgtatctctgccttcaattaatttaatttgtacttaaagaatatctaaaactacatttaagcaaaaacagtttccatggaaacatcatagactgtctaaattcagactatgatgtaatcaactaaaatgactatcatacctaaatccttgtttatttcatctgtagtatattttatttaaatctattgtatcaaacacagattttccacatctgaatttaatttggaggtataggacattttctcattgtttctattttagaaacttgtgtttgatttcacagtattttagaattcacatttctgctagagttaagatatcgacagaatgggctggattatgtagaatgtaactatatgatgttgacctagttttacaaaattatagaaattttctacccatgctgacagagtgtggaatgtcactgtagtcaaaaatattatggaagagtgaatcttacacactaaattcattgttaactgtttgacttattaacatcttacgaggtagttgagaatcttgcccttgactttctaaagtatacaatctaataagactatttttgacatatatatatagacatatatatatatatatatagacatatatatatatatatatatagacatatatatatatatatatataatatcaattattgatttaattgctttttctttaaggagtagttgtgaataaccattctatatatactggtatacaattgacactactctgtatagcactgtactgtaatggtgaaaaatgtcaagatctttgcatttgagttcagattttagatatttgtttgtgtaagtcttgccttttgagcctgtaaactctggagggataatttcaaaagtggcttttctttgcttatataaaattattcttcttttgcttttgtttctcacttatggcctcagttagaaacataaagatatgcaggatagactatccagagtatttgtttgtggaaatagtgtagttatttcctagaggataaaagaaatatagagaaagaagaaaaagtccttatatatgttactgctgtccaagatgcccatgtaaggccccagaagagttcgaaatggtcagggcatttatggagctatagttcagtgggaatgctttataataatttcccaagatacacctggttgcttttttctctctacatttacagaagattactcattttatagcatatcatatatataatattattatatctgtaaatatctcttctacaagtctcaaagttccaaaaggataagatgttgcaagaaagcagttatcaatgttggcaacagtttcagagagatcaaataaggatgaaaatgcattgggtttgagaaatttggagattacaggtgatatttgttagaatagattcaggaaggtgttgggtatatttcctcagccctcagggtaaatacaccattccatgggtatatttcttcagtactcagggtaaatacaccattccatgtactctatacgtagagagtttaatgtaaaattaggggtttacagaacttgttggaagactgatggaatgaagctcagggaatttgccactgaggataagggaagctgttgcccaacagtaggagaaattgaccctgaagatcacagtctaataaactaaagcaaatcattttaaaagctgctagaaactggtagatgtcctcaacaatctgtgggaagctcccagcaactgtctcagtttgtgaagaagatgggtctcaagagcttctctgaaagccatggtgactcacctctctatatctctctcatatgtcaattgcttctagggaatgtggcttctgcttcacttcaggcaagttctcatctgaatatctcacattgataaattttaacctagaaccaggttgtgaggaatgaatttcacaggctttgataagagtgatagtagtactgagttgataacaaacagtccaggtccagagtgtgagcaagagtggttaccatgacttaagagaagaagtagatgagaaaatagacttttttttttcttaaaagaaaattgatagaataagaatgagggataatagggcatattagaggtcagcaaatgatttagattttttttgttgttgcttttaaggagtggtaatacctggctagatttttatgcagaagggaagaagctagtagagaaggacagattgtagtatgataaaatgaggtgattgttaatgaggcaaggtttctgaaggaggtgggagaggttgagagcaatgcataattggggagtttagttttgaatatgaggcaggacaagcctttctataaaactgcaaatgagacagcgtggtgcaaaaatagattaatttattggatttggagtgatgaattgagggaatgtatgggtgatgacctctattttctctgtgaagtaggaagtaatgatgcctgctgagaggagatctggcaggggttaattttgagaagagtggacctgtttgaaataatgctgaggggaatggagataagagttatccatgaacaaagaaaagattgctgcatttactgaaagcccagagaaggccagagcccatacatgggcagtggcatcaatccgcatagctgctggattttccttacctgagcttaccatctttgatgaatttatagctcacttgggttcctcttttctgtgatgttaatgagtgtcctgtgcttgtcttcctcttggacattccccggacagcaaaaattgcctatttggtctatttgtgtgtgtgtgtgtgtgtgtgtgttttttttgtttttttgtttttttgtttttttttttggtcgagatgcgtcttgctacatttccaaggctggctagagaaacttggcccaggtttagcgagttgcggagtatataatgtaaaaacatagagaactagggagttggtggggagtatctgtgacaatgttcctgcaatgattgaataaagagtctaggctgtgtaggaaagaaaatgaggcctggaatgtgggctaataaagggtaaaaatgaaggggaaaagagaataaatgtcttgaaagatataaaaacagactttgtaggaataaaggggtgagaaaactagaaaaagacccaacaggaattatagtcaaagagtggtttattagagatattttcagagatgtagtacttctagataatagagaaaaaagattccagtaatatccatggaatcagtgaaggacaatgaaactcagaacatcaaacaaccaaacaatatggtgctgggcagagccacaacttgcagttgtgtgctataccactccaatctacattacaatcatggattgttcccacaaaggtatgcattgcacagctagtgtggccacccatggtggtcctggactgtgtgttattcatgtggaccttgtgttcacacactaccatggcagctatttccaatttctatatggtccttatagttacataagtgggaagataggtcactttatgatttgaggctctttggagagagcagaaggagaaataaaatccaattgagaggttttatagcatagtatggtaccttagatatgataaaccttttgacagacagaaaaaaataaataaatgcttcataaataagagaccaataagaacaaaggcctaaaaacaaaacattgctttggttgtataaacaatacattttatatttttcagagctgtttagaagatagactttaccatgataaatgtttcatgatagcggccttggtattatgatgagaataaaaatcctgagtatgggagtccattggcccttggaaaatatattccagtaaagggaaacaattttggacttagaagagcaggtcagggtaggaagttatctacttttagtggatgaacagaagatacaaatcagagccagaaattctctgctgcttttataaaaagtacagtttggattttaaaaaagtaaattggatttaaaaaattagttttctttattactagagaaaatcattagtattttctaagtgttttagctttataaatataaaaaagaaaaaatggatagattgtaccaagtgctttcttatttcacgataatattctgatatattcatatgtttccttcagggaaacaattgtttctacaaattattgtttcatatttatattacacagtattcattaaaattatagtatatagtaaaattagtatcattattttactttatatgaagacttggctccaagaacccctgaaagatttgtaaaaatgctgcaataattcctataatatccttatgtaagaggtaaattttattaagattttgttggtagtaactctcagaagcagtgaactagtcgcccatataaaagcaatattattggaggaaagaagatgcatggcagaaaataagaaagggttctttaaatttctgcaattgaattagctatgattagctgctacaagaagtaaactctgatagctcagtaactaaaaacagaaatttatttttagcttctcttcaatcctgttgatggtgaggagtgaggagttatgtgggagtgaagtaggcaatgatgtaggtacaggaatttcaggaacctttattattttcaatatatgtcttccaaggctgtcctagacatggtcttattgactactgatggcagagttgagggatagagaattatgcatgagatttttattggctattcactctccataggccagagcatagtcacatgagcacacctatctgcaaagaagaccaagaaatgtagctggatatcagaaagaaagagaaatgggtttgagggacaacttgtcagtttctgctaaaatcattattcagcagcacacaaaacatgcatgctttctgatgtgagattataaaatctggcctgagtttctttagcagttttttgacattttgacataggctaaggtacagtgaaattttccaggaaagagagttccaaaataacactttctgtagtaaaaatacctggcatgacataattgtttgggccatgtgtatatgattggatgctacaactttaaatgaatccacaatagtgaaaaaagagaagaaagcaagcattccctctcatccatcacacacacatccattacaacacataaatattctaaacatgataataatgctggctcagatatggtagaaggaggagaacaactaagatttgtttgactctctcagaagaaagttggcttggatctgaatcagaaaagtagagactaagaatattttgattacgaggaacagaaaacttctgaggaatgattcctatgtcatagaaatgatatctaaggatagaagcagcacctggaagaatatctatgatatgcaaaccggaatttccagttttggtcacatggggtactattgtcctggactccttttccactaccaacaaaaaagagagaatacaaaccatgattttaaaatacctagctgagaacaaagaaagaaaaggaaatcccagtgttaggggcaaagatgggcagaatagtaagctcatcactcatcactcatcagtcatcaggcatttccaggttggacttggaaaatagagagcacataaataatatctaaaatgtagattttacatatttagattttagatatttatattttgatattatttaaaaacccattaaaactggcattttaatgttcgtgtaggaacagaagttatggccttgggtctgcatgagaaaagaaggagatcctgtgtaaagcctggaagctgaagtggctctcccctatgaaaagggcactgtaaaaaaattcaattgccagtccaactaagtggcaaaaattttctgtttaggtctctgagtattaaaaaaaaaatctcccataagaagcctgggttatacatagtaaagatcccaagttgaaaaattaacaaaaataccagtcccagactggattctcacaggaaaacctagtgtgtggagaaataatcctcattgaaaatgagctcctaaaggaaaataacttatgaacacaaagaaggaaacaacagacaccagagtctacttgagggtgagggtgggaggagggagaggagcagaaaatatgaccattgggtactaggcttaacacctgggtagtgtaataatcatcacccaggtctgatgtacaacaaaccctcatgacatgagtttacatatgtaacaaaccttcacatgtacccctgaatctaaaataaaagttaaaaaaaatgaagagaaagaaaataaaatatcaatgttttattaaatgcaaataagcataccgacaaaagacaaacattaactgagtggattaaaaatatgccctactagacatgctgtctataagaaactcatttcaaatataataatacaggcaagttgaaagtgaaaggatagaaaaagatgtatcatgtaaacactaatcaaaggaaaacagagttctatttatatggggataagatagacttaagagcaactaaaattaccagggacagaaagagatgttatgcaatgtaaaagggtcaatccacccaagaagtcatagcaatcctaaatttgtatgcaccaatcaacagagctgtaaaaatatgtgaagaaaaaactaatagaactcaaagaagaaattaacaaatccacaattctaattggagacttcaacaactctctctctcaataactgatagaagaagtagacagaaaatcagcagcattataggaaaactcaacaacatctagtatctagtcatttatggaacactccaaacattccaccaaacagcagaatatactttcttttcaagtgcttttatgtacctcaagataaactgtatccagatccattaaacaaagctcaacaaatctgaaagaattgaaactggagagagcatgcactctgactacaatgaatcaaactggaaatgaatagcagaaagagaggaggaaaatgtaaattcttgaaaactaaacaacacaattctaaataacaggtcaaagaaaaacagaaaatgagctccaaaacataaattacaaactacacaaagaaatggtttactctaaggtgagttaccggatacaataaaaagcaggattagatctccagataatagaataatctgaaagaatctaaaaataagcatttataaagtgagtaaagagtaaagtgataaaatgaaggatagaaaatatcatgaaagaccagaatactgtctgaaaaggaaataagagatttaaacaaacagtaacatctaaagataagtttggattttatttgcattgacacaaatgtcagcaactgagttagatgaatatccatagggtaattgaactaaccatatttttagttactttttgtttttaactcgttttaattattatctaacttaagttcaggggtacatgtgcaggtttattacataggtaaacgtatgtcaagggggtttgttgtacagattatttcatcacccaggttttaagccttttacctattagttattttcctgatcctctccctcctccctccctaccctctggtaggccccagtgcgtgttgttcccctctgtgtatccatgtgttctcatagttaaagcatattcttaataagagtcccaaaaaggagagacaagaggaaagaagatagaagtcaaaagacaaagacttcaaaatacccagtaaaacataaatccttagatggagaggagcatgcctggtctttaagcaggctgaagcacacttgtccacacaaacacagcctagtgaaatcatgattactgcataaagacatctgaaacaaggaaatcttaaaagcaatcagagagaaaaggcaacataatcaacattctctcagcagtggttgcaaatggatctaccaagcaactggaagaacaatggaaagatatgggcaatgcaggacaggcctgaaacaaaagcagatggttcccaaaactgcagagactgaccctctcaacaagaaagtaggatacttttaaaaaacaccattaactcagctcattctccattttttgagggctttttttttcttttaacatatgcttggcttttttttctttttaagaaaattaagaaacctgacaactgcaggataactctggatttatttccattcaggtgttttatattcgcatacatgttttactgtgaattgtacaccatttttgagtgtgtaggatgaatctaccagagcagatgctttgttaaatttgtctatgtgactttgattaccggatgtagatgtatgttacttcatctcacagagtttctaaataggcatgtagcaagaaactacattttaaaatggggaatgtgttaattaaaacattaacccattctgtgtgtgtatgtgcatgtgtgtgcttagatttctatcttatgttattccagtaaggatctgagacgatgtgaaagaaaaataaaacactgaaacaataaggccaaaacccaacccaatgcaagtgaaaaccactattaataactctggaaggaaaccatagatattaagcagaaaactgtaatttcttactgctaagaatgctaattctatcttcgttgttatctagagatagaggggcattcaacttccagatcactcaaccacacatgtcatacatacattattgtatacagttttttctacaccacctcatttcagataaactgatattcaagtatgttaattttggttgaccaagatctataatgttttaatttttattttataatcctaaacactcatgatgttcctcagacttacattacattctaattgtagactttcaggctgtgctaatctaaccctccttatattcttttttgacaattgcctatattttctttcccacacattgactctaggcaatctctaaaaaaaaaaaaaaaaaaaaagccaggttaaaaacaaacaaaaacaaaacaaatgcaaagtaatctttcatataaacttccacatgatgctcttcaggtagcttgaatccttgaccctgaatgccaagttctatatttgtttcttatataaagccttcaagactatatctacttagcttcgcttaatgtgactatattaattttatagactttgtttttttcttttcttgaaaacatagaaataaaaaataggaaaaaatagaaattaacaaaaggtgggtatgtttacataaatatataataaagagaaaatgatcacacagaataatttatatagaacagggagtagccattaaaaaataattagtaaggttctctttttgttttcattagaaagtagaaacttttgttagattaagaaaacagttgcctcggtgacaattgtcttttcttaagtaaaatattgatgattggaacattgctactgagcaattcagtactatgggtagtaaaaatatcaaggaccctaactcattcacatgtggcagtgatgtcagtaaacaaagaaaacctcagcaaactaatgaattggtatagaagtattaaattaccttaataaatgcattttataatagttttcccccagtctattagctcatttagaggaatgttatttaagcactttggagatagacaactcatctttctttttttattattatactttaagttttagggtacatgtgcacaacgtgcaggtttgttacatatgtatacatgtaccatgttggtgtgctgcacccattaattcatcatttaacattaggtatatctcctaatggtatctctccccactacccccaccccacaacaggcccaggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccccacaaaggacaggaactcatcattttttatggctgcatagtattccatggtgtatatgtgccacattttcttaatccagtctatcattgttggacatttggcttggttccaagtctttgctattgtgaatagtgctgcaataaacatacgtgtgtatgtgtctttatagcagcatgatttataatcctttgggtatatacccagtaatgagattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtcttttggctgtataaatgtcttcttttgagaagtgtctgttcatatcctttgcccactttttgatggggttgtttgtttttttcttgtaaatttgtttgagttcattgtagattctggttattagccctttgtcagatgagtaggttgcaaaaattttctcccattttgtaggttgcctgttcactctgatggtagtttcttttgctgtgcagaagctctttagtttacttagatcccatttgtcaattttggcttttgttgccattgtttttggtgttttagacatgaagtccttgcccatgcctatgtcctgaatggtattgcctaggttttcttctagggtttttatgatttcaggtctagcatgtaagtctttaatccatcttgaattaatttttgtataaggtgtaaggaagggatccagtttcagctttctacatatggctagccagttttcccagcaccatttatgaaatagggaatcctttccccattgcttgtttttgtcaggtttgtcaaagatcagatagttgtagatatgtggcattatttctgagggctctgttctgttccattgatctatatctctgttttggtaccagaaccatgctgttttggttactgtagccttgtaatatagtttgaagtcaggtagcatgatgcctccagctttattcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtatcctcttttatttcattgaggagtggtttgtagttctccttgaagaggtccttcacatcccttgtaagttggattcctaggtattttattctctttgaagcaattgtgaatgggagttcactcaagatttatctctccgtttgtctgttattggtgtataagaatgcttgtgatttttgcacattgattttgtatcctgagactttgctgaagttgcttatcagcttaaggagattttgggctgagacaaatggggttttctaaatatacaatcatgtcatctgcaaacagggacagtctgacttccacttttcctaattgaataccctttatttctttctcctgtctgattgcccatatccaacactatgttgaataggagtggcaagagagggcgtacctgtcttgtgccagttttcaaagggaatgcttccagtttttgcccatagatgcagaaaaggccttttacaaaattcaacaacgcttcacgctaaaaactctcagtaaattaggtattgatgggatgtatctcaaaataataagagctatctatgacaaacccacagctaatatcatacctaatgagaagtcatcttaaagatagctgggagtactcatgccctactaccatcagtagataaatggtatagattggctgttcattctttcactcacttaatccacagaaaatactcctattggttttatctttctcaagttccttttcccaatttgatattaaataacaggtcttaaaatggacaaatattctaaaatgaaattagcataattaaaatattagcttttatttttaatatgttgatatattctattgtgatgttctgcaaatttttcaccttctagggaatattctttcccaattacgtttttcagatttcacaatgaaactgacattaaagaacaaaaactcttcagttatcttttaaaattctaggtgatagataatggagacttggaagattgaggggctgtgaggagtaaggataataagagattaaataacaggtacgatgtatgttatttgactgatggataccctaaatgccctgacttgaccaccacacaacctatgcatttaaaaaactgcacatatatcacataaatttatgcaaaaaaattctaggaacacaatatctcctttaggaaattccatggcaacttcttctatctgttaatagaaaaataatgaagccagtcattgtgacaaactaatactgtctattatttctccattaatttttgtcctgtacatgaacatttatagtccaatattattttcatcaacttttcaggtatttgacctaaatatgaagcattctttaatttaaaaattcccagattaagtcagcacaatttaattcaatcaatatttattagttttccaatttgtgcatgatatttaagagacatacaaataaataaaatgtttgctgatgtcaaaaaaattttacttgcttttatacatacatatttttgtagtcgataatggttttactatctttgaattctgcaatatgtctgctgcaaaaacttgtaaatgacttctctgtattgtagtgagagagtttttaaaagcccattgcttttggtgggaaacaacatgtctctaagacagatgctatcaggagtcttttcttgcatttctcagagatatttacatgatgtttacttcctgtgtgatattatccatttctgcactgctttcggtagttaaggttaaacactattcgttttctgtttccctgtggtttgactgtgtaactctttcatgttttcttatattcacgttaccattttactatataaggaatcctgaaaaagtttagagggcctaaagtggtgcttcaataaacacattttaattcattctgttattttcccggtaatttccccaatctcacttttggggctccctttcctcaggcaagcactcttgtaaaatagatatctgccctaaaatcccaacaatataagaggcaaaaaaatacaaagaaagtattagtatctcacaccaggcctcttgcaggatgggaggaaatgtagggagagcattaggacaaatacctaatgcacgcagggcttaaaacgtagatgacgggttgataggtgcagcaaaccaccgtggcacatatatacctgtgtaacaaacctgcacgttctgcacttgtatcccggaacttaaagtataattttttttttaaaaaaagcatatgtggtaagacagaatgcagagagatatctcttctaggtctttgaattatgaattctctgatgcaaaatatacagtaaaggaaaataatcagtacaaattcaaaaagttaccaagttaggatttttaaaaaatcttaggaaagtcacagaaattactatatttgcttctactgttatagatgccttggctttaacaaagcttatgaagacaggggactgtctgtctatgacttttaagttttactttgtgctaaacttgaatgaattatttcaaaattctgtagttgtcccatcaaattccaaagtttggcttaggtatggtggctaaataattgataacgccttgccttctcagttttttttaatttgtataaatttaagctagtgcaagtgcaatgttgttatatgcatatgttgtgtagtggtgaagtcttggctttattgtatctaccatctgaatagtgtacattgtacccattatgtaatttcttatcaatttctctcttaccgcctcccccacttccaagtctccaatgtctgtcattctcctctttgttcatgcgtacacattatttagctcccactaataaaggaaaacttggtatttgaaaaaaataacgagttaccacaatatttccattagaattgctaaaattaacaagactgacaatgtcaagtctatctgaggatgtgatgtaactgatactctacacattgattgtgggtaacccaaatgttacaattactttgacaaacagtagaaatttgctcaggagaaatgaaaacataggttcacacaaagacttgtacactaatgtacacagaagctttatttatagtagctccaaatttgttcaactccaaatatatatcagcaggttaatggacaaattgtgttatatccatacagtggaatactattttatactattagtatcaatattatgcaatattgtttatactatttggcaataagaagtgaactgctgatatactcaataacatggatgaagcaaagtcattgtgctgattcacagagccagtctaaaatagaagatagtttatgattcaattttatgcgatagaaagataaatatagcccattgttactaaaaggaaatcagtaccatagttgtctgtagccagagtgtaaatgggaacctgatttcaaagagtactagagaaatttggggggcaataataatgttttattacttgtctggattgctatttcagtgcatgtatttgtcaaaattcatcccctgtacatttaaaataagtttattttatttttacttaaatgaagttgtttcttagtaaaactcttaccaacctaaaataagaagttcaagtaacagtgttagatgaaagtggtcagagctgccttctgtttttcattctagtagtgcgtaatggtgtttgcctattatgattggatatggaccctgacaaggatacatatgacttattcctatgggatattcaaaaatttgtctttatgtgtatgtatacattgtgtgtgtgtgtgtgtgtgtatcaaagtatatacatatgcactttaaaaatgtgtgaccaggcaaagtttgtcaatgttcatcttaatagaagtttaatttcaataaataatgaacaggtgtgaagacaatgtgtgatatcaggagcaatgaagaggaaagcagggtactttgcataggaggctgtgggtacagctggtgttattatataggagttaatgtaagggcaatagacaagtttctgagggtgtccgctggcaatgtagcacctttgaatgttggttttagagcctgtatctctgtcatagggctccaagtccaaccagtaagctgatttagatggttagcctactttgatgctacctgggaacttcaccatctccggaatcactctccctctcatctctgttcttcctgtctttattttctttatgccagaatgcatggccatcctatctaggtgtcttatcagtcaaggaagcagcacctcttcctacttatactaacaactttctctcactttttattatatagtttcttaatgtctgaaaggtaactcacgtgaaagaagatctcccatgatcatgcaaggtattttcagagacccatctctgggtgttttctttaagccccatttttttttctagtaccaattcttatttgcccagtatgcatgactcttctccctatattaagcaaatgaaaaatgcagaatgaaaaagtctaagaaccacttcagacctctgtactctgtagccactgcttccccttttcatgtgccctgcccccagccactttttcataccttctgttcaagttccaaagtagacctcatcagtcttgtttctgtagtactccttgtccttaacttcacctcattgctcttgcaaatcctctgacatgcacccatgtaatctggtttcctgggaaacaaacttgcttattccttgaaagcttcagttactcatatttatacagtgactatcattctcactttttatagactatatctttgttggctctacataagcaaataattgagagtcgaagcagtttctccttacaacactcaacatactagctgtagctaaaggcatttggaataagctgtaactttgtcttaatacctttctctttctacttaatactataaggatatgagaaaaacagttagttgtcacttctatttttcatttcttctcaaagatagctgacttttcttgttcatgtcattactgtctgaggaactttcattttcttgtgttcctattgtcttagtaaatttgtgcttctataacaaaatatctgactctgggtgatttataaagaatagaaatttatttcttactctctagaggctgagaagtccaagatcactgtgctgacaggctttgtgtctggtgagggcttccctctcttcttcaacatggcactgtttctgtgtactcacatgacagaaggtggaagggcaaaggagtggcatcagatgatgcctcttttataaggcattaatcccattcataatgacagagccctcatgatctaatcatctcctgaagtccccaacttctaatatatcaccttggtgattaagtttcttcctcttcttttttttttttttcattatacttcaagttctgggatacatgtgcagaatgtgcaggtttgttacataggtatacatatgccatggtggtttgctgcacccatcaacctgtcatttgggttttaagccccccatgcattaggtatttgtcctaatgctatccctcccattgctctccacccccaacaggccccatgtgtgaagttcttctccctgtgtccatgtattctcattgttcaactcccactaattattgagaatatgtggtgtttgtttttctgttcctgtgttagtttgctgagaatgatggtttccagcttcattcatgtccctgcaaaggacatgaactcattctttttatggctgcatggtattctatggtatatatgtgccacattttctttatccagtccatcattgatcggcatttgggttggttccaagtctttgctattgtaaatagtgctgcaataaacatatgtgtgcatgcatctttatagtaaaataatttataatcctttgggtatatatctagtaatggaattactaggtcaaatggtatttctggttctagatccttgaggaattaccacactgtcttccactgttacacaatgattgaactaatttacactcccaccaacagtgtaaaagcattcctatttctctacatcttctccagcatctgtgtttcctgactttttttctttttctttaagacacagtctcgctctgtcacccaggctggagtgcagtggtgcgatcttggctcactgcaacctttgcttcccaggttcaagcaattctccctgcctcagcctccggagtagctgggattacaggtgcatgctactgtgcccggctaatttttgtatttttagtagagatggggtttcaccaagttggtcaggctggtcttgaactcctgacctcaggtgatccgcctgcctctgactcccaaagtgctgctgttacaggcataagccaccgcacctggcctgtttcctgaccttttaatgatcaccattctaactggcatgagatggtacctcattgcggtttcgatttgcatttctctaattaccagtgatgataagctttctttagtatgtttgttggccacataaatgtcttcttttgagaagtgtctgctcataatatttgcccactttttgatagggttgcttttttcttgtaaaattgtttaagttccttgtagattctggatattagccctttctcagatggacagattgtaaaaattttctcccattctgtaggttgcctgtttactctgatgttaggttcttttgctgtgcagaaactctttagtttaactggatcccatttgtcaattttggcttttgttgcaattgctttggtgttttagtcacgaagtctttacctatgcctgtgtcctggatggtattgcctaggttttcttctagggtttttatggttttaggtcttacattaagtctttaatccatcttgagttaatttttgtataaggtgtaaggagggtccagtttcacctttctacatatggccagccagttttcccagcaccatttattaaatagggaatcctttccccatttcttgctttttgtcaggtttgtcaatgactagatgtttgtagatgtgtggtgttatttctgaggcctctgttctgttccattggtttatatatctgctttgataccagtaccttgctgttttggttactgtatccttgtagtatagtttgaagtcaggtagcatggtatctccagttttgttctttttgcttaggattgtcttggctatacaggctcttttttggttccatatgaaatttaaagtagatttttctaattctgtgagaaaagtcagtagtagcttgatggatataattgaatctataaattactttgggcaataaagccattttcacaataagtttcaacatgtaaattttggaacagacataaacattcaaattatagcacctatttttaaagcatttgttttcagtagaatcttggtttgcagtcattctagttttattgtcttatggggtctctgaagactctccaagggaattacctctttaacaagatttttggggtttagagttgatattcaattacattttattcctcttagttctattacctcagattagtaaagttcattccacctagatatatcattgtttcagaagttgagagggaaattcttaagattagttagctaacattttgtattatataaattttttaatcctcattttgtggacagaaatccagactatagcagattatttgagatattctaggagcgaagtaatatttgtcgaattatcattagatattttcaccatgttcaatatgttatctttactggtcagaataggagatacaggtctctgtaatttgggaagtttgtatcaaaaagtcataatacgggagaaattacaataaatgcttgggcttttctgttatgtatccctggtcaaaagttctaagagaactttttagcctgattttcccagaaagaagagcccaaacagtctaatgtgctcttattttataggaaagacaattccagggactagaagtgaagaacaacagtaaaaaaaattcaagaaaagaggtagagcccaaatggggctgtggtattgagctgactgtagtgttacaccatggaaatgactgtaactatatctccggacaatcctggagagggaaggtaataaggtttggctttgtgtccccacccatatctcaccttgaattgtaataatccccacatgtcaagggtggggccaggtggagaaaattgagttttggtggtggatcccccatactgttctcgtggtagtgaataagtctcatgagatctgttagtttcataaatgggagttcccttgcacaagctctcttgtctgttgccatgtaagacatgtcttgcttctgcttcaccctctgccataattgtgaggcctccccagccatgtggaattgtgagtccattaaaccttttattctttataaattacccagtcttgtgtatgtctttattggcagcatgagaacagactaataccgaaggcaaaaaacaaaaataattgatctactaggccttcttagcaattagtaagctttaccccatgatgtaataactcccccataccaccaggttgtgcatgctgggcataggagctgaatggagccctgtggtatcaccagcaaggccgcccttgggtgggaagccagaggggaagggaaggggctgaagacgaggcagcatccagttacatctgtgtgaatttggtctgaacacatggaaacctggaacagggatgtcaaaagggtctgaagaaaaggataattggtgttgcatacaaaggtctttatttctttttgcaagcatgttttatctaaatgtatcttatatctcatggtcttagtctctggactgccgatgtcctctttcttactgagattatttccctattgtatattgctgatggtatttctgctgctaaatgatacgcatggagaatgttctaagatagatggagagccttaggggccatatctgtagagggaaaaatctaagaacatgcttggaagcacagttcttctctcctttgactacttccttaggagtactctttaaggacaatttctggcttgttacaaggagatctcacatatgtgagggctgtgtattacacacttgagagtggctaagaacagctggccatatagctgccaacattataactgacagaggatgctctgaatcaaagcccaagtgaggatgtgcagaatcctctgagggggataaaaacacattgaaaataatgctaagaaagaagtctctgttcacaagacaatactgatttcaaatttcttgaaaaattctcaggctgcaatcataaatattactctacttaaaatacactgatatatgagttatgtcatttgcaaaaaaatattgtgtaacagaaaaggtaaacagatacattagtgtctacccactttaattttatcctaggactagaatccagtcagattttttttcttcctagggtaggcagtgctccaccaagaaagctataaatatattttctcggaaaaatacactttgcacatgaactgtaccgagatgagtgcacatacacaagtttgcaagaaatgtcagacccttgaagtttccttctttaataaatgcagaaaaaatgataatttgacatagtttttttatgaaactggtaataagaattaacttttagcaaacccaatttccccaatagaactgcatgcttactttctaacaaattaggtaaataatacatggaacttttttttttcattttcaggcaattataaaattttaaatgtaatttttctctttatgaacaaacctatctaagttcaaatataagcctcaaaatatgagaaattcaggaaggataggatatatgatgaaaggatagtagagctgagaatttcccagtatggagacaaaaaggctaaggggaggtatgatagcttctgaaaatatgttaagggatgttatcaggaggacagggaccaattcttattagccaatgagagcagaacaggaagtaatgaacttcaactacagcagggaaatttaagtgaaatataagaaaacttttaaactgtcagaacaattaagcaaaggtacaaataataaattcacctttactgatcatattcaatgatgctctgatgagcatcattttactctctctccatgagttcattttttttacgtcctatatataagtgagtacatgcagtatgtatctttctgtgcctggcttatttcacttaacacagtgtcctccagttccatccatattgttgcaaatgccaggattttattctttgttatggctgaataatattttattgtgtatatgtaccacattttctttatccatttatctcttgatgaacacttgatgactccatatcttggctattgtgaatactgctgcaataaacatgagagtgcagacatctcttccatatactgatttccattcttttggatatatcccaagtgatgggattgctggatcatatggttgctctatttttagctttgtgagaaacctccatactgttctccattgtggttatactaatttacattcccaccaacagcatatgagagttcccttttctccatatccttgccagtatctgttattgcctgtccttttgataaaaaccattttaactggggtgaaatgatatctcattgttttgattcacattcctctgatgattaatgtgttgagcacttttcatatgcccattggccacttgtatgtcttcttttgagaaatgcctattcagatttttttctttaaaattttttaactttcaagttcatatcatttgcccatttttttgtttttatttctttttattagagaacacatacaaaagaagggagaacagtgtatagtaaagcttcatgcacccatcacccagtttccacaatgatcaatgtttagcccctcatttttttggtgggggaagtaataatataattattataaattaatagcataattatatagaatttagttattaaagtaataattatatagttatgaattgtattgttatagactatataatatgcaataatgtaatatataatttataatataataattatgtatactatataatataataatcttattggcaaggagttattttttctttattttaataggtttttggagaacaggtggtttttggttatatggataagctctttagcggtgatttctgagattttggtgcacccatcacccgagcagtgtacactgtacccaatgtgtagtctttcatccctcagccccctcccaccttcccccgaattctcaaagttcattgtgtcattcttatacctttgtgtcctcatagctaacttccacttataagtgagaacatatgatgtttggtttttcattcctgagttacttcacatagaataatgatctccaactccatccaggttgctgagaatgacattattttgttcctttttatggctgagtagtattctatggtacatacataccgtattttctttatccactcattgattgatgggcatttgggctggttccatatttttgcaattgcaaattgtgctgctataaacatgcgtatacaagtgtcttttttatataatgacttcttttcctttgggtagatacccagtagtgggattggtggatcaaatggtagatccacttttagttctttaaggaatatccacactgttttccatagtggttatactactttacattcccaccagtagtgtaaaagtgttcccttttcctcacatccacatcaacatctattattgattttttaattatggccatttttgcaggaataagatgatattgcattgttgttttgatttgaatttccctgataattggtgatattgagtattttttcatatgtttgttggttacttgtatatcttctttttagaattgtgtatgcatgtccttagcccactttttgatgggattgttcattttgttcttgctgatttgagtttcttgtagattatagatattagtcctttgttggatgcatagtttgcaaagattttctcccacgctgggttgtttgtttactctgttgattatttattttgctatgcagaagcttttttagcttaataaattctcatttatttatctttgtttttgttgcatttgctcttggattcttggtcatgaagtcgttgtctaagccaatatctagaagggttttgttcagtgttatcttccacagtttttatggtttcaggtcttagatttaagactttgattcatctagagttgatttttgtgtaaggtgagaaatgaggatccagttttattcttctacatgtggcttgccaattatctctgccttctgcctgttttaaaaattaaattatggctgggcgtggtggctcacacatgtaatcctagcactttgggaggccaaggcgggtggataacctgaggtcaggagttcgagaccaactgggccaacatggcaaaacgctgtctctacccaaaatgcaaaaattagctgggcgtggtgatggacacctgtgatcccagctactccggaggctgaggcaggagaaccgcttgaacccggggagcggaggttgcagtgagccaagatcatgctactgtactccagcctgggcgtaagaatgagactcggcggggcgcggtggctctcgcctgtaatcccagcactttgggaggccgaggcaggtggatcatgaggtcaggatatcaagaccatcctggctaacacagtgaaaccctgtgtctactaaaaatacaaaaaattagccgggcgttgtggcaggtgcctgtagtcccagctactcaggaggctgaggcaggagaatggcatcaacctgggaggcggagcttgcagtgaaccgcagtgagccgagattgtgtcactgcactccagcctgggcaacagtgcgagactccgtctcaaaaaaaaaaaaaaaaaaaaaaaaaagagaaaaagaaaattatatgttttttttttgtttttgtttttcctaattagtttgaactcctttcatattctggttattaatccttgtcacacgagtagtttgcaaatattttcttccattctatcagttgtttctttactgtgttgattttttttttttctgtgtagaagtttttgttgttatcctatttatatacttttgctttggttgcctgtgcatttgaggtcttaggaaatttttgcctaggccaatgtcctggggcttttccccaatgttttgttctagtagtttcatagtttcaggccttagatttaaatctttaatccgtttttatttgattttttatatagtgagaggtaagagtctagttttcttcttctacatatgaatatccagtttgcccagcaccatttattgaagagactctttccccaatgtgtgtccttcatgcctttgttgaaaatgagttgattgtaaatctgtggatttatttctgggttctctattttgttcttttggtttatgtgtctgcttttatgccagtaccatgctattttgcttacttttagtattagagttttagtataatttaaagtcaggtaatatgatgcctccagcttttcttttccccctctcaggattgctttccctattcaggctcttttttggctccacatgaattttcagattattttttctatttctgtgatgaatgtcattgctattttgatggggattgcattgaatatgtaattcactttgggaagtatgaacatttaaaaaatattgattcttttgatcaatgaacatagaatattttttaatttttgtgtgctttaatttctttttcttttttttactctaagttttagggtacatgtgcacaacgtgcaggtttcttacatatatatatatgtgccatgttggtgtgctgcacccattaactcctcatttaacattaggtatatctcctaatgctatccctcccctctaaccccaccccacaacaggcccaggtgtgtgatgttccccttcctgtgtccacgtgttctcattgttcaattcccacctatgagtgagaacatggggtgtttggttctttgtccttgcgatagtttgctgagattgatggtttccagcttaatccatgttcccacaaaggacaggaactcatccttttttatggctgcatagtattccatggtgtatatgtgccatattttcttaatccagtctatcattgttggacatttggcttggttccaagtctttgctattgtgaatagtgcctcaataaacatatgtgtgtatgtgtctttatagcagcatgatttataatcctttgggtatatacccagtaatgggatcgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgttggtttttctcttgtaaatttgtttgagttcattgcagattctggatattagccctttgtcagatgagtagattgcaacaattttctcccattctgtaggttgcctgttcactctgatggtagtttcttttgctgtgcagaagctctttagtttaattagatcccatttgtcaattttggcttttgttgccattgcttttggtgttttatacatgaagtcctcgcccatgcctatgtcctgaatggtattgcctaggttttcttctagggtttttatggtttcaggtccagcatgtaagtctttaatccatcttgaattaatttttgtataaggtgtaaggaagggatccagtttcagctttctacatatggctagccagttttcccagcaacattgattaaatagggaatcattttcccatttcttgtttttgtcaggtttgtcaaagatcagtttgttgtagatatgtggcattatttctgagggctctgctctgttccattggtctatatctctgttttggtaccagtaccatgctgttttggttactgtagccttgtagtatagtttgaagtcaggtagcgtgatgcctccagctttgttcttttggcttaggattgacttggcaatgcgggctctattttggttccacatgaactttaaagtagttttttccaattccatgaagaaagtcattggtagcttgatggggatggcattgaatctataaattaccttgggcagtgtggccattttcatgatattgattcttcctacccatgagcatgaaatgttcttccatttgtttgtatcctcttttatttcattgagcagtggtttgtagttctccttgaagaggtccttcacatcccttgtaagttggattcctaggtattttattctctttgaagcaattgtgaatgcgagttgactcatgatttgtctctctgtttctctgtagttggtgtataagaatgcttgtgatttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttacgtttaacgtttaaatctttaatccatcttgaattgatttttgtataaggtgtaaggaagggatccagtttcagctttctacatatggctagccagttttcccagcaccatttatgaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgccgccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaagggggagggatagcattgggagatatacctaatgctagatgacacattagtgggtgcagcgcaccagcatggcacatgtatacatatgtaactaacctgcacaatgtgcacatgtaccctaaaacttagagtataataataataaaaaaaaaaaaaaaaaaaaaaagaatgcttgtgatttttgtacattgattttgtatcctgagactttgctgaagttgcttatcagcttaaggagattttgggctgagacgatggggttttctagatatacaatcatgttgtctgcaaacagggacaatttgacttcctcttttcctaattgaataccctttatttccttcttctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatatgtcccatcaataactaatttattgagagtttttagcatgaagggctgttgaattttgtcaaaggccttttctgcatctattgagataatcatatggtttttgtcattggttctgtttatatgctggattacgtttattgatttgcatatgttgaaccagccttgcatcccaggaatgaagcccacttgatcatggtgggtaagctttttgatgtgctgctggatttggtttgccagtattttattgaggatttttgcatcgacgttcatcagggatattggtctaaaattctcttttttggttgtgtctctgccaggctttggtatcaggatgatgctggcctcataaaaatgagttagggaggattccctctttttctattgattggaatagtttcagaaagaatggtaccagctcctccttgtacctctggtagaatttggctttgaatccgtctggtcctggacttgttttcattgttaagcgctttttttactttggtaactttattttcaggtattttatttgtagctatcattaatgggattattttcttggtttcattttcagattgtctgctattggcataaagaaacagtattgatttttgtatgtttattttgtatcctgtagctttaataaatttgttttctaatagtttttcagtggggtcttcaggtttttctaaatataagaccatatttcctgcaaagaagagtaatttgaatttttcttttccaatttggatgacttttatttctttatcttgtttaatttttctagctaggacttccagtgccatgttgaataaaagtggtaagtgggcatccttgccttgttccacatcttagaggaaaggctttcagtttttccgtattcactatgatactgactttactggatgtggcctttactgtgttgaggtatgtctgttctgtactaaacaattgttgaaagtttttatcatgaagagatgttgaattttatcaaatactttttaagcatttattgaaatgattatgtggtttgtccttcattctgtcgacgtgatgtatcacatctattgttttccatgtgttgagccatccttgcatcccagggataaatcccacttggtcataatgaatgatctttttaatgtgttgttggattcagtttgctagtactttgttgaggatttttgcatctatgttagtcagagatattggcctgtagttttctgtttttgtcatgcctttttctggttttggttatcagggtaatactgatctcattgaatgagtttggaagtaccgccttcttatttttttttgaaataatttgagtaggattgatattagctctttaaatgtttgacagagtttagcagtgaagccatcaggtcctgggttttgctttgataggagactttttattattccttttatgtcattacttgttactgatctatttgggttttctatttctttatggtttaatcttggtagattttatgtgtctaggattttatccatttcttctaggtatttggcatgtagttattaataataatctgtaattatcttttgaatttacgtggcatcagttgtaaagtctcctgtttcatctctgattttatgtatttgggtcttctctctttttttcttagtttgtctagctaagggtttgttacttttgtttatcttttcaaaaagtcatatctttattttgttgatgctttgtatttgtttagtctcaatttcatttatttctactctgatctctattatttcttttgttctattaattttgtgtttgatttgctcttgcttttctaattctgtaagatgcgttgttaggtattttatttgaaatttttctacttttttgatgtaggcatttatttctataaactttcctctcagcactacttctgcaatatcctataagttttgatatattgtgtttctattttcacgtgtttaaagatttttaaaattttcttcttaatttcttcattgacctaatggtcattcataagtatattacttaatctccatgtgtttgtatactttccaaagttcctcttgttattgatttctaatcatatcaagcatttatgaccataatggtggtcagaaatcgtggtcagaaatacttgatattgtttgtgtatttttttatttgttgaaacttgttttatgattgaacatatggtctattctggagcatgctccatgtgttgatgagaataatgtgtattctgcagccgttggataaacagttctataaatgtctgttaggtcaatttggtctatagtacaggttaagtctgatgtttgtttgtttattttctgtctagataatctgtccaatactgaaagtggggtgttaaaataattctcaactgctattgtattgggctctatctctttagtgatatttgctttatatatctgggtactccatcattgggtacatatatatttgtaattattatagcatgtcactgaattgacttctttatcattatataatgactttctttgtctctttttataacttttgtcttgaaatctattttataagtacagctactcctgatcttttttggttttcatttacatggaatatcttttcccaccccttgaaataagttttattttaaaaataatttgctaattgtggtgtgtttatctaatattagcttattatttaaagctgcaataatcaattaggccagttttatatttaacaataattgttactctttatggaaaatcatcttcttgataattttaaagttcttggctgacttcttgtcagatctgattaaactgtcattatttttatcttgtacagtggccaaaaaagccctcatgctaggaatagaactgccagctctcctacttttaattgttttctatgcttgtattgttagtttaattgtcaatctgtgatttttctacagtaatcttttccaggctctgagtccctttttaagttttgtttcattgaactagataatataaatcacagagtggcttaattgacatatgttgactgtatatcaatatgttacacacaaaaatgcacacatagaggtatctctcccaactctgaggtggcagattcctctttttcctcaggaactcatattatgtagatgacttgtgactttagaactcatgaaatatgagatgatatatccatcaatctatatcaaacattgataagcttgattatgtttataggtaaaaatagtagaaataactactgtttctagaattatagcagactaaagtattctaaaagcctttcactgcaaatcagtttcaactctaaatgatcatacttttaaatgcattgatcaactcactggaaaatacaagaaatctctaagaatctcaccccaccaataagtttaaatctaggagaaatatttagagaatgtggacaataacagtatatttttttcagtaataccagagagagtttattataaacttactcttattaaaagaacttcttctaaagtatgtatataataaaaaggacaatgatcctaaaaaatctgaagtaaaaaataataacatgcaaagattttggtgtgtaataaatatagacaaatattatattcaaagtaataatttccaatatgtgacattaaaattaccaagaaagcaagagagaaccaagatattagacaataatgtaaagtcagttggaatagcaattaaagttaaaatattctaaggttttgaatttatttaacaggagagataatcaaggggctctttttacattaggaatataagttaaattttcaaaaataccccccaaaacatgttactactaattttaatgtaatataaaaatcaatgcaatcaatatcaaagaatgaagaaatgagaaaaaggtaaaataaaaagatggaatagacagaaaacacaaaataagaaagaaaagtacaaatgttttaataatcacaataaatgtaaataaactaaatactgaactcactgcttaaaatactgatatttccagattgcatgaaatgccaacattcagcaatagctgttttcaaaagactcatcaaaacctgtatatacttgatgaaatagtttcaaatatataaggcaaaacaatataagtataaagataaatttacaattcactattataaggggatatttaaatacctcttgcattatgtgatatttcatctgagcaacacaacatgcatttttagtgaacttagaactcaacactcaacaattatagaatatccattcttcagcaagcaccataaaaactatatagagagatttcaaaggacacattctatgggtacaagacaaattaagttagaagttaaaagacctttcaaatgactgggaaaaagaaacataaatagcacatgagtcagagaaacaattcttactagaaatttgagacacttataactggataataacaaaaatacttgtgtccatttgtctgttcaagtcctctaaggagataccaatgaagaattaaatgtacaaggatacatcggggaaatgtctttgaaggataaagagggagagaacaggaataggctgagggaaacttcagactatgatgtggaactgacgtctgtgaaaagaaaaactagaaggaggattggggtggaaggtattcagacagtagtgcaattctgagaaagcctcctccatgctgatgggagtccccgtctctactaaaagtacaaaaattagccaggcgtggtggcaggcgtctgtaatcccagctgcttaggaggctgaggcaggagaatcacttgaacatgggaagcagaggttgtagtgagccgagatcgcaccactgcactccagcctgggcggcaagagcgagactccgtctcaaacaaacaaacaaaaaggaagataatggagagtagaaggatggttaccaggttgtcctaacagcgttctacatctagccaaaatggacctggtactcttgctatgctcagtcactatcaacagcagcctaggaaaatgtggccttggtgaatgccacagtgggtcagagagtggagtggttagaggttgtcagtcaaccttgtacccacagcacatccttttgatggtattctgagtagcatgcctccatggctactatgatacaaaatatcaacatttttggaatagagttaaacgatattttgaagtatggcagtaagtacttaaaataaaagcttatattaatgagttttgtgttcttcaagattgtagaacaaaagtcaatagaataaacctaaagaaaatagaaacaaggaaacaagatgaaagcacaacgtataaactaaaatagtatatatatatatatatacacacacacacacacacacacacaacatgaaaactaatttgttagaaactttagtaaaatatgcaaaccattgtaaaaatggatcaagaaaaagaagccacaaaaagtaagcataaaaaaggaatataatgggccaggcgtggtggctcacgcctgtaattccagcgctttgggaggctgaggcaggtggatcaccagaggtcaggagttcaagaccagcctggccaacatggcaaaaccccatctctactaaaagtacaaaaattagccaggtgtggtggtgagcgcctgttatcctagctactcaggaggctgaggcaggagaatcgcttgagcctgggaggcggaggttgcagtgagctgagatcgcaccactgcactccagcctgggcgacaagagcaagactccgtcccaaacaaacagacaaacaaacaaacaaaaagaacataatggagagtagaaggatgattaccagaggctaggaaggatagttaccagaggctaggaaggacagttgggggatgggtacaaaaagtagttagaatgcacaagaccttggttttgatagcacaacagggtgataaaaatgataacttaattgtacattttaaaatagctaaaagaatataattggattagtttgtaacaaaaaggataaatgcttaaggatatggataccacagtgttctatgatgtgattattatgcattgcatgcctgtatcaaaacagctcatggaccccataaatatatacgcctactaatgacccacaaaattagaaagtaaaatttaaaaaggaacataattgtagttaaagatttaaaatgacaaaaaaaaaaaaaaaaaaaaacccaaactgagcttatgtcttttaaaagtgttgaatttggctatttttaaaaagtctgtgtcttgcagcatgaagttgcagttttaagaaatacaatgagcctgggcaacacagggagacccccatctctacacaaaattaaaaattagccagacatggtggcacatacctgtggtctcaactactcgggagggtgaggtaggaggatcacttgagcccaggaggttgaggctatagtgagctgtgattgtgccactgtactgcatcctaggtgacagattaagaccttgtctataaaacaatagaagaaaagaaaagaaatacaatgaatttattaggttggtgcaaaagtaatcgcagtttttgccattaaaagtagttgcacaaaccacaattatgtttgcaccaacgtaataaaatatagatttttcaggaaatgatctgaagttttctaacagtttttattttatctactgatatttctaacttcatgcttatcaagtgaaaggaaagcacaaagatttgttctctagcagttttgctgttggatggctggtggtaggtaaatggaatttcctctgacttcatctgcttcagaatactgatggggtctcatcaattcgggtgggagttttcatttgttcatataggatttcatactaaatgccatgtcaagtaatctggaaatcctgacagggtgaatcaaatgtactgaggaatgagtccaaccattttgggcactatgccattactgctggcactcatttattcctggccactgcaattaattcctggaacacagtttctaagggctccagtgggtggtaatgcctttcaaccagaattcactgggctcctttccagtcttttgggcactactgcctctctgctggtacactgctatcttctgatgggtgttttccatgtttccctgattattttcactgccttaaaggatcttcataatgctaaaactaccctatgattgacagcaaggtgcaatgtgaatgatataccacctgaaggctcctaagatagctgtttttactcctaatgttgcatagtgttgttagttgagaaattacttcaagttttatttatagtctctttgcttttcatagaactcaaccacaatctttgaagtctgggctaggaaacaaaactggataacagaaatcatgctttgttcctctctacattgaggaacaatgtgtattacttctacattgatgcgttcttaccagatcaaagtcatcatgtcttggtggttcattttcatctccagatggtttctctctcaggatgcgcatttgttcttataaaaacacatttttgttgaactgatcacatcagttccctagatataattaagtatatttgaatcccccttagatttcttcttcctttttttcttccttacatacttcctatcttcctctttttatcatctctctatcatcaaatgtacttcatacatgtataagaaatcatcacatactaaaataaaagaggaactcaacactgaagataattgagaagaaaataaaaactttaattttcaagaatttttaaaaatatacaattttaaggcagcatataaaaaagataattaggtagaatgcaaataaggaaaacataaattcattcagctgacatttaattcctccagccttttctgaggaatctactttaggtcatgtgctcaatgaaaaataaaaattcaatttgaatggaagtaaatccaacataaatcagtcaaaaagaggccatttggcaggtaggaagaaagcacatttccaaatttgaaaggtcagagatgtggttgaaagattgaaaggcctagtttgcaattgtcacccaccaccttcccagacctaactcaaattcacactgtcacccagtcagaagagagaaatgcaagtggcaacaaagtacacctgagtttcctgccctgtctcctgggagagaagataacccaccttaaggttataccagtgttcttacgaaatgggagattcctctaagcatgcaggaatgatcctcagagtgccatcagaaatgttcccataaccttagtttttgtttgtatttttcctggaaaggtcctgagtactattttcatttaaaaatggaagtagaggcaaaatgagaaattactaatatcattataacatcagtgacttcctcactgtctcatgtttcttctttattcaccaattctagttttcaatctaatttattggacatcatgtttaatatttactatttaaatcatactgttttattctttttgaggaattataggtgaatatgtcataatttctacctcagggatctcagatatgtattatatatgttatttcatgtatttttacatattttgtatttacatacattgtatatttacatatttcttatgtaaatatatgttatttcagatatttcattggaagaaaatttgtatttatttcttcagcaaatattaattagaagtagtgatataagggagaaaaactaatcacaaagaggatgattcatgtgaaatattattaattcttatagggatgatggacattcatgtcaaaagtagaattaggcccagtctttgaaagcagtgaacattttcagtaagtgggttttgggggatagaaaagagcaaggacagtctgaaagcaaatagctttagaaaaacacagatatgggaagcattaggatactgtatatatagcttgggaaagtagaaccttcaggtttgggagggttggctgagggataagacagaggaggcaaattgggaatagcttgtggaagacaaattgcatcctgaggagttggaactttagctgtatggtagagaaactgagtgttttatgtcaaagctatagaaataactttcttctagaaggaacaaatgtgtgctttgatgaatgaaaggctaggaactagtaatattgttcagttactagccccttctaataattgaggcaatcattggctgcccaatctaatttttactattattccttaattgactaaggcctaagtctgagaacagaagatccaccttttccaaaagaagcatcaatcagcctatagttgggaaaagccacctcctagctgtccttagtgaatactggacaggctcccatcaatattccaccaccttcctgccagacacaatgagaagagtgagagctatgtacatagaagtcatcaggcttgtgaattgaatagtaatttactggttttccatttccttaaagggtataggtgcttgttatacaatgaagccacataaggaaaatgcccaagaaaataaagtgagtggtatctgaacaaagacattggcatctcattctgtagttggaagcattataaaaaaataagatgaacaatttgaataacaaatacaaaaacttaattaaataaacaaaattactagaaaaaataacacaccaaaaaatgactcaagtaaaatgagaatatccaataactctaattagtgtagaagttaaatcagtatttaaaaattttctttttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagcttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttctggctgcatgaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtctttcgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttatgaaatagggaatcctttccccattgcttgtttttgtcaggtttgtcaaagatcagatagttgtagatatgtggcgttatctctgagggctctgttctgttccattgatctatatctctgttttggtaccagtaccatgctgttttggttactgtagccttgtagtatagtttgaagtcaggtagtgtgatgcctccagctttgttcttctggcttaggattgacttggcgatgcgggctcttttttggttccatatgaactttaaagtagttttttccagttctgtgaagaaaatcattggtagctttatggggatggcattgaatctgtaaattaccttgggcagtatgggcattttcacaatattgattcttcgtacccatgagcatggaatgttcttccatttatttgtatcctgtttgatttccttgagcagtggtttgtagttctccttgaagaggtccttcacatcccttgtaagttggattcctaggtattttattctctttgtagcaattgtgaatgggagttcactcatgatttagctctctgtttgtctgttattggtatataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagggcatccctgtcttgtgccagttttcaaaggggatgtttccagtttttgcccattcagtatgatattggctgtgggtttgtcatagatagctgttattattttgaaatatgtcccatcaatacctaatttattgagagtttttagcatgaagggctgttgaactttgtcaaaggctttttctgcatctattgagataatcatgtggtttttgtctttggctctgtttataggctgtattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtggaatccatctggtcctggactctttttggttggtaaactattgattattgccacaatttcagctcctattattggtctattcagagattcaacttctcctggtttagtcttgggagagtgtatgtgtcgaggaatgtatccatttcttctagattttctagtttatttgcatagaggtgtttatagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcgtaagtttcaaagaacatctttatttctgccttcatttttttatgtatccagtagtcattcaggagcaggttgttcagtttccatgtagttgagcggttttgagtgagattcttaatcctgagttctagtttgattgcactgtggtctgagagacagtttgttagaatttctgttcttttacatttgctgaggagagctttacttccaagtatgtggtcaattttggaataggtgtggtgtggcgctgaaaaaaaatgtatattctgttgatttggggtggagagttctgtagatgtctattaggtccgcttggtgcagagctgagttcaattcctgggtatccttgttgactttctgtctcgttgatctgtgtaatgttgacagtggggtgttaaagtctcccattattaatgtgtgggcatctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgtacgtgagatggatttcctgaatacagcacactgatgggtcttgactctttatccaatttgccagtctgtgtcttttaattggagcatttagtccatttacatttaaagttaatattgttatgtttgaatttgatcctgtcattatgatgttagctggtgattttgctcattagttgatgcagtttcttcctagtctcgatggtctttacattttggcacgattttgcagcggctggtaccggttgttcctttccatgtttcgcgcttccttcaggagctcttttagggcaggcctggtggtgacaaaatcggtcagcatttgcttgtctgtaaagtattttatttctcctttgcttatgaagcttagtttggctggatatgaaattctgggttgaaaattcttttttttaagaatgttgaatattggcccccactctcttctggcttgtagggtttctgccgagagatccgctgttaatctgatgggcttccctttgagggtaacccaacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctgcataatatcctgcagagtgttttccaacttggttccattctccccatcactttcaggtacaccaatcagacgtagatttggtcttttcacatagtcccatatttcttggaggctttgcccatttctttttattcttttttctctaaacttcccttctcgcttcattgcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagcttgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttgtccttctaacagacaggaccctcagctgcagatctgttggaataccctgccgtgtgaggtgtcagtgtgcccctgctggggggtgcctcccagttaggctgctcgggggtcaggggtcagggacccacttgaggaggcagtctgcgggttctcagatctccagctgcgtgctgggagaaccactgctctcttcaaagctgtcagacagggatatttaagtctgcagaggttactgctgtctttttgtttgtctgtgccctgcccccagaggtggagcctacagaggcaggcaggcctccttgagctgtggtgggctccacccagttcgagcttccaggctgctttgtttacctcagcaagcctgggcaatggcgggcgcccctcccccagcctcgctgccgccttgcagtttgatctcagactgctgtgctagcaatcagcgagattccatgggcgtaggaccctctgagccaggtgtgggatataatctcgtggtgcgccgttttttaagccggtctgaaaagcgcaatatttgggtgggagtgacccgattttgcaggtgcgtccgtcacccctttctttgactcggaaagggaactccctgaccccttgcacttcccaagtgaggcaatgcctcgccctgcttcggctcgcacacggtgggcgcacccactggcctgcgcccactgtctggcactccctagtgagatgaacccggtacctcagatggaaatgcagaaatcacccgtcttctgcctcgctcacgctgggagctgtagactggagctgttcctattcggccatcttggctcctccaaaaattttcctaccaagagaacaccacacctgactgatttttaggtgagttctaccaaacacttagggatatgatcaaatacataaaaattattttagaaaatataaaatgacaaaacattttctacctcattttatataagcatatctgtatgtaaattataaatgttatatacaacatatattcaaatatatcacacacacatacacacacacacacacacacacacacatatatatatatacacacacacacatagtagtacctcattattcatagggtttggttccgggacctcctgcgggcaccaaaatccacaggtgcttaagtccatgatataaaatggtataatatttgcatattacatatgcacatccttttgtatactttaaatctatctctagattacttataatcctgaatacagtataaatgctatgcaaacaattgttatactgtattattcagggaataatgaggagaaaaatagcctgtatatgttcagtagagatgtaagtcttattttttcaaatattttaaattttcagttggttgaatccactcatgtgtaaccaacagccaggagggccgactaaacacagtataaactttagtaccaaaaccaggcaaggttttggtactaaattataacttcattctatagcaagcacctatacccagaaaaatacagagttacctcattcatgaatacagatgttcaaatcccatcattagtacacatccaaatgtatgaatctcataagcataagtaaaaaattaactcagaaattttacacagcatgatgtaatttttgaaggttcgagcacaaaagtgaacaacattttacttggaagtgcatgcattcattcaataaaacatttagaattgtggacatctctgtgaagaagggagggaaatgcaatctttgagggcacgtggcagagattcagcattctgagcaacgttctctgtcttgagctgaatggtgactatttgaaattatttttgcagcatcaaataattttagggctgaaaggacctttgcaataaacaagcctgggtttttgttttattcatgaacaaactaggctcagaatgcgtaaattctttacatacggtcacacaaaatcatccgagtctcttgctaatgttttttctattacaaaacactgatagaaactgaatgagtcttctgtttggatttttcttctgtccatttaagctgtcattaggtatgatccttatgataaacattaaataacaatacccgttacttcgcattcatattttaatatttgttttaatcatttatttttaatatggtatcagaaattatttttcaatgaactctgaatagctattatttattaagtgttccctatgtgtttatcactgtgataagttctttattaactaatttgatgtgtggttttactaaatttacagtcaaagtttattcttggggagaacatttccctaattgtattatgatttgcaataatatagggatttaatttgcagagaaacttaggggggttcaggaaagtttcctagaggaatatgatgggaagtcagctgggtgagaaatgcaattgaagttggcagaggaacaggtgaggcagcggggtgggggtgggagtaggatggtggttataagggaaatttgtaccctgcaagtaggaagacgatagattactggaatcctaggtgtaatactgaaacaacaggtaaatctatgcaccctgaacacacaatgcaggctaagctgggggaaatagtttcaatctttgaggttcttggtatgggatgttctacttagttccccatccccaagctcaatgtcagtccacagaataaatttctgagatagaaattaaaatgagttaaaattcttatctgtgtctgtgagttttatatacacagaggagtgattagcataaaatatgaaattgaagccatagaaaacaatgaacatgtaacatcagaggtagctaattccagtgacagaagcctgagggacaccagcatgtaaaagaacagaggaagcacaacctgcaactgaagcagaaagaacaaccacagagttaaggaaaaaaaaaactgaagaatatggatttataaacgccaaagggagatgaaagacttcaagacgattgggtaaagttagcagggtcaaatattgctgagagtttagtgaagttaaatgttgagaagtacatgctaaactttgtgacaatgaggtcacgccactgatttctttgttgttgggaataaatgaataataaaatgtaaaaaaaaaaggactgataagtgaggtagaggagataactagggtgcacagtagtttcaagatatttggttctgaacaggtaacaaagataggatggtaattagaaacagatgtcgcaggaagggtttcccttagaatgagtgagagtagatcatgttaaatacccacggaagtgaagcagatacagggaaaggatgggagtaattaatggaaagcacagagaaagcacagagactgtgggaagagacagaaccagagaagaagtgggcagagtaatgataggaagaggactgtttctaactttggtggcagaaagggaggataagaaaatcctttttttgatagattttatcttctctatgaggaagaaagcaatgttgtctgctgtgaattggaaggcaaaaggtgggaggcctgaggaacagtggctctaaccagtgggtcttactttgtctgcattttggaatcacctagagcactgtcaaacatatcaggttgtacttcagacaaaataatcataatctctgagggtgggactcagacataagtacttttagtaattcccaggtcataattatgtgccacaaagcctgcaaacatcaccttaaaccctggctgctcattggaatcatctgggagaccttttaaagttagtgatgcctggatcctatcatgagaggatctgattttattgtttttgtatgaggcctcagttattaggattattaaaaagcatcctgggattctaacacgtaaaccacatgtttacatgtggttgagaacccctgattataaatggtagtcagtcagtgatgaagactcaacagaggttgaaatgtcaggtgtgtaataacagatgcttgcacaaatgtgtgatgcacccatggcactcagcagtcctggtatagaactggaaaagatgaatagttggattcatatgagcccagggttttgttagctgctgctgtctgtcttggaaggaaaatgtgtaaaacatacttgcagatattgataaatagaggggtgttaatgatgaattataaagttcaagctgaatagaaaatagaggtaaagagatgagggggtcagtaaggaagaagtaaagagacagttaggcagaagattcctatgaggttgatgaacaaatatagagcaagcaactgcatgaaaaaactggcaataattgtggttgaaagtctaaaactgatttaatttaaaaatttttctttgttgttattggcatccttgacagaggctaatactaatgccagtagtcaaacacaaatgagtgaacaggtgagtattagaaatgatctttatacaaagtaatgcactgttttggaataatatagtattgccacagagcctcgcatttcccggtatagattggaagtgttgactcatatttggtcttggcagttagaaatggaggtcaagaaagatgtctgattatggtgctgcttcaagatgttggtcttcttaatataaactctcacagaaacatccagggatttagatctctctgggagagatctctgtgtgaacttataaaagacatttagctgaaccatacatcttcactgtctacgctgaaatcaacctttctttttgggggttctttaccttgataagctgcctccaccatgcctggctcttggggatacattactttcttgtttacatttcagctcacatgatggcactattttcttcaaagtttaacaaaacagacaaaacttttaactaataaatgcaagaaaaaatttcacaaattacaaaagtaaaaaatatagatgtttctgaagtccaattttccgattacacaataaattaattctaaaacttcaaagatatttattgggcttgattaccttcctactccttccaggacttacatggtatatttaactttattttccactatatggagaagtttctagggaatgtgtattctattgaagcaagtcttaaagcatttgatgtaccactgttctcttgtttctacatcttgtagagtcaatggaaggactatagtgagaggtttttaatttcggggtagatccagaaaccaggaagtgtttttatcccttatacatcaactgaatatatttgttatataatgattttaacttaaatatattaaaaataacagctattatttattatgtatgactgtatcacatacagctctagttacttaacatgcatcatgtaatccttctatcaaccctttattttaaagatgaggacactgaagtgaataagttacccatgatcctacagagtacattgttgaattttatttttgacttgaaaactgaagtatcttttggataagaaggctaagtaatccagctgatggctttctctttaagcctaccatacgagatactacaataataagagaagattggaattcttaataccaacagaaaaaccatcaagaaatcctgaagagatggaatgtggtttcatacaactgagggatttaaaagtagtctagaatggaagaaggtcaggcatcacagattaagacagattggatgagtgctttctagataggtgctttattctttcccccatatttctctgaggaatttccccttcccatcatcactgcaaagcagagaaaacatcatcagtgcagtgtcagcccaatgagatgaattgtattaggctagcattggagttcagctgaagttggaagaaaaacaaaattgcaggtggataccattattccctggttatccttttctcccaaggagccccaccacactcagtagattagtggactgcaaaatacatgttgaaaagtagcactcagtagattagtggactgcaaaatacatgttgaaaagtagcacttggggaagaggtacaaagatgtatatggagaggcagggtcacctggatgtgatggtgcagaaatgggaacattagaatccagattagaacactagaggttctctaccctgaggtacatttcttttgatgtaaatttatccactcttaaactcactaacaggagcaaaacctatggcttgggccttcaaagaatccctaaaataatttaaaaaaatagtcaaagttgctggcacttccaaagaaattttaattcatgagagagaaatgttaagatattttaagaatgcaataatataaccaaataaaacaatcagtgggccagagagtatatgaatttcaactaagctcaatatatattcttaaatgtataaaagagattactacaaatactaagcaagaacaagtagttagagaaggaattaagtgtagatgctataatttaaaaatataattgttgaaataaagaactcagtaaaatgaggttaatgatggaataagtgggtataactgagaaaggaattgtaaactggaagtcaagcggctattagagaagaaaataggaaaagtggaaagaaaagtataaaatagttaagagataattaaaatgtagaagttaaaataagggtaaagggaagaaataccaaaacatgtagaaatacaagaaggaggaataagaaataatggaaaaaagtttgaagaaatataactgaggattggaagaagttacagataacctataattagcttaataaattgaaagaaaaataaatgtaaaataaacataaaaatgtgttaaacaatttaggaataaccagtagaagaataaaacttgatcatataattttataatcaataaaaaatgtctttccaatataagaagaaaaataaataaggtatgacaaatagaaattattaaataatatggtataattttaatgtaacagtaattgcaataaattttaaatgtattttatttataaatcaaaagacaaatactctgagatgaaaatttttaaaaattacaatacaagtaaatactattgagatagaaaattatgaagacattgtgaaaaaaaacagagaaaatcaaccaaagcaataatggagtaacagttttaatattaggccaaaggtaattcaagtcaaacataacagaaaaaatgttacattctgataaaaaaataaatctaggaaaagagcaatataagtccataggatttataaaaaataataaatatatggataaattataataaaaggaaagaaaaataaaaaaagatgaaactaaagtttgtttttttgaaaaacataagaagtacctgcatgcactgcctagaggcctgagggttggcctgccactgctactgccactactgatgtcctgcatgctacccagggactagaggactcacttgcctgctgggcccaccactaccattgctggcacctaagcaagttgctggggggcccagggacccatccacccaaacccccaccccattggcatttttgtatatcacccaagatcctgataacaagcatgcctagcttgctgccaccatcacttgtgcctgaggactggcctgcctggtgtcccattcctcagcaaagcttcaccacagtctccattaacaaccacagtctaagccactgaggaactcacagatagcactgatgcttattataaccaaagaaatcatatggagacgactgtgcccaccaagcatcaaaacaaaggtactctacccaaccaacactacagatatatctatagggaaagccttttcctacaaaagccaaattgtaaaactggaagaagtatctgttacacagatgcacagatgtcaacgtaatgacacaagaaacatgaaaaagcaaggaaacatggcgcctccaaagaaacacaataattattcagtaacacatcccaaagaaaataaaacctgttaaaagtgagaaaaatattcaaaggaacaatattaaagaaactcagtgagatacaaaggaatacagattaaaaatagaaataaatcaggaaaaaagttcaggatctgaatgagaaatttaacaaagaaatagatatagtaaaatataactaaacaaattctagaactgaacaactcaaataaaaaaataaaaatacaacattgacctttaacaataggctagatcaagcagaagaaataatatttgtacttgaagataggtctgctgaaataacccagtcagctaataaaaaagcctatatgacatatgggatattataaagcaaacaaatatttgaatttgtggtgtctcataagacaaacagaaaattaaagggatatgaaagctatttaatgaaaaaatagcttaaaattacccaattcttgcaaaagatatggacatccaaatacagaaagcttaatctccctagtagattcaacccaaaatggtctcctcaaagcgtattatagtcaaactgtcaaaagtcaaagacagaatcctaaaaacagccagagaaaagcatcaagtcgtatataaaggcatcaccatcagactaacagctaatttctcaacagaaaccttataggaaggaagagaatggggtgagataattaaagtgctgaaaagaaaaacgaacaaaatacaaataacaataacaaaatacaaactgtatggcaagaatgctatacacaacaaacacattcttcaaaaaatgagacagaaatcaagtctttcccaaacaagcaaaaactgaggaagtttatttccagtagacctgtggtggtctagtggtgatatagaatttcctaccagaaatgcttatgcgagtcatatatctgcaagtgaaaggatgatctccacaatcatgaaaacacatgaaagtataatactcactgggagagcagacaagtgagaaagagaaaagagtcaaacattaacactactgaaaaatgacaccccccaataataaaaaataaaagaagaaaaaggggataaagcatatgaaaatcaaccagaaaaaaaaaagtgtagcaagttgacaggaataagtcctcacctgtaatgataaccctaaatggaaacagtttaaattcacgacttaaaaatataaactggctgcataaataaaaacaaatatggctcaattatctgctgcctataagaaactcacttcacctatagagacacatatagactaaaaataaaggaataaaaaagatattccatgcaaacaggatccaaaagtcagcaggagtatctagctatagttacataagataaaacagacttaaagtcaaaaacagtaaaaatgcacgaagaatgtcattatataataataagtcagtttgaaagaggatgtaacaattttaaatatacacgtacctgccatggaagcacccagatatataaagctaatagtagatctaaagggaaagataggctctcagcattatacagatcatgtagaaggcacatcaatacagaaatattggatttaaactgcattttaggccaaatggacctaacagacatttaaacaacatttcatccaacagctacagaatacatgttcttctcaccagcatatggaccattcacaaggatagaccatatgctgggccacaaaacaaggctcaacaaatttaaaaatttgaaatcttatcaagtatattctgagaccacaatggaacaaaactagaaattgataacaacaggaactttagacagtgtacaaatacatgcaaattagacaacatgattctgaacaactattggttcaaagaagaaataaagaaggaaacaaaaacatttactgaaatgagtgaaaatggaaacacaccataccaacacttatgagacacggcgaaagcagggttaagagagaatgtaataccaaaaaatgcctacatcaaaaaagtaaaaagattaaaagtaaacaacctaattgatgcacctcaaggaactagaaatgcaagaagaaaccaaaccatcattaataaaaaaataataaagatcagagcagaactaaatgaaatcatgacttaaaaattacaaagaatcaatataatgaaacagatttcttttttaaaaagataaaattaatccagtggtagctagtctaagaagaaaaaaaaagaagacccatataaaatcagaaccgaaaaaaagatacactagaggagaaaccacaaaaaatgcaaagtataattagagactatttgtgaacaactaactatactctagcaaattggaaaacctagaggaaatggatactttcccggacacgtacaatctaccaagattgaaccaggaagaaacagaaaacgtgaacagaccaataacaagtagtaagattgaatcagtaatcaaaagtcttctaaccaagaaaattccaggactgaacagctttactgctgaattctaaccaatcttataaaaacaaagtaactaacaccaattcttctcacaccattccaaaaaattaaaaaggagggaactcttcctaattcattttacgagaacagcattaccctaatactaaaaccagacaaggacacaacaaaaaaagaaaactacaggccaatatttctgatgaaaatagatgaaaaaatccttaaaaaatgccagcaaatcaaatctaacaacacatcaaaaagataatacattatgataaagtgggatttatctcaggatacaaggatgttttcaacatgcacaaatcattaaatgtgatacatcacatcaatggaatgaaggacaaaaaccatacaatcatctcaataaatgcaggaaaaagcaaattatgcacaataatgttcataagtgacaaatccactgataatatcatactgaatgtggaaaagcggaaagttttttctctaagaattgcaatatgacaaggagtaggagtcctagctagaacaatcaggaagagaaataaataaaaggcaaccaaattagcaaacaaagtcaaattattcctctttgcagacaacataatcttacacacatacatatatatgtgtgtgtgtgtgtgtgtgtgtataaacctacacattccaccgaaaaactcttatacctagaacacaaacaagagaaaaaaagaacaaatgaacaaacaacccctccaccggcaagctcacaaataacctcaaaatataagcaaatgatctgaataggcatttttcaaaagaagacgaatgactaacagatatacgaaaaaatgcctaacatcactaattatcactgaaatgcaaatgaaaactacaatgagatatcatctcactccagttaaaatggttattatcaaaaagacaaaaataacaaatgttagtaagatgcagaaaaggagaactcttacacactgttggtgggaatgtaaattactgtagccatcatggaaaacattatggaggtttctcaaaaaactaaaaataacaccaccatatgattcagcaatctcattactgggtagtgatacctgagctcccttgtctactgcagcactattcacaatagccaagatatggaatcaatgtaagtatccatcaacagagggatagataaaacatatgtggtgtgaatacaaaattgaatgctattcagccacacaaaagacaaaatgttgtcatttgcagcaacagagagggaactgaagaccattatgttaagtgaaataacccaggcacagaaaggcaaatatatattctcactcatgggtgagagctaaaaaagttgatctcatggaggcagagagttaaatgatggttacgagagggtaggaagcgtggatgacggggaggaagagaggttgttcaattagtacaaacatacagttagatggaagggaaaagctctagttttcaatagcacagttgggtggctataattagcaataatttattgtatatttaaaagtaactagaaaagaagtcttgaaatgttcttaacatgaagaaatgataaatatttgaggtgatgggtatcctaaataccctgattttacacattgtatgcacgtaccaaaatattacatttattctagaaatatgtgtgattattacatattaataaaatgttaatttaaaaacctttttttttgaggatctagacaaattcattctaaaatgtctaggaaagaataaaggtccactaatagctaaattaattttgaggagcattttaaagagaaattcttaccctagcagatatgaatacatatttacaaaaccacggtaattgtttaaaaaatcacaatagggtattgttgcatgaacaaacaacatttcattgggagaagatattttagcatcagaaactgacaggggattaatttatagaactctccataccatgagtggggtgcatgctccagactggatcccaaagcctaaagccttgtctaggtgaggattgcaaagtgtcaaaagaggtgagctgagtctagagcttgcctagtctggtcaatctttgacttgagaactgaggtctgaaatttatcaagaaagaaagaagcatacatttgaatgaaaactaaagttagttaatagactaataatttggacagaatagaagtattgttatatagtgaaattgaagctcagagagataaaattaataagaaaaaccaacttcaagaaaaactgattttgggaaaaatagatacaaataaaaaagtacaaggaaaataacataaaattaagaattgtagaccatgaactttagtataggaaagaacttggaatttacaaaatactaatataacatagtgggcagaaatatataaattagacattttaactagagattttatattagattcagagaaatggatgggtcatacaaaccaaaaatattcaatatttagaagattcaaaaacacaactattaagctaaaatgcaaatatagagagagaaagagggagagaaggaggctgtaatgaagtgtctgactccatttttgatgtttgattgctgacagcttttaatgcccacatttttcctttccttttctgctccacatttggtcaggcagatgagaaatccaggtgtccccttctttagtgccagccagtggtaagttaaagccacataagtcttgggcagtatgtatgggaactctcaattcagcctcagcccctcaacataataaaagtcacgccggtctcctttctctgctctctgaagccagttttggacctggttaggagtctgtcctccccacaaaacctcattatgtgatacacattttatatccgttggtgcatgtgtggtgtcattagtttggcatctgaaccaaatttgcgatatgtgtatggggaggaaggttcacacagtgatgaagaaaattttacaatcaaccaaaataaaaaaatacagtcttttcaaacaaacatataatatatacagaaatttccacaaacatggcctcaaagatagtctcagcttatttttaaaaatccacattattcagattatattgacttgctatgattcaataaaattagaaatcaagagtaaataaataacttaaaactttctctctctctctggaacttaataaacctactaccaaataacctttaggttgaacattattataaagggaaaacactttgacctaaataaccttgaaaatacaacctatccaatgtattgaactaaagtaggtatgtttagaggaactataataacattaagtatatttataataaagactgaaaataaatttggttcagatgtcaaacagataacatcgcacatgcagcaatagggtaaaaaggctgatttcataatgaggctttgtggaaaggaaatacccccgaacagttccaaaacaggcttgagagagcagagaccaacaaataacttaggaaaggagcagcataatatgcttatgggatatatggaaaaaataataaatataagaataaatcatcatgaaagaaagaaaaagagaagactcataatagtaaaatttgttctttgaaaaaattaataagaatgaccatcctctgggaaaactgatcttgaaaaaaagagaaaagatgcaaataacaacaaaaaagtagaaacatcataattttaacatgaaataacaaaaagaatatgaaaatctatatccaattatgtttgaatacctagatgacttgaataaatttctggaggaattaaagcctgccctgcaggcttttgcaggtgcaaaaaggaagaaaatatgaataccattaaaactactaatgaactgaaattcagccaagcccctcctcccatcaacaaaagattctgcaggtgaactgtaccaaactttcaaggaaaatattattcattgtttttgaagtttttatataaaacagaaaaaagacaaatattattaactcatgttatgaggttagtataaatttgattaacaagttggataaataagagaaaaagaaagttctagaggaatttgatcaatcctttatattgttgcaaaagtacaaataaaccattcattaactggattcaaatgtgtattttaaaaaatgatcaagatgggtccatctcaaaaaagtaaggagagatgaacatcagaaaatctagtagtacaatctactacattaattgaccaaaggagaaataagttttgattatcagaataaataaggaaaaactttaataaacatcaactcagatttattacaaaaactcctaaacatagaaaacaaagttgctggacataagatcagtttacagaaatgaagttcattcatcagtattacgactaactagaatatgaaacagaaagtaagagaccaatcacagtaaaaatgaaactatagaattgtaggagttaatctaataaagaatgtgcaacatctttatgcagaaaaaaatcctattaaatgatgttaaggaatacctaggtaaatggtcaaaatactgagccatgtttatggatggaatgattaataatataagtatgtcaattttactaaagtagcatataaattcaatgcaattgcaatcaaaattacaaacatatctttaaacaagacattgaaaaactgattttttatgtgtttgaaaaaataggatcttaaaaattccggattttttttttaaataaagtaaagcctccccagttctaatatatactaccaagtcagtgttctggtataaaagcccaatggaaccaaatcaaaggtcagaacagatctggtgtatattggaatttggtttataactggagcaatgcctcagatgaataaagataagacaggcctaaatgtgaagagtgaactcgaaagccaaaagaaaaaataatctgagacatgactatagctctgaagatagcaaggccttcaaaaacaagggcagaacattaatgagtaaattgagagatttaactacatcacaactaaatatttctgctcaagaaaggataaatagacaaagttaacttgacggtgagaaatggaaaaagatatttacaatgtttaaaaaacccacaaaagattaatatctaaaatatgcaatgaatgtcaacagaaagaagacaggaaaaccaattgaaaagtgaaaaactcgcagatggaaattcgggatgaattataagaacaagacatgatgctgtgaaacagagtctctgaaccatttaactcaatcacttcatgagatcatctccccctatttccacaaaatgtagagtgtacttaaaaatcaaatgcttatgtaaaaataaaataaaatacaggagaagtctaaatttttgcttggaagtaactgctcctgaaagattaaccttttcagcaaatatgcacttagcacctactataggcctggcaaattttgtgtgctggggataaaattccactcttgtggcatttacattttagttagagaaagtgctgtaagattcattttgatagatattgcttttatctgcaatatctaaagaagtactttacacacagttgaatattaaataaatattattgactgaatgaatacatgattaatgatatgctggcctcctactaaaatgtaatttttggtggtcccagttgagttagatcttttagtaaaaacctgagcaggttagtacctttcttccattcttgcctctgtgcttcgtatgctttagttcaatgtctaatttcacagaaatgtctcacaaggcagctatatggtatacagatttatttagtttcacatcctatctctgtcacctactatgtgtgttttgtcagtttaaatattctgatgctcacttttctcatcagtagaaaaggggtaatgatacttgcctcggagggtggccatacagtttaagagtgattaaacacacacacacacacacacacacacacacacacacacacacacacacagcttggcatggttcccggcatggaaggcacactctataaatggtagctattatcaacaattatatcttgttaaatgacattactaatgagtgaatcacaatggagaaaacagcaaagtacagccctacatggaaacttcatttttaagcacagtctgtcctttaaatctgtgggcacatttcttctcctatgcaaaatctcttggttaaggtgcaagatatcagcaagtggggatgatcttttgggtttaatgccttttctcatgttgaatctatacattcatgaattgctgaataccagagccacgtctccaattaaggaactatgcttcctatttttacctctctggcctattctagctttcccttcagtaaaagaacttgagacaagggattacatgcaggtagttcgttttcgaaagtgatttcatggggcattaactttcttgcacttccaagctgtgcttgcattaacacctagaaggtccctttctttaaacactaccttggaggccttctgacctgcacagcatggcttcaattgataattggctaatataaggttgccttttcttttttcaaagttcttaagaacttaacaaaaggattactaataggacattatctcttttgactttcaggttgctcttgtgtgagagcctggtggttcctaaaagtgtttcacattgtggagttgaaaagccccagagcataaagcaagtaatatttggagtacctgagacaaggttctatcagggttcctccttgtgttgctgttaactgcagtgacaattagaataaaacataggccaagggaggaggtccaagagaagtccaatacatcttcctttctaactatttgtaaatatcccctctattttggatgctgccacacgtgctccagtatacctgttccgatacagaaccatagaacattagagcagagaagaactttggaggctttcactttgccactgtctcagtggtctgtatttgacgagtaccaacatattaagacattcaattggtgaatcaagtccacgtttgtaaattttctgccatttgggttaggcaacactccatgaggccttatgtagtaactgaggaacatttttggtgcaacagaggtaggagaagtgggattctgggccacatgttcataaagttgccttgcaccctctggacctgcttgcacacaacccattatacaatggatcactgccttattcacccaaacttataactcagtggttgggacaaaattcagctcagaaaaggctgcattggtggcctattctcctatgtcacatagttaaggtattttcctcactaaggattagcagcaaaccaggaactgattttcaaaatgaaaacagttgtttgaatcatgactctgttattggaacttgtcaggcactctgttcagtgtcagaatccaacacagataccattggatctgctgtgtcctatggcccatgtgccaaagcagcttgtactagagggaggaacttctataatgccttctcttggtctgaaacctgcccaaaactggcaactttctgtgtcatcagaaagtattttagaagtattcccaagtgcagtattcccactgtccctaaaattcagaggcttactacatgctgtgccactatttagtagtaaaaatacaaggtgcaacaacttctcttttatcctagagggttagcttaaggcttgaggatgtcctggcttgatctagaccttttgatttctagaatttcattgagatagcagactaataagtggtagattatctggtctcacattttttttttaaatccatcctattatttcttctttctgaggcttctgacttcttcctcaatcctctgctgaggcacctctgataatctctatgccatttttgcagaccaagcttcaaggtgtcatcctggaagcatattgagactggttctagcttctttgctaaaacattaaatcctaaaacatgaatgctttaatgtcaatacattctctctcatgcagcctaaaagcttaaaaataatgatacaaaaatgctcccgtgtcagtcttgaaatgccatttttttttttttttttgagacagagtctggctctgtcgctcaggctggagtgcagtggcacgatcttggctcactgcaagctctgcctcccgggttcacaccattctcctgcctcagcctcctgagtagctgggactacaggcgcctgccactgcgcccggctaaatttttgtatttttagtagaaacggggtttcaccatgttagccaggatggcctcgatctcctgaccttgtgatctgcctgcctcagcctctcaaagtgctgggattacaggcgtgagccaccgcgcccggctgccactgattttttttttatcaggactttgtcattggcttataaaagttatttaacccatacattctgtctcttttgaaactccactcttagagttgaacacagggcctaattttctgcacactttgctctatggttgcaggtgacaaagtcctctctaaatatttcccttagattcttatggctgttataatgttccagctaaaccttagtgacaaccttaataatgacagtatagcatgtgatgggatagcatgccaggagttatcagcatctcacttactactgcaataatggtgtttgtatccttgtgtgtttggtgaatgatccaggtccaaaatctcatcctgatggtctgctttctagggccacttgtttcttagcatgagattaaccaatgaaatatagctcaaggcaagggcttatgttcagatagtttattttgagaatggaccccaaagaaccaaagtggtggattaggaagcatgaaatagggaagaagaaaaggcactaaaggatgcattattaagttggtcaccactgtaggaaactggggcttgattccaccaggaccctctgaggaaccctacagaattgcctcagaattgtccacctgtgggaaagaagaggggagttttgtccgttggatcttatcctccattgatgaattttccccattggcctttaatttccttgtacttctgggttgcacatgtgtgtctcataggttcctcaaggagtcccacattgtggagcaagattgcaacacagggatactgctgcagcatgattggagtataagatggggtaaaaggctgtaaattgggcacaagaagtgaccaattatactcccttctttttattaaaactttccccaagttgagttattcatctttacattctgctccaggtgcctcattaattttttttttttttgtagtagaatcataaaacattggagcaaaaggaacctctgagaaattatgagaacccttttatacagatgatgatactgaggtacaaaaaagcttgtgaattctgacaaatatcatagcatatcagtgctaagattagacttggagctcaggattcttggttacctgcatttgttccttgagactcccaacatcttggagttcaagaggtcatgtaattgttaatatgcaaatgatctacctatttacttatggtcttttttctttgagaataactacagtaatgctacttatgtttattcagtactttacattttgttgagcaatttctatacttcagtccatttaatcctcacaggaaccttataagggttgtgttattatcacttcatagagtaagaaatagaagttggagagtcggttatctgtccatgatcttggttagcaaatataattctgtcttttgaaataattggaattctgtcttgtgaattcctttattacaagctatgggaagatgctttataaatgctaaaggagtacacacatataaaattatgtcgttgagaaatctttaatctttcatgaaaatgggtggtgtccaaatataatcatatacaaacacatgcatatacacacaaagcagaataattattaatttaaaatatgtaaagctcctggcaccatttgtagcataattgttgtttattatatcaatttttttcaggtatttaaaaaattgttgagtacttattgaatacctggcattgttcacaacactgtggatcaaagtcagaacaaagtcttgctttcatacagcttattattaatattaaaaattcatgtaatttattatttgcatccatgactagaattcaaactgaacatcctgtgggctgtgatattttttattgagacaagctatgaaagaagaaatgactttggcgcctagaacaggtaggcgaactggagtacacattctgtacattgtaggttattttcaaaattgctcctcatgatggagggagaccaataagaggaaagcaggtgaaacaaagaacttctgcttcaagcaccgagtttccttaccattttcacataagtaaaatcacaccctcatctccattcctcttacaccaagttcccaactctgctcagccaccaataaaagcatcgtcctcatttctaacttccaacacttgcctactacttttgccagcttgtggttacctatggaagacattttatggcctgaaaatgtctggcttaagaagctccccccccaaatatgcatagcaaaactgatggtaacatatggccctatattttttcccttcttgccagttcactaaaataaatttactttcaatttacatattcttgtctacatttcagagatttaaatatatttgtaaggtctgtcctgtctatctttttctgagattatgcaacagctttgcatgctgtttaggaaataacagaaacttttatgatttttagaatctttcatttcctaagaaatttagaaaagcttatgagatcagaaagagaaaggccgaaatgttaaattatgtaaaatgtgtaataattatttctataagctaagtggtaatatacttttccaatttgaaaacaaatctactgtctataaaactctaaataaaaattctattagataggtacatactatatacaattccatctagatcctttagacaaagggcatatttttaagatttattggaatgcaaaggagatcatggtggggatttttcaatgaaagaaaaccttattatggacctttgaatttgctaatatggaaatactattatttttatccagagatgagactcttgttcagtgagaaaaactggcaggctctgtgagaatgtttcaaaaaactggcttccctcttccggggtccagccttaaccattcttgagattttcgtcaacagcgtactgaatgtggaaaggagtggtcctgtagacaaagagtaccctgtgcctgtagcaagagtgatccaaacgtgaaaggaggggacacttagctatgttttgcttgcttatggtctagattctcttgtggagaacagagctgtgactgggtctttatacattgatgataggactgggtcatcaacctcccttactgatcatgtggctacactctagggaaccattattagggacccttgcctttaccctgaaaaatcatatggcaggtagtattaaggatgtttatgaggtcaagagtaaagtgagatattttaagataattttcagaacagtggttcttaactggaagcagttttattttttcaggggacatttgacagtgccttaagttattacaactcctgaagggggcaactggcatctgatgggtagaagctacaagtgttgctcaacactagaacaaagaaatcttggtttagagttttgttttcttttcttctgtttttgctatttttgtttgatgccccaaacagccatgttaaaatataaatataacctattgttactgagtaatgtgtgcagaggcactccttattttataccatttcagattttactccattctctccttctttgctaagcctcttcttgcatctctctccatttcagaccctaatggtagcccattcctgaccccattcctaagcatcatctcatacctaaatttcaactatagaattggattcaaatatattgtagtttaaaaaaaagttgaaagttgagtggcctagttctttagaccacaaaatgttttcattgagtatgatatacccaagctatgatatgtccatgcaccaggatgaattaatgcattttacctataatactcaagtgacttgtactcttttcttttcatagtgtttggcattatagggtagccaatcttcagacagaggaagtgcctattgcagcaccaaatttgctgcacatatttatgtatatgtagggcattaaaagaaggagatactaatgtaattgataaaaatgagtgattattttaattaaaatgcaaaagaatatggcagagcatcaaataacattcctttttgcaaaacagaatagataataaaatgttctcttctcaaagaagagaagtagggtagaatttttctccaaattttcagaaaggcatctatttcttaaattggtaaaactgttaagtctctgctgtttaggaaataacagaaacttttatgatttttagaagctttcattgacttgcggtcaaaaggtagaattaatacagagtagaagaaaaatgataagactcgatggtgatttgaaattgtaaagaaagaattttacatttaaattatacttagagacatagaaagacgagattaaagccacagtgagggagcggtgttgctgcatacgtgctcaatcacgaaggtttaaaaacagtataattaagcttgcgatctcaaagacagtagtgtgtctgattatggggaagagtcttattgtgaaagatggagcagatgttcatgcttgtgagacatggagacagagatgtctgattttgagcgatcaatactttatgattgtgaagtttgacatttccaatctgataaagaaaaatatctcccatgtgatacaacattctcggctccttttaaaagacagcacttaagtattatttctcttttgggtagggagacaacaatgactatcatattatgaaacaatccttttctaggcattttcactagcatataacatcctaaaaatgcagagagaaagaaaagaataatgagcgctgagggtccaatttgctctaaaaattcttttggagggatggtctcatcttctgatctcaggggcaaatcacacacatattttttcattccaaattagaatgcattacctatagtaacctgttctgattactcctgtcttcaccccaaacacattccctcaaaagggaaagggaatacatgcagagtagccagtggagtatttttgttttaattatactttaaaatttatctaagccactttttgtaattgcttgcttcaaacaaatgagcccagccaatttgccctaggagacaagaaacgcttcatgtcctgaggactttctgtcttccatagagagttgaaatttggcatcatacagctgcttcatagccaagaaattaagggattttctatttcaatagctagctgcattcagagatgttagcctgttaggaatgtgtgtctacagtcagtaacacctaggactgatagcaaatcagacgtgttagagaattttctcaaaaattgccacagctgctgtgtttctgctagaaaataaataacaaatatattgacatgccttttccttagaacagcagctgtactgatcaatgctgttaaaagggctgtctggccaagccgggggttgcatgtgacagtctgagttggtgtcaccgaccctgatgtcctgttattctaatttgcaaacgagagcctaatctcccaagttgaattctttagatattcttctaccttgacactaaaaccatctgccatttggggattgataatgtgtaccttttatgtgttttctcatcattgacatttcctgagccaaaccattagggagttgaccaagggagggaaaggactcccctgccctcaccacccccctctcttttacttcaaacaggcaatgaaaacattttgcataaacaaattcccagtcataactaatcatatgaaagctgacaaaagtatgttatcctacactatgaaaatactaatcaaagcagcttgtcaattgttaaagttaatgatttagatatgcaacactctgactaaattttagtaggtaattacataattatgcacaggttagcacaatcaaaaatagcagttgcctcctcagtctttaaactatgttacggtactgaatctcattctggaaatgacagtttcttatgatgtttcagagcatgaacatggcaccactggctattatgtttcggaaggatttccatgcatctaggctgatctctccaaaggttcaagatcaggagggggtttgtctgttagtgcacaatcaaatttgtagctgaaacactgtatttacaagtttttttcccatctttagcgcaagtaaggcttattattagttacagaatgatccattctaatttataatgccccatagtgttctcaaacttcaggatacaaatacaaaatatctgttagtttatatatttaaaacatttcagcacaacttttctctaaccaaatttctggaaagcaaatctttttttttttttttaactgatttgtactctactgttgaaatcatgtctcaaataggaaaaaaaaatccctagaggattgacaggatattttatcatgcagggcattgaagtctgggatattttctaggactttcaaaaatatgtggcattatttagctctggattctctgcctcaagcccagaatttggagagaaaggaagaataggaggaaactttatcaggtacattctcattttctcctctttcttcttctttgcttctttccatttgttcctttttattgagttcatatcatgtctcaggagacataaaacttcagggggatagaaaaataaaaagcaacacaatctgaaatttcagagaggccccatatagttagaaaagacatgtagacaggtactgtctatgaggtaggtcctagaatagaagtataaataggagtttatgaaagtggaggtaggaacacttaagtttgtgacagggagaagtggtggttgaggaagctccagaaaagaaaatcctttatctgaatcatgagtattcaaggcagaaagtgttttttggggagcaggggaagggaggacattcaggtagagtgaatagcctgtgccaagatatggaagtctgagaacattaaagtgtttggtctggagaactttgatatatccagaacttatatgtaagaacataaaggagacattcaggaaaatctcttctggggcctaatagttctgggactgtaacacagtacttttttttccgttttacgtgaacatatgggattaataaacaatggcttttgttttgtttttttttttttttttggtgagacggagtctcgctctgtcacccaggctggagtgcagtggcgcaatctgggctcactgcagtctctgcctcctgggttcacgctattctcctgcctcagcctcctgagtagctgggactacaggcacccgccaccatgcccggctaattttttgtatttttagtagagacgggatttcactgtgttagccaggatggcctcgatctcctgacctcatgatctgcctgcctcggcctcccaaagtgctgggattacaggcctgagccactgcgctcggccacaatcgctatttttctaaatcaagatgtgtcagtctttgtgttcctttcaaaagataaagtcagtgtaacatctgtaaattccccacgtaaaaccttttgttcatgcttctttttctttgtgttcctgtgaaataatagggataaactggctccatcgtgtcctaaattggttaacgacttttgattagatattattagttgataatttctgcttatgatggcattagatcaaattaatgatcaaattaattaaactcattggcatcctttttcagccataagaaacaggatatgagatgaaatttatacactagtgctttattgtaggatgcagttccggagcagcaggaatgaagggaaatgggaagtaaggaaggactaaagggaaagcaaatgtaatgcaatatgttattgaggtggccacagcttcaaaaaaacagacatttactttggggattgctatggagaatcatatggcctcatggtgccttgtacatcctgcaaagggaagaaaggaagaggaatttatcttctggattcttctgtttactgttcaaggtgtgccccatggggtgttaactcccccaaccttccaggttgtgttggcagcacatgcattatgcagtcatgctatagcctgattccagaaagagaatatggaacatggtatagcccaatgcatatggaatagagactcttctgagaaaaaggaagtagcttgaggagttttagaaatgatttttttagccaaaattttatcatgctgaaagctattatggacaggaaggagcacgtacattgaatggtatattaatttactaaccatatgtgtttcaaatgtttctaggtcagatttagtccctgcagtgcagttgtagattaagacagactggagggaatgcagtcccctgaacagatttaattagcataggaccctgggatgatgtgcactgtgtatggctcgaatgtctctgacttcatattgcatggctgaaggtcacttccaaactgacaactgacgttaaaaacattgatcagaatggctttttcccttgttaacagaggtgctccccaccaactcatcataatatgtcctctctttttaaatctctgtgtacaaatgttaaaattttcaaaaccaagtttcaaaaatgacagtaattttgtaaatgccgtcacaaaaatagagtgaattttcaatgcaggctgatcatttcctttcaggcataattcttgcaatgtaggtagccaatcctaagtagataggattagccacagattgtgcaactcagactgaatgaattatttttttctagtagggttacttgagataaatgaaaaaaaaaattacacttccatactggaatatgaattctttaaaattaatatatatatacacacatatatatgtatttgaaatgtgtattttgatgtctctctcactaatatgttaattttgatttagaagacaagaatataatttcaactttgcaaatgacatttaagagattatttctttgatttgggaggcaagactgaagaaaatactaatagctacatatagtgtgtttgtaatctattttgaatttctgtttcagtcaaatttgaaatgttgatgtattgttcttctttgcattgtattgaacctatttgctgctctgctcacaaatgctaatatttctgtgaagcacagagcctggctcctgcagcttttgcttcaggcatcaccttgttattcttttcagcttcttcttagaaaaaaaagaccctgacctcttacctaggtctcactatctacttagtacttgtgaaagggcaacccatcttaaggcttctgtatacctgctgtgtttctaaatcaccttatattattatctttttcttttctatctcagaatagaaatgtacacacaaagtaccatctttctgttatctgtcccttagttagcaaagagcccatgataacttacttccatttaaaagatggctaccttcacagtattattgctgatgaggagaaattttcctagtattaatctccttttttctaccactcctctcacttattttttccttgctaatgcctactaatttgtatttctcagaaaatacaattccaatattacattttctatgtgtttttagtgagccttgtttgattcacccaactcctagttttaaatctgagttctttggaagaataaactttttcttcttacatttagacatattttgaacataacatgtcaaaactgtttttaaatgaagtgtttggtcatagcaatgaatactgaagtctttctattaatgtaaatctttcctagggcccacaccttcagatgccttaaaactgatagaagcaaaacatcattctagaacctgaatttaaatcatttccatatgaattcaaaccaagcagacaattttcacagatgacaccaaattttacagtttcttttctttctttctttttctttttttttttacttgagtgtgattgatttatataaggcttctattttgattcatgactgtgaatgagaatccttctagcacttgacatccatgcttctgaccaggtttgaggatagagtcaagggtctgtgcactgtgtgaaataaaaacatcagtatatgcagatgacaattctatcagaaaccaaactgcccactacaaaggaataacactatgagatgagataggagctgtttcaggagaaaaacaaaggctttgaacaataaatgggtaaaagatttattataagtgactccaagataattcttttgggatgctgtactatttctcatgtcaacataatttccaattttatcgaataacagaataaaggcaagcacgaaacctgaacaggtaaagtctaatgttttacatggaagtaaaggtgatacatcaggaacttctgcttttcctgtcacattaaaaaaaaaccactcttttgtggttacactcaagaactgtgaagaatctaagatgtcactattacataattgcaaggtaacaagttagcctaccataatttctgggtgctgcaaagctacaagtctccttggtaagagacaaatgaccttattactcatggcacaacaggcagcatgagcttcctgttgttggttcttctgatcccaccaaaacactaatactggccatgcagagaggctcaggtggatgttgaggctcaggtagataaagagaggctcaggtggatgtagctcttaccagtagagctacaaagtttgtatcatagctgagaagctctgagtttaggaagcctcaatcctttaaaagggactgatacaaacttgcccacaccttgaggctataaagaaggaggaactacctttaggttcaaagtccccaaacaaataggggcccgaggagacaatcattcaggggccactgggtgacatttttttctcctttggctcttttacacaagcttgataccacctcctgaattatggacctcccagcatctagagtgttgagggtcagcagcttcttcctttgggtcacatgtatgctcggttgcatagatcttgatggtttgagacaaccctgtacctaacattgctctttccctgggacaactcatggcaatcattgggggcatctctaaccaatagatctacaaggtttgagttgctcttctcctctgggatactcagcttttccttaaggcacccgttcatgtgccgttttttggaatacacattctttttttcatagaattttttcttactcttcagaatgctgggattgatagaaagaggaatccacaaagtatatgcataaacaaaatgcaaaaagatatatttaaaatgttaaaaactttaaattgtattaatgtctattttatgaaaaaagataattaaaaatgggttaaacattagggaggaccagattttaatagtggcgttgatagaatccttatgtttgtgcttttagcaggattggccactaaatgatttctccagcaaaaaaaatcatgaaagaagaccaaagacagtaatgtctagtaatagtaatgtctttgttaaacataagtgaaatcagaaacttaaaaatatgtatatacatagaagaaatagactttaattgcatatctagcccctgaagcctggcatatcaataatttaacagggttttctggcattatctaaggaaaatctgtgggacacctattttctaaggttaagagatttacttttctttctttctttctttctttctttctttttttttgagacagagtctcactctgtcgcccaggctggagtgcagtggcatgatctcggctcgctgcaacctccacctcctggggttaagtgattctcctgcctcagcctcccaagtagctgggattacagattcccgccaccacgcctggctagtttttgtatttttagtagagaaggggtttactttttactcaagtcatgatcagttgtaaaaaagtcagtgaaatggagaaatcagcccagatctcttgatctccttcatcatctaaacaattcaaatccagtcattatatatcccctatactggcatcaaacaggtctttttcatgttacttgcctacttaagacccttcaatgggtggccattatctataatataaaatataatttcttgagtagtatatatggtctttcattattcaacccttgaggaagtgttcagtttcgtccagacacttccccagttgcaccacacattacaactatctgtctgtgttatatataatgcccctgaccatgacttttgcatatgttgttaccttagcttgggtaccttaccattttactctttgtattcctatgacacccttagtttttgaaaatcagctcaatattaccttcagaaaaagctatatttatctaacactgtatatgtaatttttgttctctgtataggcttttattgttttgcccttttctgtcttgtcattttgcttgcctttttctcacactgtatgcctagggcaaactttaggcctcatcttgcagacgtcttgtttagcttgaggtctgatgcacaagagttacaagatgaaaatttttgcagaaagagtgcatgaacgaatccagaaaatgtaattaactcaaaaataatttctagaaactattaagtatatcacattgagtctagaaaatggatcccaatccaaaagccagttttggttttagggacatctccagagaaggcttggaagtccttccgtcagcgtagagagaaactttcacacaaattcagaactgccttagatgttactgatggggacagtaaagttggtgttgctgagtaaaacaaaaatccttttacccaaaccattggtgttgtctggtgtgtcttttgagaaaataaataaataaataaatcatttaactgatgacttaattttgagttgtttaagtcttttaaagatacattcattatagtataaaagattgacacttcaaggtagtacttttgcaaagcactgaaccaacatagaaaactgctgacctaaataagatagttagtagaagtagaaaagatgggtaagtgtgcctgtaaaatgaagacagagttcataatgaaaggaagagaggagcattaggagatgacttattcatcttgcattttcagcacctagcacagggcttgatacttggtagatgctcaatatagttttgttgaataattgaatgactgagtgaatgaacaagccaggcagacagaaggagggagatataaagagctgctatatttgggtaagttttcagtagaagaagatcacagaatgaaaaatgttctactctgatcatgaataaaaagcagagaaatatatgaaatattaacaaaagaagaatagaataagcctagatttttttcaaaggtttatgtatgtgtaacttgccataaattcaccaattttaagtgtacattttgatagagttttattaagtttacagttgttcaatcaaaaccacaatctagttggagagcatttttatcactttgaaaagttacctcatgcccatttcagccaatcctcactcctatcacaagtcccaggcaaacatcgatctatttgttctctgcctctattgtggtgccttttatagtaatttcatataaacgtaaccataccatgtgtagccttttgtgtgtagcttctttcacttagtgtaatatttctgaggtttcatattgttgcatgttatcagtgactcctttcatttttattgttgactagtattctaacacatagatataccacattatgttttacaattcaccttttaataggcatttgaattgtttccagtgttttttatttgtgaataatgcttctgtgaatattcacatgtacgcctttgcatagacatacacttccattttatttggggttggagggaaacagatactttttaggaaactcaaaactactttccaaattgcaaaactacatctaaagtgaggtttatggaaatgttttatccccaaactaaaatagtaacaggaagttgaggataattgatcattattattattaaaagagccatattaaacctgtcttatcttaatatgtattggctaaataattaaacttaactagagtcaatacagtctcttttttctaaacttgtaaatagagatttgagagtcagagatttggttctttttccccagtcaaatgaaagcacactaaaaagaaaatacagtgcaaaagtgtaaaaaggtttatatagctataaatgtgcaaattataaaaccagaatctgttttcattgaataaatctggtaactgtcttatgagatgaaaatgtactttgtactttgcatatcctttctttaaattgcatgtaaaatatttttctattattcatgttctgtatttaaattaattttagataaaggagccacactatgatataacctagtttatattaaatttttatcatctattatgaagaaaattattactagtccatataaccaaatgctaaatgatagcagcttcacaaattacaagtagtaatttacaggaggtgcaaaaaaatgttacagcattttattgataaaaaagtttcagtttctgaaactagaggattttgtcattccatttaaagaagctttcttctcaatttaaataattataacataaagccactttttaacattcaatatacaacttgggccagaatttgcaacaagtaaagatgaaaacaatcaatgctaacctacaaaggatgcaaccattatggagaacactttggaagttcctcaaaaactaaaaatagagctaccatacaatcagcaatcccactgctaggtgtatacccaaatgaaaggaaatgagaatattaagatatctgcactctcatgtttgttgcagcactgttcacaatagccaggacttggaagcaatctaagtgtccatcaacagatgaatggttaaagaaaatgtggtacttatacaaaatggagtaccattcacccatgaaaaaaatgagattcggtcatttgcaacaacatggatagaactgaagattattatgttcagtgaaataagccaggtatagaaagaaaaacttttcatgttctcacttatttgtgggatttaaaaatcaaaacaattgaacccagggagatagacagtagaaggtcggttaccagaggctgggaagggtaatggagtagagtggaggttagttggggatggttaatgggtacagaaaataaaatgaatgaataaggcctagtattttgatagcataacaggatgactatagtcaataataatttaattgtacattttaaaataattaagagtataattggattatttgtaacacaaaggataaatgattgaggggatggataccccatttttcatgatgtgattatttcacattgcatgcctgtatcaaaatatctcatgtatatcatcaatatacacacctactatgtacccacaaaaattgaaaataaaaaattataataaaaacctgaacactgcaaaggaatactgtttggttagtagaacaaaataatttggccgggcacagtggctcacgtctgtaatcccagcactttgggaggccaaagcgggcagataatctgaggtcaggagttcgagaccagcctgggcaacacagtgagactccatctctactaaaaatgcaaaaatgagccaggcgtggtggcgggtgcctgcagtcccagctacttgggaggctgaggcagaagaatagcttgaacgtgggaggcggagattgcagtgagctgggatcatgccactgcactccagcctgggcaacagagtgagactctgtctcaaaaaaaaaaaaaaattcatgattcattatgaacactgcatatatatgggtatatatgggcatatatatgagcagaaaccattaatgtttcccaggttttgaaatctcttaatgaaatgaaagtaaaagtattgccaggccaagatatgttaaaaattttctgaataaagtggctgcttttggtttgagaatttattctcttgagtcactgccattacagagggtttatttcatttcttgtaggcagagtacacaaggtaggagacaaaagggacggaatataaaaatcagacataagaaaattttcaaaaggaagaaagaaaggaaagagaaaagaaaaaaaacttctttgtttctgctgctggaacttaaagcacacccacaatagacagaggagaggtgggtaagattggaggtgtgagctgctaggtcacacacctgggtgaacaacgaggctaggatgagcatctctctcctcagtggcagcttccatcctaatgtggataaaacctcagtaagtcagttggagtcctgctctggtgttcctcagaatgtcttgtatttgttcttttgttccgctcactttccttttcctccttgagaaatacgactaacccaaaagatatggtttttgaagcctgtatttgcactagacctcatgtttctctaacaactcaagaacaaacccctccatcctcaaaacactttgaggcaagtcaaccagtcaaaggaatgaaatcacctttgtccaaagtgaaactcacttatgtaaaaaattaataatagtggactagactatgcattatgtaaagcaaggcctttgctatttttaaagtcagcaatctagagtcaagaccaaaataaacatgactcaatgactttggcaagtaactttacagaagcaaaattgaggcttagagaggttgactgaggtaatggtttttcacagctataaacatttctgaggcttctttgacacctcacattatgttagttgtctttgctaagtgctctcacgacattcttggttactcctataccttatttataacacttacaactagggttttgaacagtccaaactccacagggactgcaaaggagatagagttttattatttcttgagggaccacctttaaacatggttttcccattcgttaacatctcaggtgaatcccttggctgcctgatcacattcaggtattgaaaaaaaaaaaaaaaaggatcagtcaaatttaaaattacagctttataagcagtgtaacattctcttctctctagcttaggtttgccgaggataatttgaatgggagtggggggtggggagcttccctgctacttaactcctgttttctcgccatttggttttgtgttgacacaggcatgaaggatcacacagagattattagttctgtttctttaattgatacctctgtagactattgataatcattgtctttccctggaaatcttcaactgggcatggacactgtgtggcaaatggttcaagtgattgagtttttggggggtatgtgtgtggatccatcaagagtctcctcatcacacagtttcctgctatggggatctgctctggatcaactttttctggccttttctcagctccttcttgatgaacccccacccacagcctctagctgcttggtttctatgctcagttgctagccttcttatagggctaacatgtatgagcatgctgatttaagccctgctactgttcaggacataggaaaggcactaatccttgttaatccaatcctgaggaaaccagtatagcaccacgcaccattctaattacacatcccatttcaattgcctgatggctgatttccacctcactattttgaacctcttatgctccgagaggtttggaacattaagtgcctaaaccaaacacacacacacctttggtaaaatgtctataatccagagcttcttacctgttgatgaagtggcttagttcttggctctaattaatgaacctctttggtaagttatatacaccttactaccttgaaccacttgaagagatctaaaggacaaaagagaaaagagttgtggtcatatccgaatttccagaacttagcttagtgcctggtacagagtagcagttcattaaatagctgtcaaattagtgagtagataaattaataaatgcccttttataatgaagaaaaatgccaggatataaatgatgttgtaaagaaaatatatgaaatacaaccgtttagttgcagtatattaatcaactattttctgttatttaatatttttaaaatatcaaatatgaaatcctatgacaactcagatgaattaggcattatttgtcccatatttatgctccttaaaaacacttatcaaaatttggggcaagttttgagtactgaagtcagtgtgacggacagactttgggacgcctcagtcaagcaatcagttcatttaaatgtctcaagtcagatatgagtagttctgtagcttgggagaaatacaaattgtctctggtgatgggctaaggaccatttctatgggtagctgcttccttagtccacgctgcattttacctgcttaattttttgagcatagattttctacaggtgggccttcaggacagccagggtttttgttgttgttgttgttgttttgttgttgtttgttcatttgtgtaagcaagataagaaggaaaatatatagtagtagcaatttaatgtttaactaatcacaaaaaattcttgttatggtaatttctaaccttactggtttattctgattttcagacataaaaataagaagtggtaaaactctatctcctgcattttaacttcacctttataagttttccttaaacatctctaaattacaatctccaccctcaaatggtctcttcattaattaaaaaacaaggtacaatgtttctttgttaacaaaacattttacaatctattcccaaatatcaatggaaacaaagacaaaagcctcctgggacttggtggctaaggtcacatgaaaaaagtcccttctccatcacttcctaactggaggcccctgggataatctttgcattgtggttttctcatcaaagcctcatcacaaagtgaggaaaataatataacttagcacacaggttaattaaatagagcaaagggctaaaccacttcatcaacaggtaaaaagctctggattattgatattttgccaaggtgctcgtgtgtttgtttggtttagtcaatcaatgttcaaaacctcttataacacaagaaacaccggtttcaattttgttatcctggttgtttttagattagaaatctgaagcataaagaatggtttgcttacagatgtatgtgctcactctgctaagtccaaacattgggatcctgaaagtacttgagggttgccccttggctctggcttcagaagcatactcctaggggtcttctgcatactgaatttccttctgaggaaagcctggaaaggtgtgccgtacttttcagttgacagcatgttacatgagctttattaaaactgaaaagttgtcatgtaagggattattgtccccattttacagataaggaaaatgaagctgaaagaggttaactgaggtgcacaaggtcacatgagtatttcatagcgaaattaggattagaactccattccgctgattttcagcggtatgttctatctgctgggtgttgttggagagcctgaaagcttatcggaacagaaagaaagttaattcagctgcagattgattaacctaaagggaaatccaatcaatgttggtagagagctgggagaagcacttttctgtctacagtgatgtttttaccgggacagcacaagatctcccatctggatcagaatcgaattccaaatatcagaacaagctaaattcttctttcctttctgtagttgcatctgtttatttacatttaagtaatactgtatatgctcctaaaatttctggctggcagcatggagtaactctcttcattatactgatttgtgtggtcatccttagcacctttctggatttgtgatcgtgcgtgatgaatcttataaatggttcaatatttccatgattcaaaatgaaagtgctaaggcaaacgcaaaagcagctttgaatttctgtaggccagttaccattcaagagcctccatctgcagcaaaacttcctccttctagtggaatacttgttcacactcaggaaatgacatttgaggtgtggccttactgacttgaactgagagcttgttttgcttaatcatcctgagggaatcaagatataggtaaaaccaggaggatgaaattttatgattattataggaatatgaaatatgtgtgttccttttattttcctgctgaataaatagtaataattgaaaaccattgatgtactgcaattttgctttgttttgctgtgatgcctttttaacattttttcttattcaatttttctttgagaagagaaagggctgaatgttcattttatattaattggaatatgtatgctagttttagcagaaatatctatatcttcctttattataatcaattttttctcattaaatctgaaaactgctccaaattactattgtatatttttaaagcactttacagtctgcatttgcacattcattatcccattttattctcacaacatcctgtgaagtagaacttaggaaagacatcgtttgccattgcaaacctatatatgagaatataactttttgctttggggaatattttgtttcgatgtgattattacatagtttgctaatgtgaaaattggaatattctctttatttctaacttcccaacttcagttggcttcccagaaatttttataatatcaaagtgtagataaatttaagagcaattagaaaatgagtaataatgggcattttatttaagagaaaaattggggcaacttccaatttttattagatgtttggaatattactattgttttcatctgaaaaaattttccgttatgttttcaggttatgcgtagtaggttcaagttctatttcactcggaaattacctatttaacagctgttgccttgctgtttttcatagtgattttagggaaatatcatcagagaaatgaaataattctgcaatctctaacctgtttctttaagatgtgcaacaagggctagaagcaaagaatctgcaatattctttataatttcatggggtcttctgaggaaatgtgccaattttatggggactcgtagggaaaaattttgatttcatgtggattcgagtgaaaaggtaaatttcatgggatttctaaaaatggctggatttctcaggatccatgaaatctatgacagccatggagaaaatgcactgctcttgtcatggagtaaatttcagtgcagtttggcaaactttatttcttatacacctgctatgacatacattatatattttgagtcatttttgaccatttactcttttataaatgtctatgaatgctaagggtggcactttgtgtacctaacaacaaatagaaaaatgtagttgttttgtgagttgcttagagcatacttgtgtgatcactaacacatacgtgactcatctggtgacttatctggagtcaaggtcaggatggtggtgctcagagttctggtgggcctaatcaggggacagagggaagcctctcactcccatgccatagtcttcaaggaatcatagaatgttaggttcaaggagaccttagacagtgttgtggttctctcaaggtattccaagatttaaacatctgcaacagagttccctgtggaacttgttaaaaatttaaactctctggcctcacctcagactagctgacacagattctcagagagtagaacttgagaacctgcctttgtaattcaactacctgagtaattctgatcctgatccacacttcagcttgagagccactgttcaaatacacttttattcccaattcaaattgtctatgatgttgtctgtcatgaattctagatctctatttaatacccctcctcacagagagcaggattgaggcctgctgagattccattagctggtcttgtggctggaactggggctgggtcataggaaaggctgttggggaagaaaagatgtctaaaccaattctggaagcttgtgcctacggaagcactgtgaatacaacagctataagagctgactgatacaggtgtgctgtattggtaataaacagtgtttccttgatgcatttctttttttctgaatggggtacaattcttgacaaagttcaaaggaaaacaaaataaaaattttatcttaaattatagggtacctgcatttatgtacaattcagtatatattaaaacagtggaaagtgctttgttttaataagtaaaacagtgttagattctaatccagatcattaaagagggttttctatacttgaatgtgcaatggaacattagaaagcaatgttaggcacaggaataatctcttctttactctggactgcagtaactgcaagatctccagcattcctggacccctgtatcctgaatgctcataatgctttcttattgtgacagcaaaaatttttcaacatgcttcctggtgtagtatttattgccccttagagaaccatttcactgattttcttagtcacatcatattcagacctttctaaaatggaagtatgcacatatgattcctctgcataaagtctttccatgtttccccatttctttcagggtgaagttcaacaacatagtactcaaggatcacatttttggtaaggcctcttgggcagtttgattatgttgtgtctctcctgtactcttgtagcagtaacctatgcatatactatactgtaatgattggtttattcaatctctgaaagtaagaactttgatatttttctataaagtgtttatagttctcagcctggtctacaaaatcttcaagatatactcgcacatatgtttctagccttattgctcagggttttccactgacactcatcatttcagctacatctaaaacctggcttacaatttcaaaaactcaccttctctaccgtttctactcctgggcgtacctgaaaaaccattccctcctctcatcacctatataaatcctgctcattctgtaagactcagttcagttgttatcaacttcattgagattctatcagggaacaggtatagtgcctggtgctgaggttggcctttgtttatatggagcaagtaatccagttataaatcttccctctcccctgaggttggattaagagctcttcctcttgccaatctctagcacagcacttatctcacaatattgcattatggactgtaagcttcttgaagaaagacaatgaaccatctttatgtttgtgtgatcagcacctggcatagtgcttgactcatagtaggcacatgaacggtgggttggaaacctggggagctcaccaattatcaagacagccaatacaatatttattacaaagttctggagtggcagtcttggtggtacttctttcatattttgaattctgattattatgtacaatattttgaaataagtcctcatgcagttttctggagatttttccgtatcttaatttctcagagttttcctatagttaacagccccagagctctgacttggcagtcctgatcccaactgattcctgggaaggagacgccaggggaggggaggttaaggtttgtccaaatcaccttgtgttaatcttgggtgcaagtgatgggggccagctgtgggtacccctccaccgcttgccaaattaaacagcagaaagagaatgtcatttcttcgaactctatttcctagttgactaaaattctaaaaggaaaacagaatggcaggcctggatcctttgctatgtatattttcttaatctgtcatggaatactggttttccagctgtacaatatctgattttgtttttctgtacataaataggcttttgataaatataaaataaatgtataaattctgaaaaaatcatcttcagatatacaatttttatttctaaatcacaagactacttttacaagcagaggctcttttctaaatgagacaaactgaacaatggaatgtcttatattttattgttctgcttagttgaatgaaataaaaaaatctcgatttttttttagcatagtaaatgtcattgggaaaaattatatagagctttccattctaaatatagaggtaactttccagaaaacaaaaaccaccttttgtgaagaaatgtacctaatgtacattttaaaatactatctaagttcaggcacagtggctcacacctataatcccagcactttgtgaggccaaggcaggtggatcagctgaggtcgggagttcaagaccagcctgaccaacatggagaaaccccatctctactaaaaatacaaaattagccaggcgtggtggtgcatgcctgtaatcccagctacccgggaggctgaggcaggagaattgcttgaacctgggaggcggaggttgcagtgagccgagatcgccccattgcactccagcctagacaacaagagtgaaactccatctcaaaaaacaaacaaaaaacaataaaatactatctaaaacagttgttatttaaaatataaaagcataataaagctaaacaaactgcaagctgtaagatgtttggaaaatgatttgaaaataatcttatcaacttcccttccagtaaacctttttacttttgttcctgaattataaaatcagaaatttgaaaagtatgttactcttatagtataaagcaaaaaaggaaaatactgacataggagtatcataggtatggggcaaaaatagcttcaaaaaaaaaaaatcatttagcctaggtatgttgctcatcctcattgcccgctggcctagaccataactcaaaggccagaggaattgccagctggccctggctttactgtcttctagctgtgtttttacttggtaaagaacctttagctctctgggccccaatttcatcatctgctaaaagagggaattttttttaacaggcatgttgttatgtaaaaatgagaaactatattgtctgtaaaaaatatctgaatgagctataagatagtatacaacagtaaaatattgtaagtattgttcatatctcattctttcccaatgtaacttctaatcctttgttttttaggaagataaaaattgcacagatacatttgttatatagaaatacactaagctttttagaaatctttcagaatgcattactattcatcctgctagattcagtcttaggacacctccacgatgtcattaacacttttgggtgcttatagagtaagtgattgtcacaaatcaaacctttacatttcaagagataagcaatgtgagtaaataaaatttcaaaatagagaatttaaaatgaatttccttaaaattagagcctaaagttattttggtgcctttagacatattttaaatgaaataaattcaataaaagccatatggtttattaatatttagctctatttccctttacaaaggaccatagtatgattttaagaaaatatttatttcatgcagcttcagagttgttgttgttctccttccttgtataattgcatccatcttattttttcctcttagaatcagagtttctatttttgctagcttgtggtgcagattttactactaaacactgggaatatcaaactgggcaatcaaataagctttcaaggctcccactcccttgagacatgagcaggacgcagggctaaatttggggttccaattcctacccctcaaacagtggcaggctgaagccacacttagccttcatacaagattcatgataatcctgggactggcttggctctgacactgtattagatatgtgaagatccaagctgctctctacataactcagggcagaatagggattgctttgtaggcaccctggctgttttaaagttttcttttaaccaagtgactttgaaatttctcagtattttttttgtgtgtgagtgaaaagagagtcagacagaggagagctgacgttccccaggggcaaatcgtgttttcggttcctctttataccaaagtttttcttgcattttatcttatgtctcctcctacaagctaaagatttgagcagttcttttcttaccaaatttaagggatgaacgctgcaaggacatgtaccgaccattggatcttaaatgctttactcaaagtacagaaggtaaatgcagaagttttcattaatccctaaccacattatttgacacctaggtcttttttattagacacttatggagaagcatttgtaatctttacttcaaaaacaaatgataagatgtcactttaacagttgcagcctttatcaagagttagctgattgtattttatgtttttgtttttgtttttattatgggagaagaaggcaataaagaaggaaacagactttcatagctcaagaccatttggtctttaccgcataacttaattggatcctcacaaaagtcctagggagcagatattataaatgcaattttagatgggcagaaacaggatcaggaaggttaggtgatatattcaaatcacacagctaacacatagtagatccaaaactcaaaatcaattttgtctgattctaaagttcatgctttttccactggctactaatgcctcatagaaaggaaagagattgaggtacctgacctagccagagaacagtgagatttatgttccagttccctggtttctgaacaattcttccatgaaatgatgataacaccaccatattatattccagggttgccaaatacatgggaccaatacaaaacagcatctcctcctcctgcctgctcaggtccttctgaaacctctgcgaacacttcctctcgggagagttctaccacgctttgctctgttttagcattttcttattgagacacctgcctcctcacctcatttgtcccatagtgttataaaacagaggcaaacaaatgtttttagagaaaaagcaagggaataataataagttagttaggacctaccttcttttggattaaaaatgatgcacgaggtatttttgtgatacgagtccattgcaacttctagtgaaacaaaccttcccgtgaagtagatcagagataacaagaatcacattctacacatgcctaaactctaattcttttttctatgcctggcttgaatcaggtaaattttaatcctttatttgtgactgaaaacaaacttggctactgtctgggtggaagcaaaggtaaggacccctgtaggtgagagatgtagttggatattgatttggtcagatatactttaccttatttcacaatagaggactgtatttggggctcctgaaagggtctaaaaaaatggagtaaaaacatactaacccccaatttttcactgtaaactgtttatcagaatctttagtaagtttcccttgcctttttatctgatttttaaaatctgagtgcacagaatcaatttttcataaaacttgcaagttttgaggcttttgctgcatgtcaggcaccgttctaggtattgagagcaacagcagaaaacagatagattttggtttaagtagctcatattcgtgtgtgtgtgtgtgcgtgcatgcacacacacgtggtgagggagtgtttatgtatgtgtggcaggagggacacagataacaaacagatacatataaaatatataaggtggcaaaaataaatccccatgataatgagtgccataaaaaaataaacccagaaggagctagaaattggctggggttggggtgggtagtttctcttttatattgaatagtaaaagaaggaacctctgataggttattctttgagaagaaacatgtttctgacatttttcagaaacagcaaggaggtcagtgtgacttgaaaagagaaattaggtgactggtagggcaagcaacaaaaggttagactgtacaggaccttttaggccatagcaaagacattgtattctactttgaatgaaatgagaagcattagtgggttttgagcgaaggctcactccagctgctgtgttcagaaagaatagaggagcaagctggaacttagttatctttattaactgcctctggacacacttagagggttgtagaggggattgagtggtataatacatacaaagagttattgcatgagttaatacatcctaaattcctagaacatgaaaatgctcagtgtcttcgtttgggagccagcataattaagtgttttagagatggtcctgggcatgtccctgtctagattcaatccttgctccatttcctacttgtttgattttctaaaagttacctaactccttcattccttgaatttctcatttgtaaatgtgaataatatagtgtctccctcacaggatcattgtgaggattaaaattagtctatgcctatgaaatatctatggcatcactgtgcacatagtaaatattcaataaatgttatcaatgtcactatatagcttttacattttacaaggtggtttcaggttttccatctcaaaagctccttatgaagtaaatcacataaatacttctatttttgttttgtagaaaaagggattgaggttcagagaagtgaaatgacttgctcaagatcacttagccagaaagcagtggagtggaatcgagcccagatcttccaagtattcttttcattatattcggctgcatttgaatgtttacgtatgtgttagaagaactccaggtcaagcctctgagctccaaattgatgattctttttcttttatcataggtctaactaaaatatttgtataatgaatgaatgtatgcattaataaaagaaagaaatgaaacgagaaaggggaatcctttataaagaggacaagtttaggttgctagaacgtgcagcgtggatttaggagactggataccaatcagttgttgacacattgtataattctgagaaaattgcctaacatcttgagtctttggtttcttcatctgctaaatgaaatctcagtatattctcatatctgctggctagatttgtgaaaatatatgccaagataaagatggaaacacttaggaaaaaatgctccatataccacatgtgttgctactattaaacttctctaagaaaattcagatctagacacctctaaaataccttctggggttggttagtaagcatttgctcaaaaacttgaatttttgcactttttttggtgggggagggagagtatggattaaaaacttttttctagtggcttaaattcatggtaattttcctaactaccttagaaaaagttgtccagtctcaccttctccttgattttcatggtaaaagtgatcacctggtgacttagtcctttcaggatgctataacaagataccatagactgggtagcttataaacaacagagatacatttttcacagttctggaggtggggaagtccaagctggagctgctagcagatttggtgtctggtgaggactctcttctggcttcatagacagcaccttcctatgtcctcaggtggtagaaagggaaagagtttccctgggatctcctatagagtcagtaatcccattcatgaggactctgctctcatgacctgaacatcttccaaaggccccacatccaagtatcttcacattggaactgtttccacatatgaatgtaggggcatacaaatattgagaccttagcaccagcaggctctctttcccaaccatccgcagccacccttattgggaacagttaacacaactttattgattttgataaacatttattgaatatctattatgtaccaatcattctactagggaaggccaaaatgataagacatcatttctgaccttatggagttcagaattgaataggaaatgcagtctcacaaaccatacagagataacatgtgatataaactctaatggagacctacaaaatgctttgggcatgtagtctaaaatatgcttagccatgactggtgttggatggagaggattggatggagaaggtgcaccaaaaatgatgttcaaactaaatattaaagtagagactggggcctaaatgagtgctggggacttcgaagaagcagagtctgtgagtttgttccttttatttttaaaaaaatttaattaatttatttattttgccacagagagaagttttttagcaggttgggatatagttgttactacaggaggaggttctttgggaggtattttaaaacatttacaggttcaaggaaaaatgaggttaacattttagaagaaaattagcaaagcaatgtcttgtggatgcaggagggctgaattttagtttgaggggagaaagactttttgttgtgatactaccaacctatggatgcaccagtgtgacacaagcacccagtgtggtaaggctattttctgaatttctatacctttaatttttggggacagcataatgtaggggaatacatcttcatagagaataataagtgttggtttgaccctgaaggatgagacatttgaatgtcaaaatattttataacattagtaggcaaaattatggtaaaactgtggcttgtgtgggttgcttttaaaatttctgctctaccctgagcgaacaagacctagtcaggtgattgaagaaaggtcacaggctttatgggactgagcagtttagataagcagtcagtattatctgatatttatcaagactgaacctgaactccaaacctggagctttgcccaccggcacatcctatctggcttatgctttttcctataggcaactaagtcaggatcagatgggtggcagataccaggccatatgcatatttataatattgcaaacttgccatcaagctgactaagccaaattaagcatataagaaatgaaaagtttagatggaagctgatgtttttaggattccaggatgtggctctgccagatcagtgtgttaacttaatgaacgagagcagctcgcatttcaggaaggaaaggagccatgtcgtcctgatgaatcaatccctgtaagtaggttctgtgccttatagagtatcccctctcccacctccgacccactaccctccccaccgagtccccctcattcccacctctcacagccataaacaaaacaaaaagcaaatgaaaacaaacaaacaaaaccctcatctgactcattgtaaaaatacactcaggatttggatattgcccatctgatatcagtagccttttctcagaccatagtaattacactctgcaaatacattgcttctgaattccctttaatgcagtcttttgtttctttctgctcatgttctcttttgcttttgagccatttcctgtctctcctttctcaatagtcatcagagttttagatacctcaataattctctcttctaatctcttcctttctaatgaaaaaaacctctttttctatgtttttttcagttataaacattgataacatttatcattttgttgtcatttctgtacctttcaactctttgatatttttcccataataagatgcttgaaactttacagtatttcaatggcctatcatactgtgattagtgtcctttgctaatttttgtcattcccctagttttatgtaaccttgtgttttgaatgttgtagatgacacgaaagcaatggttttgaatttgtgcttcctttgggctcttgatctctctgttggtccatatatgcttaacagtttgtgagcattttaggtttactctctgttgctattaaatatatttacttctctatctatattaccatgttggtaggttggaatcatacctaaagcaccccatattctcatttttagaacgtttgatcagtcacttgtcccaggttaagtgaaaagcgtatgccatatatattccatttgttgctttcttgcatagccatctctctaagagctcaggcagaaaataaaagaattcccttgtcaaagtatgaggggaaaggggaaatgtcaaagctcttccaaaaaatatatggttggagcccattatatcaagagttttcaaagggaaatgctgtctcttttaatctgtccccctttacccagtaagcttagagctcctgtctattcttgtttcttccaccctcaatttattaacactgaagtcaacaccaagctggataactagatgggggaaaatctctaactatgccagattaccatctaccgtctattacctctggcataggtaggggtctctgatttattttattcccatgtcccactaaacttactgcatactgagagactttggcttggcaaaagactaagaaatcgtcctggcctgttctagaccccccatattttcattgctggtatacagcagttaagtctccaaacagatttacttcctgttaaaagtattaataatgttgtacttccctttctgtctgggaaaggaagctttatgtgggcctttccacttgcacatttggtaaaaccaagctccttgggagacagtaacattttgcctttgtctcatttgagtgagacagggaaggaaagaggcccaacaaaggaatattctgggaagaaagtctattccctaatagttccagtttatatatagaaccccaagaacctcatgaattttaaaaggaatttaatttggaagtatgtacatattttatcttccaaagatatggcggtgtctttatgcaaaaacccaaataaaaggatacttttagggcagtaactgtagtgatttactcaaattgtatcttttccattgcagaggaagccttccaacagaaagggtctaactggctaaaggaagactctgggggaggcagcaatctgtccatttagcttgggggacaggggagggttggtagtgtgaacttgcaaggtagagaaagattgaagtagttgagcgacattttccactactgcacagagaaattttgagaagcccattgtagtgggaagaggagatacttcctaacttatttagacccataggagaagtggagacagaagaggaggcgacatgtactgcactgcagtttgtcaagaataccaagatactgcatctggagaagggttccctaatagcagggtcctcactgtggtccactctgtgcccacgtgtgctgagagggaggaagaggtggtggctaaggtagcagcaggtgcatctgtgaaagtgaacctcgaaggagcttcattcttgtttttacccattagttttccctttactggtgctcggataagcattattacttatatagttaggaagagaaacttaatcttatacatgtcaatttaataaacacttatttggccactctttttgtcgaaactttgttagatgctggaaatacagaggagcagcacacagttcctgcctttaagttgtgttttggaatgttttgctgatgtgaggagataattttttttttcatgaggtgatgtgtaagccctcacacaaatggtctctcactaattaaaatgacaggtttatacaagatgctggtgaggtactatgtgttctatcttctgtccaaacatcacagatggtgactgtgtgtaatagaatatattcaacctggtcaaaccctaagaaaaacttgacaccacaaggcatgtatactctgtttcctgaactggttgtctccttaaggaatgtatagctgcataccactgtcataacaagaataaaggataaggctgtttaacttaggtctttcaaatgacttatttgtacccggaaagcattcaagttcaaaggatatagagacaaaacaattagaattacggcagcatgaacagagacagtgtcaaatttgtgacagcaattgatagaaatataacagtggtacagctaaggtgaaaatcttgctttaaatcatactgaaatgtctgtgattcttccaactgctgttccccatttctaccacaatgaagcacttttttttcagttcttcttttccatgaagagaaaagaacagacccaaggacatagaaccctgtatcggagccaaggttagagctgagatatttttggctcctaattctctgctgagtccattagactatgtctcctcttctttctattatttgattttctgttctctgagtgtttacatacccagagtgataaaatacatttttgttcttatgttactaatgcagtagaggtattttttcaattttgccgaactgcaacacactaaacatggcaaataactgctttcaacaaaatgttttcaaggcatgccttgaaatgggagttaaaaataggaatgcaaatgctaataacggtattgataaaagaaactctggcttcaaaaatgagaaattcaattagaaaaaatgaaggtgacagtatttgaggaaaatactccacaatgtctgagagtactaatggaaaccttaattccatggcattatcacaaattagatagagtttttctcaatgtagttacttgcaggtcagctaagataatagtgggagtgtttctgggctggccatcctccttactgttgaccctgaaggtgatatgccaaaatttagattactttgatatctgtaaataatgaaaagagaactactaagtcaatgacccactggacccagcctaagtagcttcttaatgttcagacacacatgccaatcataaacttcatttatctgcctctcaaagaagttaatgcttcactgaccatgtattttaagatcatataatttacaaatgcttacagacttagacaaaaacatcattatgtgaaaatactttacattttatatgatcttacccaaaggagctcaagaaacttatcagactgcccgtcattaattttcacagcatctctgtgagggagggagcaaaaagcattctgttcattgttactgtcaatattcttagctgatgttctcttaagatactttataaaactaagaaagccgttgtgtctgtccacaggatgcttacaacccaagaaatcctgataaggtccacctcacagatgtcaaaaccatttttagccatgaaaaatcagatgctcttcagagcgaaagattctatctctcatctgcctccttaacacattccagttaataactagaatcgtaatatttcatgttttgatataaagctattcactctggatcttttatcaatggacatggagatcagtccatcactatattttgtaaaagagacctgaatttttatctctaaagactgagtgagcaggaaatgtgcgtatcagatagttttgtagagtctgaacaatttcccagagttggaatggggatgtcaaagtaaaaagtagccttttgaatacatacgaaaatttggtattatatactacatatgaataatacatatgtagatagttgattgaggactagcttttaagccaggcttttcaaaagtatctattatgtaacactagctgtgtaagatattcttgaaaaaaaggtcaataaatatggtcaactcttcactattatttgtttttagatattaatcatatttaatagtatattaaaggctctgataagcattgaagtaaagaaacatgcttaactttgtaaaaactgcccaaacttattttaacgctaaatcctttttcagggaacacccgtaagaaacaaacattgggaaaataactttaactcacttcatctgggtatttaacatggttcggtacattccctcttcactaagagagatcagtaagccatggtactttaactcaacaagatcacaatctagaagagcttttgtatatggtgtttataacattaagaagtttacaaggctgaataaaattgggaatgctaatttccaaatgaccaagatagacaaaaatgtgccttaggagttaggagaaaaatgtagtatagggagtagagtaggagtttatagaaggttgagtactcagtgtttgcagaaagattcaaagcagtcagggtatgtgaggtgcaggtggggtgaagtgggaaaggggaggcagagcatggtattccattttaaaagcacgagcgaagaatgtttgatgaactgtatgaagggttagtaatgatgggttaatgaatatagactttattcctcaatcttctaacttaaatgtattagtagatcttcaaactttacctcatacactcccttgtggctgttgccaccacaattgctgaagtttctgcctctgctcatgtcttatcagattcctcaggtttctttctaggctcatccactagattttcaagggtggggcaggagtacaattgcatattatacctacatacatgaaataacaaactaggaaaacaaattgttaaatataatatgttgcattctccaacattgacaaatatgtcctcatagtaacctgcaagtccaggttcaaatttagaattctaatggtaagtaggattctaaaaataacccctgttgttggctgaatagtgttgttacagtctctagttaagcacttttgtaacctcaaacacagcaagagttctcagctgattttaagttaagaaattttattgtaacaaaaaaattaagattttttcctttcaatcagagggataatatgctaaaaatggaatttaattcttttaaatttgaagatattaataagttggatttgaggtgcaggagattgaaggaagaattacctgataggaatgcattgcagtaatctgaacacaaggtgaggagtactcaaatattggtattatcagtggaaatgtgtttttaagataccaataaaaatactttcatacagttgagtttgaaattgcaatatcatttctaaatagagatattttgtatgcagttaatggtatgaaacaaggattcaagaaaagatccacatagaaacaaagaggtgcttagccataattagtattatgggatacctgaaattgtaagaaaataagatttttttcagggggggatgcagaggaatgagaataaaacctcagaggattatgacagatcaggcacagaacaaagaaaatctagagacaaagaaagccagagaaagaaaagtgcacagaatgaaaagcttttccagaaggtccctgctgagatagaaaggaagggtgaggctctaactacaatcaggtgtatatgaacatggaacatcctctcttttattccacaatctgcttctctcttgcatttttcatcttggaaccaacttcttgttatctctctggtgttctgatgtgggttaataaccttgtttggttttcttggtctctgagctggttcctgtttgctgaattttctcccatataggcagattagactcgctgtttctgatcttctctttactgtcagcttgactccattagagcagattgaattagacggtttgagaccctggccatgctgggcgaccttcaaggttaaatgaaacaacaaggagaataaagattaggaaaaggagtagagattaggtggctatcagtggccttgaagagaccatctcttgtcagaaaagttaaaagaatattaattgatgaatcaataatctaaccttagtctcatcactttgtattattgatttttctagggagtttgaagagtgcctaatatgagaatttatttggtactcattatttggaggaagaaggtagcaccagagttcagagagttttgttatcacattttctatttgtcagaatgtcagaaataaacccgatttcattcatcaggacaggaaataaacagcacattaacacttggctgaagatgctgcataaactatgaggattcctctagtcaggatctcaagcatatgcaatgcacagtcatccatcccacacatatttactgagttcttagtctatgctggggactattctatgtgcagagatttgagtggtaacaagaatataaaattcttgctgtcaagaaatgtatgctttagggatgtgaagtagacaaaattaaatataaacacaaataaaatgcttgtaaatgcaaaaatcacctatattgtaattttttttttttagatggagtctctgtcacccaggctggagggcaggtgcaatcttggctcactgcaacctctgcctccaaggttcaagcaatcctccctctcagcctcctaagtaactgggattacaggcacccaacaccatgcctggcaagtttttgtatttttaatagagatggggttataccatgttggccaggctggtcttgaactcctgacctcaggtgatctgccctccttggccttccaaagtgctgggattacaggcgtgagccactgtgccccgctctatattgtaatttcaatgcaatttgctttctcatgtgttctccaaatttattctaataataacattttctaatcttcactacaccaaaattttttcatgaattttgaacctaggctgataactggatctttcttagatattgtttatttacttcctaatgactactgtatatctttaatctccattatagtctttgatttttccagtaaccaaatcagagacctggaatcactataaagttctttcttggcaagaaaatctgctagtctctataccttgtcattttacctctttgatacatttagaacccttcttgtctacgccaattccatggctacttaactaaatagtatttattgctttgggtgatttaaatagtctactaacaggtctctgcctcataatttgagtaagcctctccaatttatccgttacccagaatgaccttaaaacacaaatatgatcatgtcatgtcttcatttaatatctttcaaagacttctcattagtcaagaataagtcataaacaccctagctttgttatcacagctttttgtgacctgccctctgttctactcaacagcctcaattctaccattttttctcccatcacctctgatccagctatgctagtgaccctaagaatttagaaagggcacagactttggggatccttcagactcagcttcaagtcaggctctgacatgtcataactataatggattactgaaaccttacctggtcttcattttgtcttcttactttgttagattgttaggaggttcaatgtgtgtttatttaatagttatgtaccttgtgcattaggtgtctacacaaagtaaatgctataaactatagctataattgtaattactcaccctctgcctagaatactctttctctaatgtttacctaggtgttcataaatcaggctttaattctttcttcaaactttaacatagacataatcttctctgagatactttccttaagtttacaaggattaagttctgcagattgttagaactgggttccatcttagttctgctgtattctattggtataactattgacaagtaacacttttgcagatcctcagttttctcatttgttcaacgaggataaaaaaattcctatcttgtgagtttcttattcaactattcttttaaaggacaaataagtctaccccttctttctcaacacataaatattctcttatttctactttttctctccatgttattggtgttcttaatatttccaatattaatggaaaggcactgatcttattttcccaaattataggtttattatgaagccctttaatctttctttgaaaggccttgccatgagactgaatcatttgattttttttctacagtccttttagaaacaggaaggcctttatttataagtttgataaaatccaggcatgagcaaatgtaaacttatttatttacatgtatcagatatgaatgcatgatgtcacataacacttgcaccactagagcccaccacctgtggaaatgtccctgtacagcagacagaatcaattaatgcagaagatttggtttgtattgggtattggcaagtggagtacaagtcctatttggggtaaaaaacatgttctcttgaaaaaaagataaattattttgtggggtaaaagagtttctttaagggcaaactggccagtactggaaaagacacatggccatgagcataataaattttaaataggtacctttacaaaattactacatggttatttctgtaaacatgcacaaaatattcattcatgattaccttttaaatactaatgtaataaggtaaaattctcaatttgtggtatttatacatttcatttttgtttttattatcctcttcaatattgcaaatataccccattgcaaagctatcctcacgaaactccaaaatctctgtacaaccatgttatttaaataatactatttgaatgatcatatcagaagatgaacagaattgatagcaatgtcttccaagacttgtaataataggataggagtgcttacatttcctggtgtagacattttttataacacttaacaaatggtcactaaatgaaatctacagtaggcaacccacagtctcatttccatctgtctctctctaaacataattgccttcaatcagctcttgctctatgggttttttaaattgtgtagaagtgcttccttgatgaatacaatatggaatatctcagctttatccccagagattgaggcatatctgtaaaaaccttgaaagtttgtaggtgttatactagcaactgattgctggaaagttactatttaccgtatagccttataaaaggtttagctttctctcaaaatctttgcaagctatttggaccatgctgaatgatttcttgaatgagttgactcatcttttgctgttcacacacatattcctgaaaggatgaatcaccaagaagagtgaaccttgagcacagactgaagcttggccaaagtaaataccaagccaaataaatcagcattttcttcagctgggtcacccgtgggcaaaggtagaatgggctacacatgcacagacctcaaagtttcaccgaacagagagtagagggaagttccagggatggggagatcctgacacagccaatcaaatcattctggattggaaaggctcagagaagctaggagacagaaaatgccataaaaatgtatcaagttaatttcacgcttttccaccttcaactttagcacaaattaaatttaatgctcctcagcctgagtggtctgcatgcaaaatggtaccacgtggttgaggctgatggagataaaaagagtttagtgttatttacaaaatagtatgaaaatatttgttttgtgatcatgagttgctttacagtaattaaaatatcccctcctcttcttcttaaaggtactgaaactcttgtagcttacacacgttaaaattaaactgtttactgttccgcaatattagataccaagttaaggtgtttcaatttccacaaaaaatgagtggtttcattcattagatgatctctaaaacatcttcttgtactaatgatttagaatctaaatagggcctatctttgtctcaacataaatgttagaataaaactccacaggacaaaaagacatgatgtgtgtatgatccatatgtccaggaaacaaacacgtttctaatattcagtagaattgctgataccagctttctaaccaagatgaaacaaatccaggctaaccctgctgacacacgacaaccctaagcggtagctaaggattagggactttgacctgtaaatatttgtgagaaaataatacaaaatttattctgcctttcttctcttattttcttggtctggaatataatatcaacctaccaggaaccctgaagaatttttgggcttacagaaaagtctgccttcttccagatctgttccttcaggaataacgagatgttacaaacccacaggaactgggtatttgttgtaagagctagggagaggatctagggacaaggaagaaaacagaaaaagtagtcaaaagttatgtttcgggtcatttttcaccacaattaacatattcttcctgctccttatcagtcctaggacatttttcctctgttttattttatagtatggttacctttcagggcctagagttggaagtttctgctcaataactcttgagagaagcttttcccagcaactcctgtgtaacccactggtcttgtgagtgaacgtgaaagtgagaaagttgtgtttttgctggttctcattgggttggacctactttgctataatgtttctttttgatggggcaaaagaggtggtaaaagtcttttaaacttttaatttttttttcaaaaggtaaaagaaatgtaaaggctttggagatgtgaatggggacattgggttgccatggtcatcctttttcttttcattacaataacactcataagagagtatagtgcagtctgcctactcaccaaagaaggcagaaaaagaataaaagtatgttttatgcaagctaaactaaaactttcccaaatgatgcctaaatatgccttgataatttttgttcaccactgcatttctataaagtataacatgaatctaaaagatttcaattttccagtgcgaattatagtgaacacatatgttcttttcttgggcaatcttatggaaatttttttcttctaattcaagcaatatgtccttgagaaatattacttcatttttttcctgaatatcatttttttttttcttaagcctccccctaaaatcctgcagtgaagttaaatgcccatgcttttctctactggaacccatccaccctctctctgctcaatgcttcagtctctggtagttttcttttctttctcttttccttccctatcctcacctccatctcctggattggtaatccccttacccacctttttaaaagttgctcagatacctctgtgagactttgtctatctgccccagaagtgttagttgctcccaaaagtaccatggaaaccttccagtagcacttacctaattgcactgcagttatctgctcacgtctccttctcccactggactgtgatattcttaagggcatgactatgcctttgtcaactttgtatccctagtattcaacctagtacacggacactcaataactgtttgataaatgaatgaatcaagagcgggataaaagagaggcaagcagagcacagcgtaaaagaattagagcaagcatataaagggcagcataaaaggctgctgactgtcccacttccctctccacatctcctgggagagatggcggcagtatcaatgtggacaacgtgaggtaactttgaagtggaagctggacctggtcaacaggatgcagtaaaggaagtgaaattattgatctggtagactctggctaaggggtagtggttgtcatgtacttgtgtgctaaaggactggtgatttttaaagcacataagcatgcttgtaacttgtagataagtaataatctgcaacaagtgttaatactaatgatgagttacaatttatgaactaccccctatgtagcaggcgccttcaaggctaggcactattctgtgttatcagcagtcatctcaaggaccctgtatcaattttaaattttaaatataaaggggaaaaacgaagaaattttaaatatttcagactaggtcacacaactgttaagttttgaaacaaactgaactgcctccatcaaccgaggtcaaaatccactcttgccagagattcataccaggaaaatgtcctggaaaccagtaaaactagcacctgaacaggggtggatttccactgacatgtgaccaaaatcagttcttagttgattcttttttttttttttttttttttttttttgagacggagtctcgctctgtcgcccagcctggagtgcagtggcgcaatctcggctcactgcaagctccgcctcccgggttcacaccgttctcctgcctcagccttccaagtagctgggactacaggcgcccaccaccacgcccggctaattttttgtatttttagtagagatggggtttcaccgcgttagccaggatgacgtcgatctcccgacctcgtgatccgcccgcctcggcctctcaaagtgctgggattacatgcatgagccaccacgcccggcagttcttagctgattctaagagtcaccggagtcctttgatttgctgctttttgccagaaggacttcagaaagttctcaattattttgtaacagtgctctgttggaactttggccaagggctacattttgtcagaattaacaagcttatagtatgtcaggatctttagcctgtgggagtgttaatacaccattccttctgagtttccttcagagccttagggacataaaacaccttgagcctcacattttctttttcttaaccaaagtccataagaaagcctcatgtctgttcctctcatgtgcgctcattctagtactattaatactattaatatcatgcagtttttcccagactcgctttcccacttctttactcccttccaaatcttttctttccttcctctgggacctctgtatcatgataaacaaagcttcacacccttagtttcttcacagaaagctcctttcaccttcttactgagctgaggcctgaatctggcttaagaacatgtacccttctgttgtccccttccatgatggcagttgtttattttctcagtcctgaagagctacaggtgagggcgtccctctctcagaagttcctatctctacaactgagctgtcttcagcctttgtttacaaatctgtgcttccacaattctatactcaacatttttttcaaaaaataaaaataatggccacatttttcttttttgagacttctttttctctctcaccacctgtgtctcctcatcattgatctggatgtagtctgtttttcttacttacttttaaaaatagttatttatttatttatttttttggtttgcaatttgtttatagcttcttgcatgtaaaacatttaagacaaaaatttccctcaaacatttacttgtattgtgttgcaaagttttaatatgaagtaattttattagtgttcagttcaaaattcttatttcagtatgatatcttctttcttaatgagttttgagcaatgcttttttaaaaaaaaactttaaagtatatgatttaaaatagatcttttgtttttgttttgtagtaatttcatcgtggccagagtacataatctggatgatatctattctttgaaattagtagagaattacctactatttgcccctcacccattttaaagatggttcatgtgtgcctgagaagaatgggaattttctgtttgtcagatccaaggacctatgtatttcctctaaatgaagctagtattctcaccactttcttattgtcataatttttttttggtctcctttacctaagaataatataaaaagatgtgttgaaacaatgctggggtatctatttctctctgtagctctagtgtggctttttttttttttttataattttaagctattttacaagttgctacaagttttgaatacataggtcttctatattgaaactttatcattaagtcatgatccccactccctttttatctctatgagttctttggcataaaattaaacagataccctagctttgttttgattaatagttgctcagtatatctctgcatctttttacttttagccttttaacagcttgtattttaggtttgccactttgaaaacagcataagactggatttattccctgagctgagaattctcttctctgaaaggaagtcagttcatttattcatttttgattgctgatatttaaacttgtttctaccatcttactttgtggtttctaattctcacttttctgtgattttttttccccttgccttttttcaattgttttttccttcattctatttttctcttctacttctttggaggaagaaaatctatttttaaatttatttgtatgcctttaatggtcatttctgatattttaacattcatgattaacaaaggttaatcaatcttaacctactcctgaggaatattaggactttagaacaattttcaatcatctcttgacatgctgttgcaatccagtattctttctccttttctaaaacctcataagtaaaatagtttaaatttttgtaatgtgaaattatctcctaactgatcactctgcttccattccagtatttctaaggtatattctcagcagagcaaccaaataatcctttgtcttaacacataaaaacaaactttacttttattaaaatttataatatgcatacaaaaaagacacagatcttaatgtgtgcagcttgatgaattttccaaaaatgaatacattcatacaactaccagctcaagaactggaagcttaccagcatcccacagcatcttttatgtcccctccctaacgtgagatccttcctcctctgctatgatgaccactcttttctgacctctaacaccatacattagtttgcctatttttaacttcatgtaaattacattacccaatgaatattattttgtgtttagcttctttcagtcaacataacacttatggaaaccatgcatgttgtttcatgtggcagtagttggttcatttgtgttgcttcacagaatttcactgtatgaaagtgccaaaatgtatcatttttctattgatggatattgggcttgtttctagctttttgttgttttaaataatgctgccatgcacattcttgtacatatcttttgaagcacctaagtatgcaaatccgtgttatatccctagaagtagaattgttactaatacataatagggcatatttacagtcactttgacaaaaggctaagtggttttccaaagtggttgtaactatttgcctttcataatgatgatgaacatcagtgcatgagtacctgttgcttcatagcctcagcaatactttcttttcaacttttaatcttgagttaattttagacttacacaagagttgcaaaagcatggcagagaatttctatattcaacacccagattaccctttagttaacatcttacataatcatagtatacatcaaaactaagaaagaaacattgatacaatactataaactgaaataaagattttattctaatttcactgtgctgcttttgttccagaatccaatccaggatctgatttggcactttgctgtcatgtttccttagtctcttctattttgtgacattgtcattcataacctaactgtatttaaaaggcactggtaggagtttgtgcagcatgttcttacttgtgtttgtctgttttcttttttttttattttactttaagttctgggatacatgtgctgaacgtgcaggtttgttacataggtatacatgtggcatagtgatttgctgtacctatgaacccgtcgtctaggttttaagcctcacatgcattaggtatttgtcctaatgctctctgtccccttccccaccaccctctgaaaagccctggtgtgtgatgttcccctccctatgtccatgtgttctcattgttcaactgccacttatgagtgagaacattgttcagctgccacttatgagtttggtgttctgttcctgtgttaatttgctgaggatgatggtttccagcttcatccatgtccctgcaaaggatataaactcattctttttatggctgcatagtattccatggtgtatatgtgccacattttctttatccagtctatcattgatgggcatttaggttgtttccaaggtctgatatgttttcatagttagatcaaggttgtgcattttggggaagaatgccacaggagcttcatgccttctcagggtgtcaaataagtgagtaaatgatgttatatggatatgtatgatgataactttgatcagttggctaaagtggtatatgtgctttactacattgtaaactaattgttttaccctttgtaattaataaatatttggaggaagagactttgagaatctacaaatatcttgcctttgtttaaattttcactgctaattttagcatccacaggtgaatcttgcttatatcaattattaccatgctgtcccaattgtgattttttctattttcctcattcctttcatttattaattgaattttttctataaggaagtgtcattccttttatctaatttctttattcacttatttttattgtggtattaactcatggatatttattttctcagtcatagtataacactatcatcatttattttgttgttcaagtttttctgattctagtgataaggagtcagtgggaagtgataccctcatccttaaacaacttggtttattgcatgcctctttactttctagtacaagatgcttcaggttgttcctgtatttttccagctttgaaatcaactacttcttcaaagaaccctgattgcttttattagagaatgatatttagaagcccagagatctagacaccaattttgctcattgcatggagatatccctgtgttgaattcctttcagtgaatagagctaggaaatatatatatgtatacatacccaggcatgaacacaaatctctgacatctatcatctctataatattgctctatctaatctatctaaaataaaatccatgagattatattgataactttgactctagccaccaagtattcaaactaaccttctttctttctaacttctttctttgacagtgagcaatctagttctcatgacctataatatatttacttagttttgttcaagcctaatatacatgtaattttataaatgctaaatgatacacctatgaaaggtacatttatcaactatagtttagtttctgtacagatctttcttcttcagccttatagtattaataaaagtattttgtccaaggttacggaaatcaactactttcttcctgacttccttcagtgtggttatgtaatttacgtttaatacagttagattcatccttatagtttgcattccttcttgagtttctccaacattttggttcatttcttaaatttatgtatggtaaatctcactctttttggtgtacacttttatgagtttttggcaaagatatagactcagacatctatcaccacattttcttacagaagagttccatcaccgcaaaaattttcttgtgctgtcgctttgtagtcaaaatgcagtactgatcttcccaattaatctattttctatgtatctattttttgcttaattatatgggcaccatataaatgtactcaagctatgtgtagcctttggggtctggtttctttcacttagtaaaatacatttaagattcatccatgcggaatatttttttttcttttttcttttttctttttttttttttgacagagtctcaacactggctcactgcaaactccgctgcctgggtgcctgggtgcaagtaattctcctgcctctcctgagtagctgggttgccaccaaaagcagctaattttgtacttttagtagagacggggtttcaccatgtgggccaggctggtctcaaactcctgacctcaggtgatctgcccgccttggcctcacaaagagctggcattagaggaatgagccaccatgcccagccttgtttctttttatattgtatgtatgtaccacattttgtatattaacctaccatttaaaaggcatgcatatgattatgagaaagctgctataaatatctatatagaaatgtttgcatgaagtttccaattatttttagtcaataaacagaagtgagattgctgagtcatattgtacatatatgtttgactttatatgaaacctctatactgtcttccaaagagactgtaccattttcaattcccaccagcaatgtatgagagtttcagttattctgcatctttgtcaggacttggtagtgccatttcctccaacccccatccttctaatagatgtggatggtagcacatagttttaatttgcagtttatttattaactgtctcttcttgtatttataagctattcatatacactgtttggtaaagtgcctcttcagatctttcagcaatttgttttattgggttgtttgttttatttctgttgtgtttagagaatttgttttataatctagatacaagatctttgtcagaaatgtgattttcaaatatttacctccagtctttttattcttggatcagtgtatttagcagagaagattttaattttgatagagttcaatttatttatattttcttttacagattgtgtttttggtgatgtctataaaatctcatcaagcacagggtcatgcagattttctcctacattttcttctagaagttttatagttttaacgtcaatgatgtattctgtgctaatttttgcattaggtgtgaggaatagattgcctacctatatccaattattttaacaccatttgttgaaaaggctaactttttccattaaattatttttatatatttgttacaaatcagttgactatatgcaagggcttacttctgggctgtattctgtttcacctatctatgtatctatctttcatcaatatcagactgtcttgattaatctagttttatagtaaggcctaaaatcaggtagtgtgatttctccagttttgttcttatttttcagaattgtttggctattctagttcctttagaatcaatttgttggtatctacaaaaggtctgctggaatgttctgttgctttatgttaatctatggattaaattggagagaattaacatgttagtagtattcactcttctagcacatgaacacagtatatctccccatttatatagatttgacatttctttcatcagtgttttgtaatgtttagcatattgaccttgatactatgcttttatatttatatcaaaatatttcatttcgggtgctattgttaaggctattttgaaaatttttgaattaatagcaagcatatagaaaatagtgagcggtggctaactcctgtaatcccagcactttggggggctgaggaaggcagatcacttgaggtcagaagttcgagaccagcctggccagcatagtgaaaccatgtctctactaaaaatacaaaaattagccatgtgtggtggcacatgcctgtagtcccagctactcaggaggctgaggcaggagaatcgtctgaacctgggaggcagaggttgcagtgagccaagattgctccactgcactccagcctgtgcaacagagtgagactccatctaaaaaaaaaagaaaaaaaatctctaaagagagacaattttatttcatctattctaagctatatgtcttttgtttattatccttgacttatcagactagttaagacttctagtaggatttagaaaaggaattatgagaaaggacattcttgccttgtcccagatctttaggtgaatacattaagtttttcataattgtgtatgatgttaattgttttttgttttgttttgtttttttaaagatggcttcttacagattaaggaagttctattactagattgccgaggatttttaaaatcacatatgcatattgacatttatcaaaagctttttctccgtgtattaaggtgatcatgtatttttccctatttaatctcttaatgtggagaattacattgtttgatttttcaaaattgaaccaggcttgcatccctggaaagaagaaaccacttgattgtggtatattattctttttatatattgttggatataattttctgatattttgttgataatttttgagtctgtgttcatatgagatgttggttggtctacagttttcccgcaaagtctttctgtggttttgaaattagggtaatacttgcctcatagaatgccttgtgagttgttaccttctattttctgaaagatattatgcagaatacttttttttcttcttaaatgtgtggtagaattcttctgggtcttcatttttttgaaagattttaaactacaatctcaattcagtaattatagattatctatttcttcttgagtcagttctgatagtttgtgtctcaagaatttggcccgtgtaatctattttttgaatttaaaatatgcagttatttctagtatctaattttattttacagtttgtggggtatgtagtgatatcatcccttttattcctgatatttgtaatttgcattttatcttttttttctttgtcagactggttagaatttatcaattttgttgatttttcaaagcactggtttttgttttcattgatttttccctatttttgtttctaattttattgatttgtgctctttattatttacttcattctgcttaatttgtattcagtatgctcttctttttctagtttcttaacatggaaacttagattattgatttgtgacctttatacttttctaatatagtattacatactgtacattttcctgtatttccttagctgcctcctgcaaattttgctatgttgtattttcattttcagtcagttcaaaatatttcctaatttcccttgagattttttacctttgacccatgggttgcttagaagggtattgtttaaattccaaatacttgataattttctaggtatcttcttgttatcaattacttctttaattccattatactctaaggacatattttgaataaatgttcaatgtggaatttaaaataaatttaaatatataaataaatttatatttattacattttattatttttattaaatataaaataaatttatatttatttaaaattaaattaaaatataaatatatatatacacacacacatttgtatctatctataaatagtcctattgctggtatggtgttgaagactctcaaggttccattactagacgacatttttaaatctcactcaaacttttggcttcaactgtccaatttgataatttcaaaatcggtgtctatagcataaatatctacttttatgtctagagttttgtgcaaacattttgtgcatatttcctttcttggaggatattcagtttcttcaaaatcaatagttcccaaattttaacacacacctacttttcctaccttggccagtattattttcataatatacccagttgcccaacccagaaacctggggtttatccctgattcctcccttacgtatctcctattctaataggtcatcaagtcctgctatttttctctttattttccctaaaaaatccttcttatttcttgtccaaacttcttcagtagtactctaatgtttcctttgtctccaaacttgaatataatccaatttagttttcgtaaccatattgaactatcctttcggaaatataaatttaacaattgccattgcccacctctccttaaagttcactatgacttttcattgccttagctatattaaaacaaacaaacaaacaaacaaacaaacaccttagcctagcctagtaggttgttcataaaccagctcttcctcctatatctcagttttattgccattcttccattcttcttgtaactcacactttggccacactgaactacttacaaaacatcttctaccttcatctgaaatagttttgtctcttatgtattacgtttgctccataaacttgtattgacaatatattatattgtcattgtttgctattttgttcatctcccctatacagcattagctctttcaggatagagaatgtaattttatcatctatacatacttaactgtacccagaagagtgtctgatacataataaatacttaatcttgctttgaatgaatgactaaatgaatgatttattgaataaaataataagcacttgagccaggactagaaacaacatattctgcttccaaatgacacactgactctgtttttagtagaatattaattagttattgccttactatataccatgtcagcaaatggaaggtcttacttataaaaaggcaaagtaatgtttgcactttgacttgatttttttaatctttttggctatggaaacaattactccaatgtcttgaataaatactcccaaaagatactcaggtccagtctttttaagcaatataactgatagctaaatgcattgctttgcactttctccctgaggagtctggctaccacttttatgccaactcagaatctcaggttatctggctatgttgtactctcatcagtttacctcttcactaactggaagagcttagtgttgtctgcaacttataaaccacctccagttagtttatgaaaggttcaataaaaattgtcccagtccaggttaaaaatgaacagttcttaataaactgattcttatcctttgttttataaacctcaactggtttccaatctacaaaacagtggccttaacctttggggcagagttttgccaaaagtatttagaatatttacactgaatctaatgtttcttccttacatattaataataacatttttttcctcaaatatctttatggtattagtcaaacctaaaatctccttatagacattgagttgacatagcatgatgaagctgcagaatttaacatatagatgttataggttactcaggaagtacagtgaagtgtggtacttgggtacctcattaaggaatttagataatgattttgttatttgaatgttttgaaatactgtctgtgtcagttggcaaggatgaattgaggtgttttctaaggcatcaggataatccactaaacataaaggttagcacatagtaagattttaatagatggctttttttggtaaattattcctttttatttcaacttactcttcagaaagctgtaaagatgaatggattaatttctataaaattctcacaagttctagaaagcattaaaaatgagatattgttgctgttttagttcttattaaatggtatacttcttttgcttcctggattgtattctactgtactctagattgtgaatattaaatacgttgtcttaaaaacactgttttggaagctttatttgggaccttcctatttatgtctaccccaactcaacattttcagcacaaattttaagaaagattagagttaaatattaacttttatgatttcatttcgttattgagaaaagtactatgtgtataatgccctctttcctgaatgaggataaatggaatgatatattttcattcattgaatgtggcacatttcctcttagggattgagttaatttcctctcaaaatgtccctcttcaccatctcgtggtcttcccccaatttcagatgctcattcacacaataagacaatattctgcatggagtaataaaagcgaaatataacaaagataaaaaatcagatctggcatttaggagacagttttaatatgccacaaattctcacatccttagactgcttcagagttaatagacttattgtctattaacaataaggactattccatgtcctgtggaaccatggaatagaaataactgataaggaaacaaattagctaaaacatagttaagacatcacctttgtagtgattaaaatttggttcacgaagtatcatttgtgactgatgcaaaacacagagtcaaaccaattaaggtccttaaagaacccagagaacttgactgcaaaaatcatgtttaccattgttttcaacttgaaataattgttttatgttcacctgaattttccacttcactcgcctcattcctcagaaacatctctcattattaaccttgctttgctcaatcactctcctgtcctgcttcaccatgtgctctcctcacctcacctccaaccccagcagatctttttagtggcacctttatttaattattaatttagcaccttctcttaagattgtcatctgccaagaaaaccatactctccatagctctattcacacacaaaaaatctactttcataaatattatccagtaatagtcaggtggtaatcctggttttgactcttcaaagtatattgtcctaccactaccttcctttgttaagcatgaaatgcatatgccctaggctgtattaaaagaaatgcagtacactctggaaggaaattgccccattggactctgtagttgtcagggaatgcctgaagtgcttcatttagttctggacaccacattttaaaagagacattgccaaaaaggaagataatcaatgggaggtatccaggatattcagcaaagttaaaaaggtatcggaaaatagttggagggaagtagggcttgttagtctggaaatagggatatttaagagaggtcatgtgtcctgctttttaaaatctgaagggattaaatctattctgtatttcctccaagaaccaaacaaggtcagtgggtaaagattatatgcagaccattgtaagtcaatataaggaagcgaaccctgttgacttcacttctacgacatattctgatctttccatttcccttcacataaactgtagtccaagacacaatcatcacttatgtcaactgcattgataacctgcgatctggtctccctatttctactatttttgcttctccaatccatccttcaaagagaagccagagagattattattattattattattattattattattattattaaagttctgggatacatgggcagaacgtacaggtttgttacataggtatatatgtgccatggtggtttgctgcacccattaacccgtcatctacattaggtatttttcctaatgctatccttccccttgccccctattccctgacaggccccagtgtgtgatgttcccctctgtgtgcccatatgttctcattgttcaactcccatttatgactgagaacatgcagtgttcggtttactgttcctgggttagtgtgctgagaatggtggtttcaagcttcatccatgtccctgcaaatgacatgaaatcattcattttgtggctgcatagtattccatggtgtatatgtgccacattttctatattcagtctatcattgaggggcatttgggttggttctaagtctttactattgtgaatagtgctgcaataaatatgcatgtgcatgtgtctttatagtagaatgatttataatcctttggctatattcccagtaatgggattgctgggtcaaatggtattttttgttctagatccttcaggaatcaccacactgtcttccacaatgattgaactaatttacactcccaccaacagtttaaaagtgttcctatttctccacagcctttccagcatctgttgtttcctgattttttaaggatcgccattctaacgtgtgagatggtatctcattctggttttgatttgcagttctctaatgaccagtgatgatgagctttttttcatatgtttgttggccatataaacgtcttcttttgagaagtgtctgttcatatccttcacccactttctgatggggtcgtttgttcttttcttgtatgtttgtttaagttatttgcagattctagatattagccctttgtcagtggatagattgcaaaaattttctcccattctgtaagttgcctgttcactctgataatagtttcttttgctgtgcagaagcactttagtttaattagatcccatttgtgaattttggcttttgttgccattgcttttggtgttttagtcaaaaagtctttgcccatgcctatgtcgtgaatggtattgcctaggttttcttctagggtttttatggttttaggtcttatgtttaaatatttaatccatcttgagttactttttgtagaaggtgtaataaaggggtccaatttcagttttctgcatatggatacccagttttcccaatgccttttattaaaaagggaatcctttccccattgcagcctctgttctgttccattggtctagatatctgttttggtaccagtaccatgctgttttggttactgtagccttgtagtatagtttgaagtcaggcagcatgatgcctccagcttctttcttcttcttgcttaggattgtcttggctatataggctcttttttgaaacttaaagtagctttttctaattctgtgaagaaagtcagtggtagtttgatgggggtagcattgaatctataaatcacttttggcagtatggccattgtaacaatattgattcttcctatccatgagctggaatctttttccatttgtttgtgtcctctcttatttccttgagcagtggtttgtagttctccttgaagaggtccttcacatcccttgtaagttgtattcctaggtattttattctcgtgttagcaattgtgaatgggagttcactcacgatttggctctctgtttgtctattattggtgataggaatgcttgtgatttttgaacattgattttgtatcctaagactttgctgaagttacttattggcttaaggagattttgggttgagacgatggggttttctgaatatacaattatgttacctgcaaacagagataatttgacttactctgttcctatttggataccttttatttatttttcttgcctgatttccctggccaaaacttcccatactttgttgaatgggagtggtgagagagggcacccttgtcttgtgctggttttcaaagggaatgcttccaacttttgcccattcagtatgatattggctgtggatttgtcataaataactcttattattttgagatatgttccatcaatacctggtttattgagtgtttttagcatgaaggggtggtgaattttatcgaaggccttttctgcatctattgagataatcatgcagtttttgtctttggttctgtttatatgctggattaaatttattgatttgtatatattgaaccagccttgcatcccagggatgaagctgacttgatcgtgttggataagctttttgttgtgctgctggattcggtttgctagtattttattgaggattttcacatcgatgtttgtcaggaatgttggcctgaaattttctttttttgttctgtctctgccaggttttgttatcaggataatgccaacctcaaaaaatgaggaggagcccctctttttctattgtttggaatagtttcagacagaatggtaccagctcttctttgtacctctggtagaatttgactgtaagtctggtcctgagctttccttgtttggtaggccattaattactacctcaattcagaacttgttattggtctatccagggatttgatttcttcctggtttagtcttgggaaggtgtatgtgtccaggaatttatctatttcttctaggttttctagtatatttgcatagaggtgtttatagtattctgtgatggtagtttgtgtttctataggatcagtggtgatatcccctttataattttctattgtgtttatttgattcttctctcttttcttctttattagcctggctagtggtctatctattttgttgatgttaaaaaaaaaaaaaaaaaacagctcctggattgattttttgaagggtgttctttgtgtctgtctccttcagttctgctctgatcttagttatttcttgtcttctgctagcttttgaatttgttgctcttgcttctctagttcttttaattgtgatgttagggtgtcaattttagatctttcctgctttctcttgtgggcatttagtgctaagaatttccatctaaatgctgctttagctgtgtcccagatattctggtatgttatgtctttgctctcattggtttcaaagagcgtacttatttctgccttaatttcgttacttacccagtagtcattcaggaacaggctgttcagtttccatgtagttgtgcagttttaaatgagcttcttaatcctgagttctaatttgattgcactgtggtctgagagactgcttgttatgatttccattcttttgcatttgctgaggagtgttttacttccatttatgtggtcaattttagaataagtgcaatgtggtgatgagaagactgtatattctgttgatttggtgtggagagttctgtagatgtctattaggtccgcttggcccagagctgagttcaagtcctgaatatccttgttaattttctttctcattgatttgtctaatattgacagtggggtgttacaatctcccactattattttttgggagtctaagtctctttgtaggtctataagaacttgctttatgaatctgggtgcttctgtatttggtgtatatatatttaggctagttagctcttcctattgcattgatccctttaccattatgtaatgcccttctttgtcttttttgatctttgttggtttaaagtctgttttatcagagactagaattgcagcctctgctttttttttcttgctttccatttggttggtaagtcttcctgcagccctttattttgagcctatgtgtgtctttgcatgtgagattggtctcctgaatacagcacactgatgggtcttgattctttatccaatttgccagtctgtgtcttttaattggggcatttagcccatttatatttggggttaatattgttatgtgtgaatttgatcccgtcattatgacgctaggtggttattttgcccattagtttatacagtttctttataatgtcaatggtctttacaattcggtatgtttttgcagtggctggtaccggtttttcctttccatatttagggtttccttcaggagctcttgcaaggcagtcctggtggtgatgaaatccctcagcatttgcttgtctgtaaaggattttatttctccttccacacttatgaagcttagtttggctggatatgaaattctgggttgaaaattctattctttaagaaggttgaatgttggccccaactcttccagcttgtaaggtttctgcagagagatccactgttagtctgttgggcttccctttcagaagagaaaggggtaagctgacctgtctctctggctgcccttaacattttttccttgatttcaaccttggtgaatctgatgattatgtgttttggggttgctcttatcaagcagtatctttgtggtgttctctgtattttctgaatttgaatgttggcctgtcttgctaggttggggaagttctcctggataatattctgaagactgttttccagcttggttccattctccccactcattttcaggtacaccaatcaaacgtatgtttgatcttttcacatagtcctgtatttcttggaggttttattcattccttttcattcttttttctctaatcttgtcttcatgctttatttcattaacttgatcttcagtctctggtatccttccttctgcttgattgatttggctattgatacttgtgtatgcttcacgaagttctcttgctgtgtttttcagctccatcaggtcatttatgttcttctctaaactgattattctagttagcagttcctggaaccttttatcaaggttcttagcttccttgcattaagttagaacatgctccttgagctctgaggagtttgttattacccacttcctgaagcctacttctgtcaattcatcaaactcattctccgtccagttttgttccctggctggcaaggagttgtgaccctttggaggagaagaggcttcctggtttttggaaatttcagcctttttcgtgctggtttttcctcatcttcttgaatttatctacctttggtccttaatgttggtgacctttcaatgggatttttgggtggtcatgctttttgttgatgttgatgctattgctttctgttggttagttttccctctaacagtcaggcccctcttctgcaggtctgctggtttgctggaggtccactccagaccctgtttacctgggtatcaccagcagaagctgcagaatggcaaagattgctgcctgctccttcctctggaagctacattccagaggggcactcaccagaatctagctggagctctcctgtatgaggtgtctgtcaacccctgctgggagatgtctccctctcaggaggcacaggggtcagggacccacttgaggaggcagtctgtcccttagcagagctcaagcgctgtgctcagagatctgttgccttcttcagagccagcaggcaggaatgtttaagtctgctgaagctgcacccacaggcgccccttcccccaggtgctctgtccccggaagatgggagttttatctataagcccctgatggggctgctgcctttccttcagcgttgccctgctcagagaagaggaatctagagaggcagtctggctacagcggctttgtggtgctgtggtgggctcctttcatttcgaactttctggcagctttgtttacactgtgaggggaaaactgactacttaagcctcagtaaaggcggatgcctctccccctaccaagctcaagtgtcccaggtcgacttcagactgctgtgctggcagggagaatttccagcctatggatcttagtttgttgggctccatgggggtgggatccactgagcaagaccactcggcttctaggcttgaggcccctttccaggggagtgaacagttctgtcttgctggtgtttcaggcaccactggggttacagaaaaaaaaaaaaaatcctgcagctagcttgttgtctgcccaaacagccgcccagttttgtgcttgaaacccagggccctggtggtgtaggcacctgagaaaatctcctagtctgtggattttgaagacagtgggaaaagcatggtatctgggccagatagcactgtccctcactcatggcttcccttggctagcggagcaagttccccaatcccttgtgcttccgggtgaggtgacatcccaccatactttggcttgccctccgtgggctccagccactgtctaaccagtcccaatgagatgagccaggtacctcagatggaaatgcagaaatcacccgttttctgcattgggtctcgctgggagctgcagactggagctgctcctgtttggccatcttgcctgggactgagatttttaaaacctaaatgaagttttgctttctccatctaaatccattctagcattctctcacttgatataaaagtataaactctaaatttctttgcattgcctataaggtcctaaatgatccactctgccttctctgtttctgtccttttccttcttgctccatatgtcccagccatactgaccatctttcttttccagaaagaaaactaaactccttgtcaaattcagacctgtgcatttgctgttgcctctgctggaacacttggctcccacctgcttccactgctgactccttcttgtcattcagcatttactcaaaggcttcctccttagagcagccttacctagctacttttgctaaaggaattcttccttcttattgttatagctctttgttttatttttttcccccatagcccttgtcattccctaaaaacttccattcttcttgtgtgctttctaattgcaatgttagattcataaaagcagaactttgtttaactactatatctacaatggtgaggacaatgttgggcccatgataagagtcagtaaaaatgtgttagacttggatgactctgtaacacattatattctaagattttattattgtaggtctcatcattcttaaactcatcatgtccataaacaattgcagtgtggcttattttttatgtgaatgcttatttgcatttaaatattgcatcaacagcatattttatctacaacatgctagcatagtggtttaaagtatggtcctgaagtccctcagattgtgtggatttctatccatgttctgctgtgtaacattgtgctagttatatagactctttacacttagtattttcaaatatttttatatacaaattatggataataacattgcccctgccctatagtgtgttttgttgagaaaatcagaagaaatatgtatagcacttaatacagtgcctggcatatgctaaatcctcaaatgttagctgttagtaatagtagtagtatttaatgtttttacacaactgtgcaactgtcaagccagtacttttacatgaaaataagtcaatagcaaggtgaactggacaatgaccaacaatttaaatatgtcatcaatgttatttagtccagaaaaataaatatataccattctcatgctattttttcctaaccttatgtgtttatactgacaagtgataagctttctgataacttcagagggagagaggagcaaaaaagagggattcaataaaagtgcattttaatctctgaatccttctataattcggaattttctcattctaaaagatcctaatgcaaaaattagaattcatagtgatggcaaacaactgtacccatattgtatatatatattctaagttgtttcacttgtatgtattgttgttgggatagaaaaggaaaaaaattacattgatgttcaatatcacgtgaaatacatattttttaaaataccagtgatgatgtaatcaacattacttagcagaagaaacaaactttacattctcttatctgctttcataacggtatataaagtcaatacaatagacacataattatacatatctactgaacattaaaattcaccttaagtattaattctttattcatatgaataattaaaatttgctttatttaagtttttaaaagtacttttgagaaccggcttatttctaaggactaaatacccttgatatatgcttttgatcctgattcaatgaaattgtttttctatttttctttgttcagtatataaaacaggcaaacccgcagtttgtacttcatgactagccttaactcttgttgaagtatagcaaaattatagtcctgtcaaaacatattagtagctgtggacaatctttggctacctctagttttcatgcatatttgtaatcttaataattatctatgcactgctttgttgaaaggttcattgttctgatttctatttagaaaagctttcttcttttaagaatacatgattacccaaatagtctaccctaaatgttgtatttctttggcgtagtaagtctgatttccttagcatggcaaatcttctctgacttgtgagaaaagtcaattgaaaaatgaaccaaattatttcaatgagaactcaagcaaatgtgcttgtagaatttcaacaagtgccgtatcggttaaagaaaaatgatttgaaggctgagtgtctagctaagtgcctgatttctctgtgcatatttatcattaattaatctataaatgtagctacccatgtttatggtatatgtagtggttattgttacagaaatcaggtgtttcatcaaatatactcatttagcacaaaacaaatatagtgtcggcctctttcattgaactctcagcaactaaagcttaagtcaagtatgcattttccaaaatgtaatgaaatcaccatcaaaacagaatgttacagtgccagctgtctcctctttggttttctaaagctttatttgttgattaagtggcttgcatctctacaaggccaccactcacttttctaaggccttgaccacagacgattcaattgcttggctgttaaattttcagccgtcagtgactatttgaatattatctactaaaagtcaaatttttctgacagaaaccacagtaaatcagtggatagatacttaaccctccagaactcaacctaagggaaacagttcttcttatgcttggggagttgtaacaacatctgagaaatgctgccgggagagcagaatgtgcctgtacatggcttatttaagcttcgaataagtaagagctttatgctgaagatactcatgaacaatgatttacatacaaaacaacactactaacctatcccactggtaccttgccagggaattattttctagtaggagatgttacacttatgctaattcaaacacatctggaagtttcttatatatatgaggcttcctggcagtgacacctcgtactcaatagatgggcagctctggatcacatagttgctagaacagtgtcccctcccttcttcctggctgcatgggcattgcttcattggctgtcatctcctttcagggtacctttattttgaacaatggcaagcatttgggacatggttaactgtggttgtaggattagggataaagaattaaggtgctctgtgagttggtaaggagggcccataggagcatacatatcctgatctctcatactaataaggatgtatgcaacaaggcactggcatttcttctaaccctagtatcttagtgacatcagtttaatttctgctccagctaggtaacagaagatgtgggaatggaagaaaatggaggaaacccagagagagaaataaaaggatataagctatggtggatgtaaaaccttgagaagataatatagttttagtcttttattgtgatttaaaataatgtttactatttaccaagaatgcaaagtaccatggctgaaattttgtgggaaataaatttctatgcagaacaatgcaaagatatttgagcaccaacataaacagtcaaattcatggggacaggcaggtaaaatggggagtcggtagaggtagcatgatgacaatgtcaccaggatgaatactattaaaagtgtttgattttgtttaccatattgatttttaaaattgtcatttactactgtggcagaaaaatccacccttgaatgacgtttcacaacttatgggactgatttagtatccaaatttaacccctgtatctgctagttccaataacttctttccctttggggaatggtttgcagtggtatgggtatgttcatttgcccatcatcccttgccacactctgaatttcaggcaagagatgcaacgcaacttagaactatgaagcactggccgggcgcggtggctcacgcctgtaatcccagcactttgggaggccgaggcgggccgatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaactatgaagcactgtaactgatcccagttacatgctttgaatcaggtaaagagacacagacgtgatcagataacactgacatgttgaatatttgggacatctgagtcattaattgagattccctattccaataatgtattataaagaaataagacttattgtctaaataaaagtaggctatccaaatagagattataatcatctattgaaaatatcatgatcagtgtaccattaagtggcatgtgttcactacaaagctgacaaatgcaccttttcaatacatgatcgagatctttatgttcggctttatgcagtttttttattattatttctgttaacttctgttcatcattttcagtatagaacttaacagtttatcctctgtttattcaggtagaatgtggaggtcattccaactccatactcttctgtaagacttttcacacttacgctgctatctagtttccccaacagcttgacttgctctgcaataaacataaatgcttcttctttttcttaccactattatcatagggatatctgcagatatttttgacattttcaacatctttacaccacagagcagagaataagcaaaaaaaaaaaaaagtgagtaatgcacataggtcttggtcccatgggggccttgtggggaaccggccataagcacatgcagcttacacacatgccatttattacactttatgggcatgcttgcatggaagaatatgggtgtatgctgaaaggatatatccactgaaaaggactgggaaggtcttctgtcccttgggacactgagtaaactgtgtggtgtgcacctgtgtttttgactgtgaatgattatatgaagttacgtgtggaatattcacttgtggcatcacatccacgctcaaagttttgggtattggagcattttggatttcaaatttttggattaggaataatcaacttgtataaaatatttgaccaattttgaccaatatatatgtattagtatgtctcttttagtcttcttgcatgttttagcgcattttagcatagtcaagagcatattgtacatacagtgctatatcctactttttgactaccctttactcttaagcaagtccttacatcattaaaagtctcaaaacataattttatgcttatatattattgcaattatatttgcccactataatttatttaatagtcataggattttttctagcacttcattgttttaaataacactatcctaaatatcttccttcttttctttatttgctcatttatcagatttttattaaatggtttttctgtgtcaggtgctgtgtaccaggaactatgctaggcctcgaaattatcaaagtgagtaagtggagaagataggctataaaaacaaataattatgataaagtataataaatgctaatataaaatgttaatataaatatgtgtttatatttctgatcaccaactaaggttatattatagaaagagaattattgggccaatgtggataagcattttaaaggctataggtatgtggtaccaaactgctttccagaattattccatcaatttatgaacacataggcaatgtgttagcatatttctcaccactatcagcatattattaatattctataaatgtttgctaatttggtaagtagaaatgatattttataattgacctttatcacatttccttggtaaagctaaactttttcatatactaatcagctttttctttttcttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatcggcccgcctcggcctcccaaagtgctgggattacactaatcagctttttctacgtctttcttttgtgaactgttagtccagtttctttgcatattatttcattgaagcattggtgtttttattatcaatatgtatgttttctttattaatttattaacctttttgtgatgtagttttagtaaatattcactctcattgtgtgtgcacttcaatttagttatatttttgacacccattaaattttaaatttttagatggttaatttgatatttaattttatgattttttctgatatataattatatatttatatttgtaaatgtgtatttgtaaatatatataattatatatatatttacaaacattaggttgaaggacatatttaaatgcttttctttcatgtatatttttttcagttgtaaaaacatagctactcatttaggcctctgtaagatatagaaggcttatttataagttaggaagataaagaggacttaatgataaaattagtactggaatagatcaacatagacatcaggatctcaggaagatctagcaatctttttcatgatcttcccctggtggaatcttatttatctctaggtattagatcccccttataactttgacttgtcatagtccctcatggctttgatttaattcagtctttttctctttacatatacttttaatatcagatcctattgctaactggccatgggtctgtgtttctctatttagattccaaagagtatggtcaagttaatctttatatacgaggcctccctgcagattcttggtcaacatatggatttgctgtccattagttggaatcctctctttgggtgattggctggagcaaggaggaaagaggtggtggtgtcagtgagtcaagctgaacaatagttgtcattggctggcatttcattcatctctaagaatgaaatgtggatattggagtcctgtgactgactttgctgtgaaaaagctgttgcaggtaagaatgtaattaggcattcaggagcttatagtactaacctcagctctgctgccaactagccctggatccttatactaatgtcttaacctcccttaaagcacagttggctcagctgacaagtgtgatggttttgtagtctttaaggtccattccaattccaaaatgtctacaattcttatatataatatttgacaatttaataaaaatgtgaggtacttctctctgctctgcaaagttgctggctttgatgagtaatcagagtattgccatcacttagctgtgaactaaatgaagtaatgtatttcagaacacttaagacctgatgtattttaaagagctaacatccaagagaaacatgtgcagagttgacagtccttggttgattacaaggcagttgagttaataatgttttatgagcaacctatttttattttagttattcttttgaactcaatactaaaattttccaaattccaaacacaatcttaaattaaaaaattaataatgtcaacagaaaaccttttaaggaccagattgtcatttgaggttattaatgctagctttacataaaaacaactgtctgatttcactaacttagcaaaattactgttcatttatgggtcataccacagtttacatatttaatagatggccttttgcatgacggttgagggatcctggctcttttcatctcgtggtactgctgtctcctaggcctccttcagatttccacataggtttctttgcttttaattggcaataggcaaacagcaagtgagaggggactcttggccagtcctggaagaagatatgaaatacttccattctcattctttgacagagcccaggaatatggtcctgtccaaattgcaagggaggctggaatatgtaatcttccaatgtagcaagaggaggatgcagggttgctaacatctagacagtctttgccataattggtagaatgtgaaatatatgctaaaatgaaaaatcaaggaaccaaacaaaatgaaatttccattttttctggctgaatcgataatagtgaaattgtcaaaacaaattttcatatagaaatacaaaaattaagatagttttgggtcattctttttcatcataaaaagtcaataaagtttgcaccaaataattacatttagcagcagattttggtgttatttttcccaaagtaaattatttgttcatttattctttaaaactgaattttaggtttcaggcaaattaaggtaacaaatggctcagtagaacactaagaatttttgcataatattacttttgtacacaggaatcagtcacattttcagagatttttttcttagtttcacataagaaacctaacaataaactatttcttttatcttctagcttcattgaaaggaccacaccaaatgaatcatgacattcctcaaggctgattttccccctttcttctccttatactcatcttccattcactctcctgtataaactattcttgtttctattttcctcttctgcctttatgaattttttaaagattttcagtaaactcagtaacatcttttccttcagctatatttctgttcccagtactgttatgactttactatcagttatacttatccaataattcagagtatattgaaaactagaactttcattagtgttaattagatgacctatacacattctttcgtgcacagaaaatattgttgcttgaatacgggagtacgttcgaaacatattcagttgtgtcatgttctgccatgttatccaacaacaacaaaaaacaagactaaaattctactaatttgaaatgattttaattttttacagtgttttgttttctgactgatagaccaatatatgtattacattcctttgtattctgagacacaactgtttgggttctgaagacaacattcttttacttcaaatgcttgacatagtgctttcctttaactggatagcctagaaatagtagcttgtatctcttttttcttcagatacaaccatcaccttctttcaaaagtaaaatataaagctgcttttccgtcagcatggttagaaattcatttatcgataaatagtctttcttaggttctcctcattctgtcacaataaatcatcaactatttcaaagaatattactattaaaatatttttaaaataataatggttgttatggatactgctaagtgctctacattgtggaatagtgtattattgtgagactatcaacctttaaccctattaagactctatttgggaaaaatatttaaaaatttgcatttcgatatgagttgaaaaattctggataatataatcagatagtttataatggaataattttgaatcgaacttttttttttttgagatggagtctcactctgttgctcaggctggagtgcagtggcaagatctcggctcactgccaacctctgctgcctgagttcaagcgattcccctgcctcagcctccccagtagctgggactacaggcacatgccaccacacctggctaatttttttgtatttttagtacagacagggttttgctattttggccaggctgttcttgaactcttgatctcaggtgatccgcctgccttggccttccaaagtgctgggattacaggcgtgagacaccatgcctggatttgaattgaacttttggtgaaagaaaatatcggtataaaatttacaaagttttgttataccaataaataaatccactggcttattccctttttaatttaaaatcagtaatgtaatgatttttataaaggacttacactaaatgaacacctactaagaagcattgtttatcttgcctataagatcataggcaataatatacaccttccttgccaccacattgttatatatagtatgtataaataagtatggacagccatatgatgaaatgctaattaaccaataaataataattggtaaattggcttgctaatgtgggaaatatacaatatatatctataatataggcagtaattacaagtgattatttctttgtggttttctgtattttcatcatttctgttttaactatgtcacgtttgtaataacacaaaatgataaatgtagttggaaaacatacctagtcacagaaatggtataaatataaataagtataatactttaaagaggtacagatctattaaagtgtactgtttcagagacttcaggctaagtgctagggatgcattatctctaccctcaagaagcctgttgatttgtagctaaaatgttagggtaattcaaatgaggacagattatttttgatagtatcccagacaccaggttcttatgaaaccagaaagcctggaaggtcataatacacttaaaaaacctcaactccctgtaaatgacatcaaagaagcatctgaaaagtattagagctggagaaaaatactcaatttgagaattttaaaaatggttagactaatagaaaatccatttttgtatcataaatataatacttgaagaagaaaacgaagcttggaactggtactatttcaaacacttgttttaaataatggaagtttatagtttataaatattgaatttctactacactttaatatagtgtattctcttggatatagaccattcattatagggcatgttcccatgtttccaatttcattagaagctaagaggacttcctgtgttctatggctgtgccacgtcaagaaggtggtagaggctggagcagtgttagctgtcactgttctctcttggtgatgtagactagatgaaggtttcttctttagtggccactggaaggctgggaatgtgaatgaaggactgtcaactgtattcttttggtgcaatagtagaatattaacttggaatttttaagttttaaaaacaaaacagttttcacagaaaagtaaaaggggatatatagctcatcccctattatcctaacttattatccagtgggtagggatttgtgtaaaattataattttaaatgtttcatgaggacctagaaatttctatttcctgcctaaaaatagacttctcatgtcttctacggcaaaggtttttaaacatggcaattaaacatcaattaaagtgattcaagattgtgaaatggctgacttaaaaacaatattagcacatacagctgggatgctggcttacctgaagacagagccatggcatccatgatttggaagttcagtgattcaataaaatagatttcatttacttggtaattttaaacattttaattgttttgatgtgtgtagacttttacaacattttgttgcttctctcagcgatatgacctgaatttacctttttcatgtagatgcataatcaatttaatttccagacgaaaatggatagtcttttggattttctgcctaacatacaggttggtaaaatttctgtcaaagcatatgaggatcaatataaacctctaagtgttgtagtgtgaataagaagtgactcacttgcttttaaactaaactctttgtaattggactttttctctatgttttttaaggtctacagtgaaccacccaataatggtgcttcaatatgaacttcatacaggttatagtcttcagaagggatagtaatatatggttgcaggtagaaagaaagggactagccaaattataccaaaagccctgtgtttctagcagaaaaaaagcaaagaaaaaagttaccacaaaaaataaactggaacatgtgaaggtaattggtcaaaaatttaacagtagcacagacatggtatgagaaaacacttatgaataattgggtgttcaaacatttggctaaggataaacatagagaagcaatctgattagacattttgctatcagtatgacagcaaacaaatgttcttaccaaacactctttttagcattgtagaattgatatatcctatattgtccattttaggttatattatatttactatgtgtatttgagtgtgtgtgtgtgtgtgtgtgtgtgtgtttattataagacagattatatagatagatgatagataaataaatacatcaatagataaatagttagataaaaaatcaggctgtaaagttgaaaacgttgagaaaggactctgggacattggtctgggcaatgatttcttgagtaagacctcaatagtacaggcaacccaggcaaaaatggacaaatgggatcacatcaagctaaaaagcttctacacagcaaaggaaatgttcaatatgcaaagagacaacttacagagtgggagaaaatatttgcaaactactcatctgacaaagaattaataaccagaatatataagaaactcaaacaaatcaataatgataaaaacaaataatatgattaaaaaatgagcaaaagttctgaatagacgtttctcaaaatgagacacaaatggttttctttttctcgttgaaccgtttttcatgataaacatgtcaggaaatggtgaacaggtatatgaaaaaatgttcaacatcatcagtcatcagataaaaatcgaaactacaatgaaatattatctcacactggttaaaatggcttttattaaaagacaaaaaataatgaatgctgtcaagtcgggggacctctagtggtcaagtgttcagtaggataagagggcaactataggtaacaataatttattgcatatttaaagataactaaactagtggacttggaatgtttttaacacaaagaaatgataaatgcttgaggtgatggatataccagttacccagatttgatcattacacattgtatgcttacatcaaaatactacatgtaccccataaatatgtataactattatgtatctataacaattaaatattttttaagttaaaatatattttttatatttaagagtaagcagaataactatcatttttctgggtttcttggagggtctccctgcaaaatcaaatgatattcctaattttttaggttctaaaaatttatgttttagggatttattcctcagacctaatattctgccttttagcctagcaatttcacacctcactgtaaatcaatttgctataagttttttctgcttttgcatatccagttaattctcatgaagtgccctttcccttactcctgtctcccacacctaatgtttctagacctggttcaaatgtctttttcaattcaaaaccttccttgagctatctaaatgaagttgataacttacttctttgattgtgtttatgcagagtatttaaccctaattattgtgttcatcacattaaattgcatttattttgtacctttctctccattagactgtgaattattaaggatatatcttctgccttatatgcttgataactctagcatctggtatttggtcttacaaattgttcactgaatgaatacatgataaaatgagtttgtgtcggcagtgaagggggaagctttaaaccttgaatgtctgagggagaattcaaggggagcaaggtgaaggagaaagataccactgtggggggaggagccaagatggccgaataggaacagctccggtctacagctcccaggatgagcgatgcagaagacgggtgatttctgcatttccatctgaggtaccgggttcatctcactagggagtgccagacagtgggtgcgcgcaccgtgcgcgagccaaagcagggtgaggcattgcctcacttgggaagcgcaaggggtcagggagttccctttccgagtcaaagaaaggggtgacggacgcacctggaaaatcgggtcactcccacccaaatattgcgcttttcagaccggcttaaaaaacagcgcaccacgagactatatcccacacctggctcagagggtcctacgcccacggaatctcgctgattgctagcacagcagtctgagatcaaactgcaaggcggcagcgaggctgggggaggggcgcccgccattgcccaggcttgctgaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggaggtctgagaacccgcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacattaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcaatggaagatgaaatgaatgaaatgaagcgagaagggaagttcagagaaaaaagaataaaaagaaatgggcaaagcctccaagaaatatgggactgtgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaacgtcgggttaccctcaaagggaagcccatcagactaacagcggatctcttggcagaaaccctacaagccagaagagagtgggggccaatattcaacattcttaaaaaaaagaattttcaacccagaatttcatatccagccaaactaagcttcataagcgaaggagaaataaaatactttacagacaagcaaatgctgaccgattttgtcaccaccaggcctgccctaaaaaagctcctgaaggaagcgctaaacatggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaatcaaaagacacagactggcaagttggataaagagtcaagacccatcagtgtgctatattcaggaaacccatctcacgtgcagagacacacataggctcaaaataaaaggatggaggaagatctaccaagccaatggaaaacaacaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaacggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcacaaataaagatgttctttgaaacttacgagaacaaagacacaacataccagaatctctgggacgcattcaaagcagtgtctagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagggcagaactgaaggaaatagagacacaaaaaacccttcaaaaaatcaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaataagtagaaaaagagggaatcctccctaactcattttatgaggccagcatcattctgataccaaagccgggcagagacacaaccaaaaaagagaattttagaccaatatccttgatgaacactgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccaacatataaacagagccaaagacaaaaaccacatgattatcttaatagatgcagaaaaagcctttgacaaaattcaacaacccttcatgctaaaaactctcagtaaattaggtactgatgggacgtatctcaaaataataagagctatctatgacaaacccacagccaatatcatactgaatgggcaaaaactggaagcattccctttgaaaactggcacaagacagggatgccctctctcaccgctcctattcaacatagggttggaagatctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaaaagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttgcagattcaatgccatccccatcaagctaccaatgactttcttcacagaattggaaaaaactactttaaatttcatatggaaccaaaaaagagcccgcatcgccaagtcaatcctaagccaaaagaacaaagctggaggcatcacactacctgacttcaaactatactacaaggctacagtaaccaaaacagcatagtactggtaccaaaacagagatatagatcaatggaacgaacagagccctcagaaataacgccgcatacctacaactatctgatctttgacaaacctgagaaaaacaagcaatggggaaaggattccctatttcataaatggtgctgggaaaactggctagccgtatgtagaaagctgaaactggatcccttccttacaccttatacaaaaatcaattcaagatggattaaagatttaaacattagacctaaaaccataaaaactctagaagaaaacctaggcattaccattcaggacataggcgttggcaaggacttcatgtccaaagcaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacattcatgcagccaaaaaacacatgaaaaaatgctcatcatcactggccatcagagaaatggacatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatactgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgatttcatgtcctttgtagggacatggatgaaattggaaaccatcattctcagtaaactatcgcaagaacaaaaaaccaaacaccgcatattctcactcataggtgggaattgaacaatgagatcacatggatacaggaaggggaatatcacactctggggactgtggtggggaggggggaggggggagggaaaaaaaaaagataccactgtgtacactgagatggaattcacttacttagaatttcatttagagctgaccctttgtgccagcgacaacctgagctgagcttcatgtacctaaagccaggtcccggatttgcaactggggctgctgtttgcaaagcccatgggagatttttgacccttagagtcctctgaaaaccttttcttaggagtttttttcttgttacaaccacctattatgatctatctcttgtgataatttcacagaagtcttcaccaaattgtttgttcaattaatccttgaagaattttttttttcatggacaaatagatggtttcaaaatattgagaagttaaaaaaatagtgttgcatgtaagaggagaaaaactgcattttatacatatagatctgaatggagaggtaatttacaggagttcttcaatttaatactggtcaatgtcaatagatacaactgtgctgtcatattggggtgatcaaggtaaaagtttcagagtggatttaaaaatggctgtttgtaaacatgtaaaaataaatctgacatgatttttttctgttggaatacttcatctggaattaaaaacctaccagagagataagtaattttaaacctatttaagtgtaatttataaatagactctggagaactagaaagcagttcaaagcgtccttcaccctcaaagaagacgttgtcagactatgaaccacttcacagcatttgtatgaaataaaggcactgaaagtctcatgatgctgtgtcttacttgtctacccctatttattcatagaatgcattagttgggccccttaattatttcttatctacttactgcctatataagtcatattgaagaattttatcattacatttaggatttttttatttacaacttggacaagtgtattattccacagagtattacatgtgtgcaaatttagtaatagatttttgaaaattggcctccccagcaaaacagaaggtaggaattcttgcaaacacttttgcccatggcactgagctaggtacatagaattctgtggaaatgaattagtttgtaacagccaaaaacagtgttgaaggagatatagcaataatgttgatcttagttataagggtaaaataagatcacttgaaaaacctctctcagtttttgacaaattaatgagtatggctgtcttcttccccttaatataattctgtatatgtgacacaaatgctagtctggttgattctgagaaacagaaaataaaatactgattactcttagaaagacataagctaatatatatggagggaagaacaatttagatacgaaaagaactggctgcaaaaacagcaggaacttaaagaagaacttttaagttgtaatttctgcctttcttcacattgccctgcgagaattatttcctacagtaaggagaaaaaacagcagcaccaacccagcatcagtgacaaatggtgaggaaacagcagaaaggcaatccaacctagctgggttggagggtgaataacaacaggttcccagatattttgggtggatcctgatgattttctcttctctatcctccctatcaggactagtgaggagaaaagaagagtcctcaaagtacgtaattgcttactgtggggcggtgagcaaagagagtgattctgcccagattgcaaaattagaaaatctcagactggaggtggattccttcaccttataccagataaaagagaattgtggaacagaaattcaaaataaatataaataaaatcttaaaataaatataagtaagaattaaatattctcaaagagatgagggagaataatggaaaagatgagcagaataatacattttgaaaaaaatagaactcagtagataaattaaaatagaataaatacaattgggtaacaaactaatgaatttgaaattagaggaaaattttaaaacatcacaagaaagagataaagaaaaagagaagaaaaaacaaaattttggagagaggaaggatggatatataattgttaacctccacattgaaggttttccaggaaactatatttttaaaaaatgaaagagaggaagtatttggagaaatagtggcctaacatttgtaagaattaaaaaagaaaaatattgcaaagtttcatagtgccaaaccttttagatgatttaaaaagacaatacaaacatattaaagtgaattttaaaacatcaaacacaaaaaagagattactaaagttttctaataaagaacagagtatttacaaaaaaaacaagaaatgaaacactaatgcaattattgttaatgttatattcataatagaggagaataacatttttcaagagtaataataaaaggactttaaatctgaaatattatatgcaactaacaataatttacatgcaaaggaaacatacttacatattctcaggcaaacaagaactcagaaatttcatcaagcaaatgactcttttgaaaatactttcaggaagtataatggtaagttgaaactagaaaaatctatgaaatacatgaaatgtacaggtaagaaaacagcatagtaaattttcctgttgctaaaacaaacctaaaatctataaaagatccataaagctcagagttaaaaatgcaaacgtggtggcaggggagaagaaaataagagacaagaaagagagaggtgatatggatatggataaactaagaaatgggtagaagaaaaaaagtaatgtagatattcatcattgttttactggtaaccaaacaataaataaaacacaatattaactttcatacaagaagaaggaacttcttgtatgaaattgaatggaaagtgtgaaaggcaaattaaactaatacacagaaaatatacaataaaaatcaaatattaagaaagaaatgagtcctagtaacaatcgcaataaatgtaaatgtattaaactcactgacaaaagacagagaccttcagaatggattagaagaaacattatccaacaaaagataaaatacaagagaaaacttcaaagaaaagatgataaaagttgagaataaaggtaaaactttcaattacaaacaatgttggattagtttaccataacaagtgtctcactgaggacaactataagaagggtaaaattttaacattatttttatgcacatagaagagtttatgagaccaggccaaaattaaagggaaccaagaaaaaataaacaagtatgaaagcaattttgactattatcaggcaaattgcaaccatgcctcttctttgagaatgttactttttctgtggaggtcttttatccacatatacagaaatctagaagtccctgagaatttactccttccacacagcccttgaccagtggctcacagaagtaggagtatagcaagttagcttctttgccttgggcaactctgaggttaacttactccagcgttctcctgcaagatcaggccaaagctatatttgcagggctttatctgagactgcaccctggcatggctttcttctctccccttttctgctttccatgctaccttgctgatctctatagagactattgcctttctaaatcatttgttcatgaatccttgcctcagggtctgcttctgggaaaactgacctaagataccatctctaatattgtcccttcctcattctttctagtttttattttttaaagtctttctgtcatctgttgtttctgttggactctatcaagtgatttattgtgggtattattttttaaattttgactgtaaattcatgtttcttgggactttatctgtagaaatcctttgaagcctggatggaatgtgtattccctcaaacataatttgcctaggtttatctgagatccctgaagaaactactatttggggccactttaaatagattgttggatttaggtttgttaggccactaagtcaatgtggattcagtgtacaaatcagcatgaggagtgttctttggctatgaatgttcaggtgagatattttgtctgaattcagcacaaaaatcataggaaagaatttccttctcttgtgctgtggggtggatttatttctggtacaccccatacacaggatagagccatttagggtcccagcattatgtaggtatgccctactggctttatcactttggtgagccataggctttgtcttctgtgccttctgtcctgtggggcagaaaaaaatggaaactaagatttgataagattaactacatagtctaaggtccaaataatttcagtgctttcttaactttctaaataagaattttaatttgaccttgaaaagttccttctgtcttgaaagagcaaggatatagttattagatttaagaaatttatttttacttaaatataaaaatatatttaagttaaaatatatttaagttaaaatatatttttatatttatttttatatttaaaatatatttttatatttttatatttatttttaatataaaattgttatattttgttttaatataaaatatatttttatatttaattttatatatttatatttatttaaatgtgtgtattaacacaaacattaaatgtattaacacacatttaaatatatttaacacatgacacgtgtgtttcttccaatgtcaagtaaaggccatgtttgctgatatgccatacatttatttgtttatttatttattggagaggttatggggggttttccatgcatattaaacatgctgctgacttaaaattctattatccagagagcagcataattcagcctagtccatttaaatttgataaaaattatatgtattaaacaataatgaattgatcatcaacagcaatgaacagacttaacaggagaggaaagacaaatgtcagttaatactctcgctttgtgaacaagtagttgtataatttaccacaataaattgttttcatggctttttagtcaaggctatataacagagaatgccagtgaataccaataataacaacaatattggagcctattatcaactcagctataagaaaaataaagaatgagtacggttgttatggaatcaggaacatattcagggaaaagttagaggaaatagcactaagttgtcatacattacttcaaaaaatgaaaaaaaggtattttactttcttccttacataaggagaaggactaacaattttctctaaggataagggggaaaaaacctttctaccttttaccctctgatcaggacctcttgttctagagggaataaaatatatctcacccttggaatcaatcattgtgaatggatgagttgtgtaggcaaatatagttttaaatgaaataaaattgagcttaggtgaaattagtgagaaccagtatataagtaagaaaatttttattgatttcaatatgttagttgagattttaggctaagggattgtcacaggtaggatcatattacataaaatgatgaaagtaatagacaacaatccctgtgaaaaagcttgagaattcctcatagctgcaatagagtcactgaaaaggatttatggtacttgtataggtagaagtatttccatttttctatcattttctaatattattgctaccaagcatcatttttattaatacccatgacttgctctgggtattaaaaaaattttactcctcaaattgcatggaaaaagtaactgttaattcacttttttttttttttttgagatggagtctcactttatctcccaggctggagtgccatggtatgatctcagctcactgcaacctccgcctcccaggttcaagtgattctcctgcctcagcctcctgagtagctgggattacagggtgcaccaccatgcccagctaatttttgtatttttagtagagataggatttcaccatgttggtcagggtggtctcaaactcttgacctcatgatctgcccacctcggcctcacaaagtgctgggattacaggcatgagccactgcacctggcctaattcatgtttaaataatcacaagcatatataattggaaatcagatcagcaagaaataaccagtagacaacggagttgatataaagtaaagatcaacctagtgttctaatttttattcattcattcattcattcatttactttttcatttattctcctattcatttcattatttattaattattaactagtttttatgtatcagaaaccatatggggcttatgagtttttattgtggttaagtgcaaagttcccaagagccttatgaaatattaaaagtaactcaaggcccctctactataaactttgtagattataattttttgaggggttaatacttatgtatagaaatcattgagacctagagagtttaaatgatttgccctagattgtacagataattaatggttgtctcagcactagaagccaatcttcttaattctactgaaagtagataatatgatgactcatatttattatgtaaatattatattttattataaacatgacagttcatattgactattacaattaacatgcagtataaaatatgtgttagtgttacattgttgttaccattatattgtattatattgcagatattttttcttttggtggctgcatacaaatgaattataactatattaataatatttttctttaaaaaactaaagatgacatttttaagtcctctctcttggaatctgtcattgcacttggctaaaatgtagctacagattatttgtactatatctttcgactgtaccaattggcaacaatttttctctttaaaccctaatcaatgaaaataatacttctgtgtctcagtcaatcgcagttgcttgtaaatgacctttgactgataagtttaattgaaaactgtggtcagcctagtctgtcagcaagcatgtcatataacacaagataatttgaaaaaaaatgcaacaatgcattcaatctgtggcagtagatcaggaaaattactgcatatccagtgctgaacagaagaaaaaataatagggtattttctgttgacctccttaagaaccaacctggatcaaatctacttaaattttaaaaccagatgaaatcaagtgcgttccatctctttgtagctaaacttcttaagcccctcacttttagtagcagcagactgtgttttcattacttattcatctcaggatgcacttataaatataaaatatcatcatttgagtttgttataccattagctttaaaattttataaactactgaacaggtgtttataaagttgaataagttaaggagatttattgttgtaagaaaagtgtatcagtaggaaataccattgataaacagaaaaacgaaagattgtaaaatttactgagtgcatttgagaaaaaatatatttttcaagctttcaaaatattaaagttgtcttaatgactgaaatgtgttttttaaaaatcctgtgtttaaaaaaattctaatgaaatttgttacattttgtctctacaaaaatagtcatctcacttttattttcacgcttccatttgtgaagtatactccatgcacctcaaacatttatgatgagcatattttctgatccaggatatatgtatattagaagattttttccttttttcataagaaacattattttaagcttcccaaaaaattaatacctcagaggttaaacaaggaagcttttcactgaaaaaaacttgtgaagaaattattattctagatttactttcaaccaccaaggaaacttgatgtggcagtaaaataaatcttggaagaaaatataagaaattaaaaaatgctcaaagttaaccaaaaggacctttacaggtttaattcattgaacaattattaatactaagcacctatttggtgccaagaactatgaaaatctctgcagaagagaacaaggaaagatccttatcctctaaccacttatagtcaaatgggaaatgcagccatgctaacaggcatttacaatacagtctactaaattccaccaaagggctatcataaggtatcataagatataggagggggatctaatttagctttgaaggatcaatgaaggctcctaagagagattattgctaagacttgatggatgaataaaagttagattatagaaagtttgagaacagtaagagtgttcccagcagagaaaagtacttctgcaaaagctaggaatcataattatgagaatatagtgcatcagcccactgtttagaatagatgatgagaggctaacaaatacaggcaggaggcagaattactctgttcctattttgaatctgtccttgccactatgaagaagttatcatcaaaatagaacagctagaaaaacaccattaacaatgaattgaagtcccagaaaaagtaaaaagaagagactataggaagccacccagacattctaaatgaattcaagtttgcagtcatagacaaattacattccaaggtgtcgaaaggacttacagatgtaatcatagaatgattggcagtaatccacagaaatcacagagaaggggagtgctgctagaagatgcgatctaagcaaatatcaccccaattctctcaaagggttaaaaggtagattctggaaactactagatcagcaatgttgatctttaacagcattttagaatggattactttaacaaggaattgaaatcacttagaaaataatgagacaacctctaagatccagtctgagtgcactaaaagcattcctgccaaattagcctcatttaattttctgtaggttgagtagcaggggagattttagggggttgggaggttgcaatatttgtgtttaggtagggattttgacgaaatcactcgtatgtccttgggaacaagggtagaaatatgactgaatgacagtggacgtaagcagatatgtaaagctggttgaacaactgcatgtagttattaatttgatgttagcttgcaggaaggtttctcacagcacgtctcatggctttgtctctggctttgtcttggtcacatttaaaaacccaatctgggtgaagaggcatcagtctgcaaagggtcagctaatgtactgacttttagaaacataatttgaagtgttttagtagatagaacaatgcataaaaaacagaacatggagattgtggagccgaattaatgtactgttttggtttttgccatcagttccataagaatacatttggcggggaggttttaaaagttcaactcgaaaggagtataaaatgaaattaaaaaaccgctttaggtacttcagtaaccacaaactctaacaattacaccggcttaaaaaaagaaagtgaattcaaggtaagactatgttaatagaagaacattttcaaaatgagggaaatggccacaagactgatttctaatatttcactgaactcggacatttgtcagacctatcctgagtgttacatacaggtatacacgcatggtggacggaagctatggttttttcctcaacatccattacaccttctctgttaataccagcaataaggtttgagtgaacttgacctcaccctagcttcaagagtaagctatgctcagctaaggccaatcaggaaaattccatcttcctttgcactgtaattggtttaattaatccaggcctaagcttatcagtgtgtggcattcccctggttttacggattggttcaggggtggccaattgatgtaaatctcagtgttttcttttttttcagcagttaatgggtagcaacctgcctttcttgctgaatgaggcatcatgcagcactaattactgctggcaggcatccaacagctaggagggaagtcagtctggggagaaagttaacaccgataaaagtggagcagagcaaaccactggaaaatggacccagcgctctgatggaactgtgcctaaattaccctggagtttttagttattctttaagccaacttgagtttgatttttctgtcgcctttaattgaaagcattctaagattcaagaacaaattctaataagattattgtcaaaacagagggaagccatgccataaaaaaggaagtttagaggaacttgggaagagaaaatcttaagggttgtataaattgtttagttcagtcccatggaagagggagtggattgttgttactgtttgagaattcaaaactagggctgttgctactaagttctgagaagatgaattttgattcaacataattcactgagaaatactcttttgagaatatttctaatttttagaggcattccattgtagaaagagctgtttgccaattactggaagtgctaaaacaaagaataatgaaccatctgtaagttctattcagccccaagattgcatggtattttgccatccttatttatttaaatgtaggtaaggtagttacttgtttaaaagagcttgatttctgtcttggcttccccatctaacctgagagatgttttcctcatctgaagagtgaatgggttggaatacatggtttctaatactgtttctatagctctaaattgttttgctacccaaaagaaattgctggtggtatggaagcaaggctcttggcctgctgtttctccagatagtagtaaaaatctaaaacaagataatagtaaaaatctaaaaatgaaaaattagaatagcagcttcaaattaatcacattccttctcaaagttagaatgagggattgccttgggaaatgctactcagatctaattcctgaagatattatgtgcatatttcagaaatggaaggttctattgagtgaattatcaaaaattcaatcacttaacaataatttattgagcagttatattccccagcttgtgctagacactatgataaagaaaatcttacctgtctggctttgtctaaggtagaaagtatatcataagttttcagtatagaacattctctgttatacagaggccacataacaccttccttatcctttgcttttagtactaaattcaggatattgccaaggttctctgtatagaaaagaagagaaagtgagaagaaataaaagtatcattctaagtgcttattagattgttttgagcgtcccagaaagatctcttaaatagaggctataaacctatttcatactatacatgcatgtaatattttactgaaataaataaaagatcaatatcttttagaaaatataaataggcaaaaagagggttcataaaccttctgagtgtctagctaataaattcctattgtatgttcattactgtgcaagtgctttggagtctgtgtaaaatgcagttcctgcctcctaggaggtaatactggaaaaaccaagataaaatgaatgagcttttgaatacttttgtgcacaggtgttgatctatgtggaatatgccatgagtgctgcaggagcatagaggggagatgaaaaaaaacgcagactgggaagttaatatggagagagtaggtcttagccttgaaggataggctgaaacttaaaaggcagcagagttgaaaactgctgcttaggtgagggaaaaatacttgaaaatgttcagaagcaacagatttttatatagccatgaggatactgactgtattaggcaaaagagtttgtgggaaacacggataggtattctgagatgtcttaaaaattaagcaaagacatttacattgcatagagttttaagcagggagatctagattgtttttgagcagagactaacataagcaatgtttagggaaatgtatattggcagtaactatagcatgaattggaggataaagaggcttgctaggaagtgattaaagtaatccctgtgtgagtgatgatgtcaagacatgggtagttccatgtaacaaaccagcatatgtactccctcaacctaaaataaaagttgaaattattttaaaaagagcaattgcaacaaaaagaaaaattgacatatgggacttaattaaactaaagtgtttctacacagcaaaagaaactatcatcaacagagtgaacagacaacctacagaataggagaaaatattcacaaactatgaatccaacaaaggtctaataactaccatctataagaaacttaatgcaacaaacaaaaactaataccccctttaaaaggtaggcaaagaacatgaacagacagttctcaaaagaagacatacaagcagtcaataaacattttaaaaaatgctcagcatcactaattaacagagaattgcaaatcgaaatcatgatgattttgactcatctcacaccagtcagaattaccattattgaaaggccaaaaaatgacagatgttggtaaagctacaaagaaaagggaatgcatatatactgttgatggaaaaataaattagttcaggcactgtggaaagaaatttgaagatttctcaagaacttaaaatagaactaccatttgacccagcaatcccattactgggtatatatccaaaggaaaataaatcattctaccattaaaacacatgtatttgtatgttcattgcagcactattcacaatagcaaagacatggaatcaaccaaggtgcctatcaattgtggattggataaagaaaatgtggcatgtatacaccatggaatactagacagccacaaaaaagaatgaaaccatgttctttgcagcaatgtggatgcagttggaggccattatcctaaccaaattaatgcaggaacagaacatcaaatacaacatgtgtggatgcagttggaggccattatcctaatcaaattaatgcaagaacagaacatcaaatacaacatgttctcacttataagtggaaaataaacatggggtacctattgatacaaagataggaaaaatagacactggggactattccactgacaggactagataggtcatcaagacagaaagtcaacaaagaaacaatggacttacactataccctacagcaaatggacttaacagatatttacagaacattctacccaaaagctgcagaatatacattcttttcattagcacatggaacattctccaagatagaccatataataggccacaaaacaagtcccaatacattttagaaaaccaaaattatatcaaatattctctcagaccacagtgaaaatcaactttaaaaggaacccacaaaactatgcaaatacatggaaagcaaataacctgctcctgagtgatcagtggtcaacaatgaaatccagatggaaattagaaaattctttgaactgaacaataatagcgatacaacttatcaaaacctctgggatacagcaaaagtggtgtaagaggtaagttcatagcgttgaatgcctacatcacgaagtctgaaagagcacaaaaagacaatctaacatcacaactcaaggaactagagaaacaagaacaaaccaatctcaaacccggcaaagaaaagaaacaacgaagatctgaccagaactaaatgaaatggaaacaaaaacaatacaaaagataaatgaaacgaaaagctgcttctttgaaaagattaaaaaaattgatagaccattagtgagattaaccaagaaaagaagagagaggatccaaataagctcaattagaaatgaagtgagagatattacaaccaatactgcagaaatacaaaagaccattcaaggctactatgaacaactttatgcacacaaactagaaaatctagaggagatggataaattcctggaaatatacaatcctcctagattaaaccaggaagaaatagaaactctgaacaaaccaataaaaagcagtcagatggaaatggtaattaaaaaactgccaaaaaaaatatctaggatcagatggattcacagctgaattctatcagatgtttaaagaagaattggtaccaatcctactgacactattcgaaaagacagagaaagagggaatactccttaaatcattctatgaatttagtatcactctaataccaaaaccagggaagcacgtaacaaaaataaaaccacaggccaatatccctgatgaatatgaatatagatgcaaaaatcctcaacaaaatactagctaaatgaatcccacagcatatcaaaaagatagtccatcatgatcaagtggatttcacaccagggatccagggatgttttaacatatgcaagtcaataaatgtgatacatcacataaacagaattaaaaacaaaaatgacatgatcatctcaatagacatagaaaaagcatttgacaaaatccacatccctttatgattcaaaccctcagcaaaattggcacagaaggtacatactttaaggtaataaaagccatctatgaaaaacccaccgtcaagatcatactagatggggaaaagttgaaagcattccctctgagaactggaacactggaaaggatgtccactttcaccgcttctattcaacataatactggaaatcctaggtagagcaatcagacaaaagaaagaaagaaaggggatccaaatcaataacgaggaagccaaactgtcactgtttgctgatgatatgattgtatacctagaaaaccctaaagactcatccaaaaagctcctgtaactgataaatgaattcagtgaagtttcaggatacaaaattcatgtacacaaatcagtagcaatgctatacaccaatagtgaccacgctgagaatcaaatcaagaactcaaccccttttacaatagctgtaaaaaataaaaataaaatacttaggaatataccctaccaaggaggtgataggcctctgcaagaaaaactacaaaacactgttgaaagaaatcatagatgacacaaataatgaaaacacatagtggatgggtggaatcaatattgtgaaaatgaccatgttgccaaaagcaatctacaaaatcaatgcaattcccatcaaaataccatcatcattcttcacagaactagagaaaactatcctaaaattcatgtggaaccaaaaaggagcctacatagccaaaacaagactaagcaaaaagaagaaatctggaggcatcatgttacctgatttcaaactgtactataaggccatagtcaccgaaacaacatggtactggtataaaaataggcacaaagaccaatggaacagaacagagaacccagaaataaacccaaacacttatagccaactgatctttgagaaagcaaacaaaaacataaagtgaggaaagaataccctattcaacaaatggtgctgggataattggcaagtcacatgaagaagaataaaactggatcctcatcttccaccttatgtaaaaatcaactcaagatagatcaaagagttaaatccaagatctgaaagcataaaaattctagaagataacatcagaaaaacccttctagacattggcttaggcaaatacttctttaccaagtacccaaaagcaaatgcaaccacaaagataaatagataggacttaattaaactaaaaggctgctgcacagcaaaagaaataatcagcagagtaaacagataaccaacccacagactgggagaaaatcttagcaaactatgcatctgacaaaggactaatgtccagaatctacaaggaggtcaaacaaatcagcaggaaaaataaaatcccatcaaaaagtgggctaaggacatgaataaacaattctcaaaagaagacatgcaaatgaccaacaaacatatgaaaaaatgctcaatgtcactaattatcggggaaatacaaatcaaaaccacaatgtgataccacctcattcctgcaagaatggtgataataaaaaaataaaaaaaaatagacgttggtgtggatggggtggaaagggaacacgattacactgctggtgagaatgtaaactagtacaactactgtggaaaacagaatggtgattcttaaagaactaatagtaggtctaccatttgatctcacaatcccactcctaggtatctacccagaggaaaataagtcattatatgaaaaagacacttgcacacatatgtttacagcagcacaattcgcaattgcaaaaataaggaaccaacccacatgcccatccattaatgagtggataaagaaaatgtgtacatatttaccatggaatactgcttagccataaaaaggaacaaaacaatggcatttgtggcaacctgggtggaactgcggactattattctaagtgaactaactcttcacttttgagtgagaacatgtgatgtttggtttttggaataaaataccaaacatcatatgttctcataagtgggagctaagctatgaggatgcaaaggcataagaatgatacaatggactttggaggcttggggggaagggtgagaggggtgtgagggataaaagactgcacactgagtatggtgtgcactaaatcaccactaaagaacttattcatgtaaccaaacaccacccatacacaaaaacctgttgaaataaaaaataaaaaccaaaaataaacagaaaaaaagaattggacaggaaattgaaataaattattttatattgtttatatcaagctatctagaaggtaagcagataaaagtttgcttaagttgctcttacatttaaatgttttttcatctttttgtgttggtgacatgcaaaacagttcaagcttttctctactggtttgtgttgtcacaaacactggacaccagagtatagtttgttctctctatattatatgctgtatgttatgaatgtgtttttggattatgtataagattaataatttaaactctcaatatgctgagaaatgctgaattcatcatgagaacacaataagaaagtgatgatgctacatctattacttatttccacaattgtgttgataggtgcacaattactttggggaaaagcaaaataaaactacagggatacatcctgagagaaaaacaatactgaagctagaaaaaaaacctcaaaacattggatataggttcatttggttttcttttgtttacattttataatatattgcttgatttctacatagtaaagttaattatattgtgaaataaaaaaatgattttggaaatgggcttggaataccatcccttttgaagggaagagatacatagtacaagtgcatgaatgcaggtaggttggaagtttgagggtggaaggatgaggatggtctctgtgatttctatttgctcagacatatgaggcaaaattatcacttatacaagattaagtatgtgatgtttcaggtttgtagagaaagaagagtaagtaaaatttagttatcttatagtctaggaaagagaactgatttagtaaaaggtagttactaggtggtgctgaagtttgcttttataaatttaaaattatcatgacttcatctttacttcatgttcagctgcacagaattatgaggtaggtgaagagctaaattcaacctggattagaatcctgtcaagaaagaaggattgagaaagaaaagggcaaggaaagagaaggagtgtgcaaggacatgattgtaatcaggcatggaatgcaagtgagtgaggaagaaacgaagcatgcagaacaatcatgggagtggaggtgctggagtctataagtgggaagatgaaaggtgttatttgagatatttgagagtgggatttgggagatggaacagttattggcaatgacaagatgaagaggacatccaggagagtgcatgaatggggaatggcatcaaggaaccatgaggcctaagtgttgcattttcttcccatctattgaagtcaccaaggttgatcacaggactagtaacagaggaaaaaaacaatgatctcagagtgatatggtttggctgtgtccccacccaaatctcatcttgaatttccacgtcttgtgggagggacctggtgggaggtaactgaatcatgggggcaggtctttcctgagctgttctcgtgacagtgaataagtcttataagatcggatggtttttaaaaaggggaatttctcctgcacaagctctgttctcttgtctgccaccatgtgagatgtgcctttcaccttccaccatgattgtgaggactccccagccatgtggaactccaataaacctctgtgtgtgtgtgtgtgtgtgtgtgtgtgtgtgtgtgtgtgtgtgtgtgtgtaaattgcccagtcttgggtatgtctttatcagcagcatgaaaacagactaatatggtaagttgataccagtagagtggggtgctgctgaaaagatgccccaaaagggggaggcaactttggatctgggtaacaggcagagtttggaacagtttggagggctcagaagaagataggaaaatgtgggaaagtgtggaactccttagaaacttgtttactggctttgaccaaaatgctgataatgatatggacaatgaaatcaaggctgaggtggtctcagatggaaatgagggacttgttgggaactggagcaaagatgactcttattatgttttagcaaagagactggtggcattttgcccctgccctagagatgtgtggacctttcaacttgagagagatgatttagggtatttggcagaagaaatttctaagcagcaaagcatttaagaggtaacttgggtgctgttaaaggcttcagttttataagggaagcagagcataaatgtttggaaaatttgcagcctgacaatgcaatataaaagaaaatcccattttctgaggagaagctggctgcagaaatttgcataagtaatgaggaactgaatgttaatcccaaagacagtggggaaaatgtctccagggcatgtcagaggtcttcaaggtaaccccttccatcacaggcctagaggcctaggaggcaaaaagtggtttcatgggctgggcccatggtgcctgtgctgtgtgcagcctaaggacttggtgccctgtgtcccaggcactccagccatgcctgaaaggagccaacacagagctcaggctgtggcttcagagggtccatgcctcaagcctttgcagcttctatgtggtgttgagcctgccagtgcatggaagtcaagaattggagtttgggaacctccacctagatttcagaggatgtacggaaatgcctggatgtccaggcagaagtttgctacggggcagggctctcagggagaacctctgctaggacagtgtgaaagggaaatgtggggttggagcccctacacacagtccctactgaagtactgcctagtagagctgtgagaagagggccatcgtcctccagaccccagaatggtatatccactgacagttgcattgtgtgcctggaaaagctgcagacactcaatgccagcccatgaaagcagccaagagggaggctgtaccctaacaaaccacaggtgtggagctgcccaagaccatgggaactcatctcttgcatcagtgtaaactggatgtgagacatggagtcaaaggagatcattttggaactttgaaagatttaactgtcctgccagatttcagactttcatggggcctgtagcctctttgttttggccaatttctcctatttggaatggctgtatttactcaatgcctatactcccattgtatctaggaagtaactaacttgcttttaattttacaggctcataggtggaagggacttgccttgtctcagatgatactttggactgtggacttttgagttaatgcagacatgagttaagactttggggactgttgggaaggcatgattggtttttgaaatgtgaggtcatgagatttgggaggggccaggggtggaatgatatggtttggctgtgtccccacccagatctcatcttgaattcccacgtgttgtgggagggacctggtgggaggtaactgaatcatagggcaggtctttcctgtgttgttctcatggtagtgagtaagtattacaagatctgatggtttttaaaaaggggagtttccctgcacaagctctcttctcttgtctgccaccatgtgagatgtgcctttcaccttctgccatgattgtgaggccttcccagccacgtggaactataagtccattaaacctctttcttttgtcttgggtatgtctttatcagcagcgtgaggacagactaatacacagaactgagatcatcactgcatcacaggccagcaagtgatgggaggcaatatgacagagtctttaagaagatgaacgctggagccatacttccagggtacaaatccccactctaatacctcctagctgtttgactgtgaatatttcacccaatatcccagtacctcaagtgcatcagtagaataaggataggaacatatgtaactcagagtgttttgtgaatattaagtcagatcgatgcctggaacagggtaatcattttgagccctgacatgctcgaattttcagattaagagtgaacaacaggtatgtacatgcgaatattccaaaatccgaaaaaatctaaaataggaaacacttctggtccctaggacgagataagggatattcaacctatgtaaatgttagttgctgtcaactggtagtgtcttcagacgggagtattttcggtgtgtgtatgtgtgtgcatgactatgtatttatcagggagcatatagaaattagcaaggaagagcaagaaccagaaagacataaagtatggttgagaaaagagccatcacttgagaaggcttcaggggcagctgtgaccgtggggagggccaagtttcagtgagagcccaaaggtaacaagaatgactggaaaaaagacaaagatataacagttagctgcaagcagactatgagtttcagaagccacaaaacaagaatttagagtggtggggaggagaggaagaactgggtcagatttaagggcatatatagaaccatgtagagataagtgtcctcatcctgatggataactgggagggcagcgctggtcctgccgagtcaggtaaactaaagagattaggtatgaggaccttggtcctggttatctttcctcctgagaccaagtgtcatgtagtttttcagaagatggactgtggagcttgcaaaaatgaacaaagttcttctgtggcctgtgtaaagtctagaggagtcactacctagcagggaggccagaccacttctaagtaaaagaggggaagttaattattattattattagtgctgaaactgaatcctaacagctaattccggtccccaagactaggtcaaaacctctttataagttttcaaagcacctaatttcttcttcaaagcacatatcataatagtgatcacataataaattgtatattcatttaatgactatttcccctcacctcttttattcactgatagagcatcagaactttgcatgtagtagtcactatagctaatgcatatctatgtatctgtatctctatttacatatataactatatcatctgtcttttagtgggttttatattaggggttaagttgccaaatagatttatttggcagtgatcatatctaatttcaaacatttgctctctaagcctggtgcctccatgttacttatccagggttaatgaaggctgtgtttggaggagcagcccagggaagaatggaattcagctctacagttatcttgcaggctttacttgcagcatctttatagactttccgcaggagaaaaacaatggagacttggcttgaggaatgaatcagtccaaattattgaaacttgagtagcagagtaggcttaagctagtatgaataagagtttgcttgggatgtccttttcacagttgaattcaatagacaaagattctttttacattatctggaattgctcagtggttatttcattttttgttcctcaactagatcatacctctctagtgacaggagggagtgtcacttgggctgcaggcagccaagccttgtttggccaaagccaagtagtttcttgttatgctatgtgagctatgtttgggaaaatcagactggcattatgtaataatacataaaaaaggccatcttgtggtcaaggtgctgtggttaatgggtgagaaaacaaggttgcagaccacttgccaccctgttaatagggcctcctggaattaataaggccgtgttgtcagggcataggggcataaacgcaacaccagttcatttgttgctgcattccccatagtacataactgtctacagcagctatggtgtacacgttaataattattttactcagtgaccggaaatagtctatttttttttcactgtcatactctcagatagctgccgtagcattgcttttttgcacatgtagtagcacacttggttgaaactgatttttggagttgggaaagctatcaggggactgctgaaatgaggcagcttgtggtattttcccctcctccttacccctagttgaattaatacccaatttaacaatttaaacaagtgtctgagaacctaggagagaatttcaggaaaagtcaatagtgctttgcaaatagctggggtccagtgaagttgaatcagtgagctgagcaagaagagggaaacacagattcagagcaaatacaggaaggtggggaagaaagatagcaggggtaggtagggtggcagcaaaagagtaaggaatatcaggatccttgagacctgcaacaacttgcacatttgacttagtgtcctgttcttttcaccctagcttggcctgttatttggctgaaatctgtgtcctaaagcaaacattttaggtggggttgatagtaggatcccagaaaatctttacgtagaggctggatttaaatccactctgctctcttattcccacccatttaatattgtcatgcttcctgacaagttataccggcagggactgaaaaggaagactgacctgctcttggccttttcctcccacatccactttttgcctgcacaaatagtacataaacataatgcttgagaattgcaaaatgttcaaggtgatttttaaaatacagctataaaatggaaatattcaaaagcattttatgttgtcttagactcttgagtaaattgtgctgtgtgataacattttttctgtcattactcttggaacacaataaccttctttctggtctccttcctgccacttgtacctctctccacacaacaaccagtgattggtatggactgaatgtgtgtgtcccccccgccattcatatgttgaagccctaattcccaatggggtggtagttggagatggagactttgagagctaattataattaaatgaagtcataaaggtggagccttcatgatgagattagtgtttttataagaaaacacaccaaagcgctcttgtgctctctctctctctctctctcatacctgccatgaaaaaacacactgagagtgaacagagggccgtctgcatcatgggagagtcctcctcaccagaatctgaccatgttgacaccctgatctcagaattccaagctttcagaatatgagaaaatacgtttctggttaaacctcccagtctatggttttatgttatggcatcccaagctaactaatatagccatctctcaataatgtacattatatctgaaactttgaaactttcccgctgaaaaccttttaaggacttcttattactcctggaataaaattaaaatccttatcatagtctacaaggtgctgaatagtctttttttttttttttctgagacagagtgttgctctgttgcccaggctggagtgcagtggcgccatctcggctcactgcaagctccgcctcccgggttcacgccattctcctgcctcagcctcccgagtagctggtgtagactacaggagcctgccaccacacccggctaattttttagagactgggtttcaccgtgttatctaggatggtcttgatctcctgacctcgtgatacgcccgcctcagcctcccaaagtgctgggattacaggcctgagccaccgggcctggccaaggtgctgaatactcttctcttcaacctcatctcatattgtcccatgaaaagccattttccaccacagaaactttgcactactcatccctgcctgcaatgctcatctttcactgcttattttatttatttgccttataaatatttctagttactatgccaattatatacataactttctaaatatgtttttattgtttgtctctctatgtactgttacgtaatgaagaacataaactgcatgaggacagatatgttgtcctttcctttcaccgatgtgttccttgcacctagtacagcattggagacataacaggtacctataaaatattcatggagtaagtgattactagcctagaattctcaaagcattttttaaatttttttattattatactttaagttctagggtacatgtgcacaatgtgcaggttagttacatatgtatacatgtgccatgctggtgtgctgcacccattaactcgtcatttacattaggtatatctcctaatgctatccctccccctcccccgacccgacaacaggctccggtgtgtgatgttccccttcctgtgtccaagtgttctcattgttcaattcctacctatgagtgagaacatgtggtgtttggttttttgtccttgtgatagtttgctgagaatgatggtttccagcttctactcacttccttctttgattcattattatagttttgttttctttagcttggggttcattataaaacatatttacctttcaattccacatttttaattaaacatgggctgctggtgttgttcatggctgggaataatactgtttatataatatctagtatttcctcacatgtatctagaaggcttctccacaataataacttttaacctggaaaactgaggcccagctttgagccctgaacttagagggggctaccctggccttccaggacctcacctctattcaatgggtcaggagtccatggatccaagaggatacactcacccaggacctgcccactgattttatgaccggatgccaagacacacagaactctagaatcccacactcaaatcacccaagcctgcttctaggtcttacaggacctcttttttcaagactgggtccagcatgtaccacaccccttggcctgaggagtagctattaccataggtgtgagcagagtctagacaagtatactggggtgtctgcatgcctctgtgcaaggcaggacagaccaagtgtggagatgggaagagaaatcagcctgacaatcagtaattccagaatctgtcagacagacttggccacaagagtaaagaggccttgggctcaggcattcaccccaagacatttgctgagttgttctacaagcttggagttggaataaaaaagaagactagtcatggaaaattaagataagaaaaaaatgaagaaaatttgctgttaataaggaagttttaagagctaaagaagccctaaagtaaaaattatattactaggagaatttatttgtttatctattaagtttttttggctagagtacaaagatttttaaaacactacaagtttcatatattaccttttctcacgagccaattcttgaaaaggtaaagaaagttagttacttcctgtttcttcataagtattcttgaagaatttaatatagactagaaagtgatttttaaaatgctttgtgccaatcttccagaagttctgcacagttgtactgattgcctctgtagatataaaatggcaaagtttgtgactcgaaagcaaaatatagacatgttctgatccttccctgaacgcaccttagtgttaacggtcagggtagaaggatggctgtggatcaattttcatggagtagctgttactccctgcctgaggagacatgaaagcagccttttaccctgaagtaaaagagcagctatcttgatttatatccactcccttactttactctggtttatgctcataagtaaggaatttaagctatatagaatatgtatcccccaaaaaacagaatcatagaaaaaatacagcatataactaaattattgttacatttgcattttaacagaccttaatgttattaatcttaaaattttgttatggataacagctatcattgtacatatttaaaattgtctaactagagacaattggctttgatattacacaattgccagttagaagtccttagaagttttataaggatagagaggtaaagtaattcttaaaatcctgaatgaaataagtaaagataagatcagaaaggtaaaagtgaattcaaaaaataaaggggctaaacagaaatacaattggatctattgatgagggcaataaaagtaaacgatgcaaattatctttgaccaggctgatgggatttgaagtgttgaaaagtatctcttcctttctttttattaaaacaaagaaaacaccttcctttctctgtctgtaaacttatagaaatgcatgtgatcagataggaaagagagtttgacagtcaaaatgttgattgaggcaaggacaatatggttcataggttttactaatggaatttttaaaaatcaaagtcttcaatgaacatttcacgcacattcactgttctcaaagttgcccaagtatacaaaatcatgtattagattcattgagctacactgcaaattataaattagtattggtttgtataattttcttgtaagatatggtatttactttatcttcaattagtaaattcagagcctatacatgtgtagtgaattctgtttatagggcacaaaaatctaaacattaaaatcttgaactattacatggtagggtttggactaagatgaaatggtagtgaaatgggtatctttgataatgttacataagaagcatcatagagtccaacatttttcatactgaaaagctattttcaggtgatttattgccaatctggtgccttctctctgccaaaaatttaggtgcttatgtgaacacatatacaacaccaaagtacagatcggagaattcacaaggaatgtcatccccaggaaataggcaaccatggttggcattttgcagagcatattgaaagaaagtacaccttaaatttcagtatcggatggatatcagcctaaaactataggaccatataaagactgttggtgaaatctgaagtttgagcctttctgatagagagactgaaattaggcaccatttaatgcaaattggtatggaacacacacatatatagattatagactcagaatatgaacattcagacaagactagttttgagataccggttatctaatgtgaatggcctggaagttaataccagaatcactctggatatcatttgtagttttgaaaatctagccagacttattatcattcctaataaattgtgcatagttcttatttcatgttgtggaatgattattctctcgtaattttgagtttaataaaaaataaagtcctgaagaaaatgatctcaaaaagcaggtatttataaagagagttatttatctgggtaaactcactaaaattttagtgagtatttgggtgctcagattttaaaatcaggcaagaattattccagctgaatggtgtttaaatagaataagacttattattttctgggtgtgttttacctaatcctggaatgcatatgataagataggctgtagtctacagtttttgcacctaaaatcattcagactttaacacaatgaagttgccttttcattcttgatgaacatccgttaaattcagagtcacagaacaagataatatcagaaagaagtggccgggtgcggtggctcacgcctgtaattccagcactttgggaggccgaggtgagtggatcatgaggtcaggagatcgagtccatcctggctaacatggcaaagccccttctctactaaaaatataaaaacttagccaggcatggtggcacgcacctgtagtcccagctactcgggaggctgaggcaggaaaatcgcttgaacctgggaggcggaggtggcagtgagctgagatcgtgccactgcactccggcctgggcgacagaatgagacttcatctcaaaaaaaaaagaagttgtatcatttttctgtggggcaaaattaaaagttgtatatattatcacttgggaagactgaggctgggagctaattgttgagtttcctaaaatacaatataaatatttcttatggagccttttaggatatctcaggtgatcagattatgattactaggcaaacgcaaaagtaagttttaaaaacattcttcttcctgtttacaatggaatttaattggtctgataaatcatgtatgtgctatcaattctctttcttattgaaaatgggtcaatacaagtatatgcagttttaactccacaattggacagataaaatgttacatgtaaaatattaaacttaacaaacctaagcatcagtcatttaaaatgcaagtagctggccttgttgaaccattcatattttcctaaatccaacatattctctcatatcactttgcctctatacaagttccttagaatgacctctctcctctttctaatttagctaattcctgctcatctgttaaaactcagctcacccatcacattctccaggcatccttctttatcatccttctgcccatgtcagttattccagtttggatattctctttctgtgtttccataaccttccaggcttttgtctgttataacacttatcctccaatactatgttcatctttttgtttttctgctttaacagagaataccaaatgaatcttttaattttaaattatcagtgtaagcagtgccagatagataataggtgctcaatactaggtgcctaaaaaattaaagttagtagaagaaattttgcagcatatggagtgatgtcagaatgcaagtgattcagtttttgatagactttgatgtgttggaaaggagaaacatcaattgccatcagtgaaaacgtcttattactagtcatctggaacagttcatatttgacgaacctaatgagtatagaagctgcctaaagagccctctatcagatgaaatggacagccctcttcaaccaatgacattgttggtctgagggctagttaacctaaaaaggtataaaataaaagactgttgaggcaagattctgaagcactctatcactatcataattttcccagttaacatatttttagtgcctattctgcatcaggtattgtattagtccattttcacactgctataaagaactacctgaaactgggtaatttatgaagaaaagaggtttaattgactcacagttccacaggcttaacaggaagcatgacacttggaggccttaggtaatttaccatcatggctgaagttgaagggtaagtaaggcccttcttcacgtggtggcaggagacagagagagtgaagggggaagtgccatacactttaaaaccatcagatctcctgagaactcactatacttgaaacagtaacgggaaaatgtgcccctatgatctaatcaccttctacccggcccctcccctgacacatggggattacaattggacatgagattttggtggggacacagagccaaactatatcaggtatccataagcattttttgtacatcatttttatttaatcattacaacttaattgaaataggcattggtatttcatacacactgcagatgagaaaattgagaatttgggaaaataagtaagttgcttaaagtcacacagtaacagaatttaaatgctggtctatctctaatgcccatgatcttcactgttcagctattctgtttccattagatacagcctagattattcattggtgtttcatttccctacttattgtcaccatcagttattttctgactcttccccttcacagcagtgaaccctataactgactgactcctcaagcaccctcttccagtgttaatctagcagcaggactaatttatcaagactggggggaataagaggaaagtttgatcttctcacttgaaactcctactctcaatcctccatttccttctgctaaatattcattatgcagaaaggaacacagaattaaaacaggaggaaatgaaatgggtgggtgacatgatttggctctgtgttcccacccaaatctcatcttgaattgtaatcatccccacatgtcaagggcagggccaggtggagataattgaatcatggaggcagtttccaccatgcgttctcgtgatagtgagtgagttctcacaagatctgatggttttataaggggcttccctcttcactcggcactcattctctctcctgctaccctgtaaagaggtgacttccaccatgattgtgagtttcccgaggcctccccagccatgtggaattgtgagtcaattaaacctcttttctttatggattgattacccagtctcgggtatttctccacagcagtgtgagaatagactaatacaacggagaagagaataaccttaattttgctttttccatccctaatcctaacaccatcaccacacttcttctactgaaacacttacaatgtgattatgtgatgaaaagaaaagagacagagatgagaaaaggaaatcatgtggaaaatatgatggtaaataccatcagcattttttcttccatctctaccagccaaatccccctaactcccaaactcacttatcccttgtataaataaacatttctattgaagtataatacacagtgtacaaatcataaatgtattttaataattttgtacaaaatgaacacatttatagtcaccacccacatcaacaaacagaacagtatcaacacattatgaattgaaattgcattttcctggtgattaataagctgcaacaactcagatatttaatagtcatttgaatattttatttagtgagctgtcttttcaagtcttgcctatttttaaaattgtgttgcctgtcttttattaacttgtaagagtgataaacacacacacacaaacacacacatataacacatatatgttatatgtattgcaaatattttctttcccttatttgtttgcctttgaagagtattgtctttgatgaaaataggatttttaaaattttaatatagttttacataattccatataattttttagttttctgtaatccatgaaatgttaatgtaatccaactcataaatattttttctaatgattagtacattttgtggtctgttgaagaaatctttgctgcaaaattatgaagatattctcttatgttatcttccagaagctatgttttatctcatgtaaattttgatctataatccatctggaactgatttttgagtgtggagtgaattgtgtgttaagaatcattttttcttctgaatatgcaattaactcgttattattttttggaaaagccctcctttctccacagcattgtgtcatctttgccctaagtcaagtgttagtagtggtgacaatctgctgctggactctattttgccctgatttaattgtctatccaagtgccaatgccatactctcttaatttatgtaatgtcttcaaattttgttctttttagaatagcttggctaattgagactctttgcattccattagtcttaaaatctgattgcccatttttacaaaaatataaacaaaacaaaacactttctagaatttttacaggaattgcattaaacacataagccaatttgcagaaaactgaaatctattgaatactgagtcttccaatctaaacacttggtatattagtaacctctcagtttttgtaggtctctttagtgcttctcacaataatttattgatttgcatatttagaacttttatgtattttgtcatttcctacatattttattatgctattttaaatgtgagtttttagttttatttcttattggtggtacatataaatacctttgctttttaaatactgttcctctgtgcaaagacattgcttaagttgtactgcttttagtaatttatctgtatttacgttgggctttttaatgtaaaaacatgtaaaccttaaataaaagttttatttctttattttccatttttgtactttcttccttcctttttccttccttacctccttctccccactttctgtcacttttccatctctcttctccttgttcttcctcttctcttgctctctctttttctctctctgtatctctctccctgtcccttccttctttttcattttttttttgttttttgccatattgtactagtagaaaccttcaaaatgataatgaatacaaatggtaatagggtacattcttatcttattcccagtcccatgatgaaaacttttaatactatagcattaaatataatgtttattgtagatattatttctacaatagacatcatctacaatgattagatatctcttctaatcataattttctaagataatttaattatggtctgtaatcatttccaatgcttttcctgcatcttttgaggtcttcatagaattttcctttttattttgctaatgtgatgaattactttaattttataatattaaagcaaccttgctttctggaataagttcaagttttttgtaatatagtttttaaagtatatacatttgaattttatttgttcgtagttttacaaacattgcattatatttataaaatatattgacttgtaattttcctttcttataatgaactagtcaagttttagtatcaagctttcattagccttaaaaaataattagaaaaattttacttatgttttttagactagtttgcatggatggtactatctttcttaagctgctttgaagaaataactattacattgtctggttcttacatttctttgatattgttgtaaatttttagttccagtttcaatttgttgtaagctctttatagtatttttatattttataataaaatctgtaaaataaatctacctgtttgtttctgatgttagtaattagtacctccttccatatgtaatttcagttgttcatttttatatgtagggtatcagttgactttcgtatattgactttttatcttgtgaaatttcaatgcttacgtattaattccaagatttttttttgttgattctatagaatgcttttccacaggcaatcatgtcttctatgaataaagacagttttatttttttcttctcaactaacatgtatttatttcattttcttgttttattgcactagctatgaccttcactgcaatgttgaatggaagtggcaagaaaggatatc

SEQ ID NO: 103 - DNA, 982 bp, Homo sapiens
atggtgaaagtgaaggccagactaaatggatttggccatagtggtgcctggtcaccagagctccttttaactctggcaaagtgaatattgttgccatcactgacccttcagtgaccttcactacacggcctaaatgttccagcacgattccacccatggcaagttctagggcactgtcaaggctgagaactggaaacctgtcatcattggaaatcccatcaccctcttacagttgcaagatttcaccaaaattaaatggggtgatttgggcgctgattatgttgtggaatctaccagcatcttcactaccatgaagaaggctgaggttcacttaaagcagggaaccaaaaggatcctcgtctctgcccattctgctgatacccccatgtgatgggcatgaaccatgagaagtacaaaaatggcattaagatggtcagcaatgcctcctgcactatcaactgcttagccaccctggacaactgtggcatcatggagggactcatgaccacagttcatgccatcactggcactcagaagaccatggatggcccctctgggatactgtggtgtgacagctgtggggctctctagaacatcatccctgcctctgtgttgccgaagctgtgtgcaaggtcatccctgatctataggaagcttactggcataactttccatgttcccactgccaatgtgttggttgtggacctgatgtgccatctggagaaacttgccaaatatgatgacataaagaagatggtaaaacaggcattggagggtcccttcaaaggcattctggactacactgagcaacaggttgtctcctccaactttactagtgatactcattccttcacctttgatgctggggctggcactgccttcaacaaccactttttcaaactcattttctgatacgacaatgaatttggctacagcaacagggtggtggaactcatgttccacccggcttccaaggggtaag

SEQ ID NO: 104 - DNA, 875 bp, Homo sapiens
gatggaagatttgatggacatggacataaacccccggaggccctggaactatctatttggttgtgaactacaggctgacaaagattatcactttaaggtggataatgatgaaaatgagcactagttatctttaagaacggtcagtttaggggctgatggaaaagatgaattacacatcgttgaagcagaggcagtgtattacaaaggcagtccaattaaagtaacactggcaactttgaaaatgtctgtacagccaacaattttccttaggggctttgaaataacaccaccagtggtcttacggttgaagtgtggttcagggccagtgcatattagtgaacaacatttagtagcagtggaggaagatgcagtcagtagatgaagaggaggaggatgtgaaactcttaagtatatctggaaagtggtctgtccctggaggtggtagcaaggttccacagaaaaaagtaaaacttgctactgatgaagatgatgatgatgatgataatgatgaagatggtgataatgatgattttgataataaggaaactgaagaaaaatcaccagtgaagaaatctatatgagatactccagccaaaaatgcacaaaagccaaatcagaatggaaaagactcaaaaccatcatcaataccaagatcaaacgggtaagaatccttcaaaaaacaggaaaaatctcctaaaacaccaaaaggacctagttctgtagaagacattaaagcaaaaatgcaagcaagtatagaaaaaggtggttctcttcccaaagtggaagccaagttcatcaattatatgaagaattgcttccggatgactgaccaggaggctattcaagatctctggcagttgaggaagtctctttaa

SEQ ID NO: 105 - DNA, 288 bp, Homo sapiens
gaagggaacgccatcgtttgaaaagtgttgcagtaagacgcacacattgtgccaccactgtggctctaaggcctgccaccttcagaagtcatcctgtggcaaatgtggctaccctgctaagtgcaagaggaagtataactgaagtgccaaggcttaaagatgaaataataccaggactggtcgaatgaggcacctgaatattgtataccgcagattcaggcgtggattctgagaaggaacaacatctaaacccaagagggcagctgttgtagcatccagtttatctta

SEQ ID NO: 106 - DNA, 982 bp, Homo sapiens
catggtgaaagtgaaggccagactaaatggatttggccatagtggtgcctggtcaccagagctccttttaactctggcaaagtgaatattgttgccatcactgacccttcagtgaccttcactacacggcctaaatgttccagcacgattccacccatggcaagttctagggcactgtcaaggctgagaactggaaacctgtcatcattggaaatcccatcaccctcttacagttgcaagatttcaccaaaattaaatggggtgatttgggcgctgattatgttgtggaatctaccagcatcttcactaccatgaagaaggctgaggttcacttaaagcagggaaccaaaaggatcctcgtctctgcccattctgctgatacccccatgtgatgggcatgaaccatgagaagtacaaaaatggcattaagatggtcagcaatgcctcctgcactatcaactgcttagccaccctggacaactgtggcatcatggagggactcatgaccacagttcatgccatcactggcactcagaagaccatggatggcccctctgggatactgtggtgtgacagctgtggggctctctagaacatcatccctgcctctgtgttgccgaagctgtgtgcaaggtcatccctgatctataggaagcttactggcataactttccatgttcccactgccaatgtgttggttgtggacctgatgtgccatctggagaaacttgccaaatatgatgacataaagaagatggtaaaacaggcattggagggtcccttcaaaggcattctggactacactgagcaacaggttgtctcctccaactttactagtgatactcattccttcacctttgatgctggggctggcactgccttcaacaaccactttttcaaactcattttctgatacgacaatgaatttggctacagcaacagggtggtggaactcatgttccacccggcttccaaggggtaa

SEQ ID NO: 107 - DNA, 875 bp, Homo sapiens
atggaagatttgatggacatggacataaacccccggaggccctggaactatctatttggttgtgaactacaggctgacaaagattatcactttaaggtggataatgatgaaaatgagcactagttatctttaagaacggtcagtttaggggctgatggaaaagatgaattacacatcgttgaagcagaggcagtgtattacaaaggcagtccaattaaagtaacactggcaactttgaaaatgtctgtacagccaacaattttccttaggggctttgaaataacaccaccagtggtcttacggttgaagtgtggttcagggccagtgcatattagtgaacaacatttagtagcagtggaggaagatgcagtcagtagatgaagaggaggaggatgtgaaactcttaagtatatctggaaagtggtctgtccctggaggtggtagcaaggttccacagaaaaaagtaaaacttgctactgatgaagatgatgatgatgatgataatgatgaagatggtgataatgatgattttgataataaggaaactgaagaaaaatcaccagtgaagaaatctatatgagatactccagccaaaaatgcacaaaagccaaatcagaatggaaaagactcaaaaccatcatcaataccaagatcaaacgggtaagaatccttcaaaaaacaggaaaaatctcctaaaacaccaaaaggacctagttctgtagaagacattaaagcaaaaatgcaagcaagtatagaaaaaggtggttctcttcccaaagtggaagccaagttcatcaattatatgaagaattgcttccggatgactgaccaggaggctattcaagatctctggcagttgaggaagtctctttaag

SEQ ID NO: 108 - DNA, 288 bp, Homo sapiens
aagggaacgccatcgtttgaaaagtgttgcagtaagacgcacacattgtgccaccactgtggctctaaggcctgccaccttcagaagtcatcctgtggcaaatgtggctaccctgctaagtgcaagaggaagtataactgaagtgccaaggcttaaagatgaaataataccaggactggtcgaatgaggcacctgaatattgtataccgcagattcaggcgtggattctgagaaggaacaacatctaaacccaagagggcagctgttgtagcatccagtttatcttaa

SEQ ID NO: 109 - DNA, 1427 bp, Homo sapiens
gatggctaaaggtgaccccaagaaaccacagggcaagatgtctgcttatgccttctctgtgcagacatgctgcagtgggataattaaggaatcagaaagactgaggggttgaggaggaattatttaattatttaggtgcaccgacccagtcggattaacatccaaaggactgagccatgaacaaagagtcaagctaccttttaagcattttgtggggcggtgggagatctgtgcagggggaagcatattacagaagcaagaaacaaagacagttatttaattaagacatgcattacatcatttcttactttccaaggaacaacatgttttacgacttgagattatctgcctagtgaccttgcagctacacagctagagaaacagagtcttcacaatgcctgggaaagggagagataaggctcactagccacagaaaaacaggcagtcaatttttaaaggacttcagctttttttctttctcagggagaattgggttttcttacatacaactgagtttttgcttacacattctttaatttcttttttttttcttttgagacggagtttcgctcttgttgcccaggctagagtgcaaaggtgcgatctcggctcacagcaacctccgcctcccaggttcaagccattctcctgcctcagcctctggagtagctgggattacaggcatgcaccaccacacctggctaattttttgtatttttagtagagacagggtttctctatgttggtcaggctggtcttgaactctggacctcaggtgatccgcctgccttggcctcccaaattactgggattacaggcgtgagccactgcgcccggcctctttaatttcttttaattcctgttccaatgcagagaagaacataagaagaaaaacccagaagtccctgtcaattttgcagaattttccaagaaatgctctgggaggtggaagacaatgtccagtaaagagaaatttaaatttggtgaaatggcaaaggcggatgaagtgtgctatgatcgggaaatgaaggattatggaccagctaagggaggcaagaagaaggatcctaatgcccccaaaaggccaccatctggattcttcctgttctgttcagaattccgccccaagatcaaatccacaaaccccggcatctctattggagacgtggcaaaaaagttgggtgagatgtggaataacttaaatgacagtgaaaagcagccttacgtcactaaggcggcaaagctgaaggagaagtatgagaaggatgttgttgactgtaagttgaaaggaaagttttatggcgcaaagcgtcctgctaaagttgcccggaaaaaggtggaagaggaagatgaagaagacgaggaggaagaagagaaggagaaggacgaggaggatgaacaaagaaactgtttatctgtctccttgt

SEQ ID NO: 110 - DNA, 2049 bp, Homo sapiens
ggctcccggaagcggcacgggaggcgaccgtgctcgccgttggcaggctagggttggcggcggcgtattctgtttgttttaaacgaaggagcggagggaggggccgcgccgcggagcgtgcctaaggtgaaagggctgccgtgcagccaggcagaggcgaggaaggcttctccatcgtcgccaccgcccgcctgtttcgccggcaacaggttcccccgggacgggaggggccgcagcgccgcgcagctcgcagcgctgaacgtcgcggaaatcccttggccggccgagcctccgcagccgcgacccggcttctctccgtccgagtcccccgagcctctccgaacccccgttggacttcccctccctggccggcgccgcccgacccgctcccccatcctagagggaattccctgcgccgcggctgtgaggcacctccaccccggcctgaaatgcaccgcagtcctgaaggaaatccaccctcatcccacgcagattcacccgcaacgctgcctgaatacgcctcgctgcccacagaaattcctgcccaaaccagacgcgtggaccacccaagacgaaattcacactcgaccctagccccgccagcccttgccgaaatcaccctaaacccgttgaaattaattcccagctgtccgaattttccttccaacattaactgactacctgtctccgccaagctgactgaactctaccgaactcttaccctgaaagcccctgagagtccaaaatatatttttccagcccgaaatctaaatcccagttctctgtatgaaaacctccagaaacccagactcttacttccttcggccacggactcgttcgaacatcgtggacatcaccttcccacatttttaccgcagtctttggctccgattctttgtccctgcctcttgggcagcatcctatccctgtttctttccacctttgaggattcctctacctctttaaaggcctgctttctttgctttctcttctcacctttggcattggcacactggggtcatatctttagttcccttgactccaccatctaagccaagggtgtccaatcttttggcttccctgggctacattggaaggagaaaaattgtcttggaccacatataaaatattctaacgctaatggtagctgatgaaacttttaaaaaatctcatcatgttttaagaagtttacgaatttgtgctgagccgcattcaaagccgtcctgggcctaagtccttgctatttttcctcttcaatttccttcaatccatagttctctaggttattttcccaccctttcccaagattcggatatcccttcattcttgctgagttcatctcctatgcctattcctacatacttgctgagttcatcttctaatgtcctcatcctggtttcttcctgaacctgaaatccagctaaccttactttttcatcccatcaaacccctgctgttgccagcccagcactcacgaagatctttacatacaccaaatattaaattagggccggtacctagacattgtctctgcactctgctggcatattttcccctggaccacgaacccttcgtacctagtaacttgccacctgtgtttataaataccagcaatttgatttacagggtgaatttgtcactattgtttacttttaaatgaagttactgtatttgttgtttccattaaaggcgacattataaagcctaggcctcatatccaaagcaaataaagtctcaattttttaattaaaagtaacaaaaggaaacctcacacttctgaacaacaatgacaagaaggaatgcctataattggtttgggtcacaatgtacatattgaaataaaatttttattaagtatcaacttccaggtacacaatgaagttttaaatgtttatctgtgacatatgaagaacaaagcaatctaaactgatgtaagcaggctgtcataaggtacatgctgaggaatttattcaacaaattgaataaatttattcaataaataaataattattcaataaataatatatttaataaatttaataaatagaa

SEQ ID NO: 111 - DNA, 16318 bp, Homo sapiens
gtgactgaaaaggcagagtgtcatttgaggatgcgagtagtataatcatacttttttgcatggaagaaagcaagtgagtactttaaactgtggaattgggatagcaggggtggggcctatgatatgaatattcatacttttcatttacatttttatttttattgcagtaaaatctagaaaatgttgagaggatttttaaaaatttaaattacattcaattcccatacatctttctctagaaaggttctaaaggaaaagaaaaaaatagctacatagagaagtaaggtatgatgaactatcttgaagactgagggttttctactgttaataagtaagttttcaaattatagattgaatatctactttgagccaggctgaggactagggagacaattgtgagaaaaacattacacaatttctacccctttggatcttactgtctataataaagggaaatagacaaataatagtcataaagcatgatagacgctttgatgggggaatttcaggatataaggggcaaatttctgccctctgtgggggtaattaccaagtctaggaaaactgaaaattttcccagagaagacgacgttcaaactataatctgacgtaaggttggaaagccaggaaaaggaatatgaaatgaagggagaaagttccaaagaacgggaacaacatgtgcaaaggtcctgttgtgggtgagaataaagcaatttggaggaattaaaagccagtggagtatagaattctagagagatatggattgagcattcctaacctgaaatctgaaatgctccaaaatctgaaaaaaaaaagtattttcttattcttttttgtcttcttattaagagatggggtttcaccatgttgctcaggctggtctcaaactcctgagctcaagtgatcttctcacctcggcctcccaaagtgctgggataacaggcatgtgtgagccactgcacccagcccaaaatttgaattttttttttttttttttttggagacagagtctcactctgtcacccaggctggagtgcagtggcaccatctcggctcactgcaacctctgctgcaggttcaagcaattctcctgtctcagcctcctgagtagctgggattacaggcatctgccaccatgtccaactaatttttgtatttttagtagaggcgaggtttcaccatgttggccaggctggtctcaagctcctgacctcaagtgatctgcctcccttggcctaccaaaatgctgagattacaggtgtgagccaccatgcccagcccccaaaatttgaaaacttgagtggtgacgtgatgccacaagtggagaactctgcacttgacttcatgtgatggattgcagacaaaacatgggtagaaactgaaagcctgccattgtttgttattgttgttgtttaacagctaatataggtattctggggatgatactgccctatttaggtaccctgaacacattattttttcactgtattaagggtatgccatactttttactgttaagtacttaagtgtgaatggtataagaaaaaaattgcttatgggtagcatatatattcagagacaggaatgatgatgatgccagacaatcacagattgtccatatcagtagctcacatggtgacacctctgctttctgatggttcaatgtatacaaactttgtttcatgcataaaattaaaaatttgtattaggtcggtgcaaaagtaattgaggttttgcctttaaaagcaatggcaaaaacttcaattacttttgcatcgacctagtataaaattatcttcaggcagggagtgatagctcacacctgtaattccagcagtttgaaaggccaaggcaggcagatcacctgaggtcaggacttcgagacaaccctggccagtatggtgaaaccttgtctctgctaaaaatacaaaaaattagccaggcatggtggtgggcgcctgtaatcccagctatttgggaggctgaggtaggagaatcgcttgaacccaggagatggaagttgcagtgagctaagattgcaccattgcactccagcctgagcaacaagagtgaaactccatctgaaaaaaaaaaaattagctgggcgtggtggcatacacttgtgagctcagctacacgggagctgaggcaggataattgcttgaacccaggaggtgaaggttgcagtgagctgagattgctccactgtactccagcctgggcgacagagggagactccgtctcaatcaatcaatcaatcaatcagtcaatacaattatcttcagcttaggtgtataaggtgtgtttaaaggctgggcgcagtggctcatgcctgtaatcccagcactttgggaggccaagacaggtggatcacaaggtcagcagatcaagaccatcctggctaacatggtgaaaccccgtctctactaaaaataccaaaaaaaaattagccaacatggtggcacgcacctgtagtcccagctactcgagaggctgaggcaggagaatcgcttgaacctggaaggcggaggttgcagtgagccaagatcacgccactgcactccatcctgggcgacagagtgagactctgtctaagaaataaataagtaaataaataaaaataagatttgtataaaacaaatgacttttgtgtttatacttgggtctcattcctaaggtatctcattctgtatactcaaatattccaaaatccaaaaatgtccaaaatctgaaaaacttgtggtcccaaacatttcagatgagagatactcaacatgtagtagtgagaaaagaagctaggaaggtggacagacaccagttccaagagggccgctcaaactgtaataaggaaattgaactttattctgagggaatgagaagtcacagtaacatttatgcagaggacggaagtgatgctacttaaactgtagaaagatcaacctaactgcagtttggagaatggtttagaagggaggaaaagtgaaggtggagaacccagtaaggagacaaaaccaattagccttcctaggtaaccactttggaatgaaaagttgaatgaaaagttgagttttgttttcttatgcagtgtacaatttttgtcttttgtcttgccttgaagcagttttagtgtgatatgtctagatgtggctttctttatatttatcttaatggagtttgtagaatttgttgaatatgtgttttgaggtctttcattagcttggaaaattcttggtcattatttcttcatctattgcttttgtttcattgtcgctctcttctccttctgggacattaattacataaatgtgagaccttttcaccaaatcacatttgtctcctatgtttgtttttttattttataatttttttttgagacagggtttcacactgttgcccaggctggagtgcagtggtgtgatcctagttctctgcagcctcaatctcctgggctcaaacaatcctgtcacctcagcctcccaagtagttgggaatagagacatgagctacctgcctggctaatttgtaaaattttttttgtagagacagggtctcactatgttgtccaggctggtcccaaatctcctgggctcaagtgatcctcctgccttggcctcctaaagtgttatattcttctgtctcttcatgctaatctcaatatgttcttctgcctctcttctcattcacagattctccctcagctatatctaatcttctgttttttttttgtttttgtttttgtttttgtttttgagatggagtcttgccctgtcacccaggctggagtgcaatggcgtgatcttggctcactgcaacctccgcctcctgggttcatgccattctcctgcctcagcctcccgagtagctggggctacaggtgcctgccaccacacctggctaattttttgtatttttagtagagacggggtttcaccgtgttagccaggatggtcttgatctcctaacctcatgatccgcccgccttggcctcccaaagtgctggaattacagatgtgagccaccgcgcctggcctaatctgctgttaagtctacttattgtgttcttaattttagttattgtatatatttctataaattcacttcaattttttatgagttccacatctgtgctgaaactatcttgtcatttaatttctcgaacatattaatcacaactgttttatagtttgtgtctgataacttccatacctggatctcttgtgggtctgtttctattgtctgattttttctcttgattatcagtcacttcttatatttttatcagcatagttttttgaaatggaaaattgtgttttaaaaactatagagatgacctgaggttctagttgatatgttatttaagggaggattcactttagtttcaacaagcggttgggaatacatataataagcaacttaagtcctgctgtgcctcctcactggccacgctccttccaggcaccagcttctctgagccaccaacctgcggctgccctggcccacctgcgcctctggcagcaccatgacagatcaggtctttgtgacactgaccacaaatgatgcctacaccaaaggtgccctggtcctgggctcatctctgaaacagcacaggaccaccagaagactagtcatgctcgccaccccgcaggtctcagactccatgagaaaagttttagagacagtctttgatgaaatcatcgtggtagatgtcttggacagtggtgattctgctcatctaaccttaatgaagaggccagagttgggtgtcaggctgacaaagctccactgctggtcacttacatagtattcaaaatgtgtattcatgggtgcagatactctggtcctagcaaatattgatgatctttttgagacagaagaattgtcagcagcacctgacccagggtggcctgactgcttcaattctgaatttatcagccttcagttgaaacatataatcagctgttgcatcttgcttctgagcaaggtagttttgatggtggagaacaaggcatacggaacacattttttcgcagctgggcaacaacagatatcagaaaacacctgccatttatttatagcctaagctgcatctctatatagtcctacctcccagcatttaaagtgtttggtgcaagtgccaaagttgtgcatttcctgggacaagtcaaaccatggaattatacttatgatcccaaaacaaaaagtgtcaaaaatgagtcccaccatcccaacgtgactcatccagagtttctcatcctatggtggaacatctttaccaccaccgttttacctctgcttcaacaatttggccttgtcaaagacaccttctcatacgtaaatgtggaaaatgtctcaggagccatatcacatctgtcccttggggggatcccagctatggcacagtctgtgtatcctcagaagaatggaaggagcggtgggaacagggctagaccgattatatgggagcagattcctttgacaacatcaagaggaagcttgacacttacctccagtagaaacactgcattttcctgtggacacatccacttcacaagccttgtttctgatacttagtatctagagctgggttgagaaaagtctgttatggttgctagagattttcacaaaaacttatcagatgagaggtttttgtaggacaacaggtgagaactgggcaaaagttgtgaagcagcaattccgttgttacatggacagtgttttgctttttaatcctgtttagcttgtttcagaaattctcacttttgttgactgccaacatacaaagtaggggaaactcaatattaagctgttaagatggctgcatcaattcttaaaatctgcagagcctggttccaaatcagtcactcccttcagaagcagacatggcatctgatccttgcttgcttgctggttgtacctacctttcactagacctgcattttggaattgcccagtgctgccagagtgagtgattgtaattctgttttcaggtaaagatagcttatattaacactgctgagtgattcataaacgtatcaacaaatagcattaacccattttatttcctggtcttagtgtctgaagatgttcaccagttttctatgtacagtaaggcagcatgctaaaatgcttttgttcagtctgtatatttgaaaatagcaaggtgttctctgatggttacctgcagtggaaccctgtatgaaaaataaagacttactgccataaaaaataaaaaataagcaaactttgggaggccaaggtgggtggatcacaaggtcaggagttcgagaccagcctggcaaatatggtaacaccctgtctctaatacaaaaatcagccgggcgtggtggcgcacgcctgtattcccagctactcggaatctgggaggcagaggttgcagtgagctgacatcgtgccactgcactccagcttgggcaacacataagactccgcctcaaaaaaaaaaaaaaaaaaagcaacttaattcaatcagggattaggagggtttctgtgggtttctggacctcagtctttgtgagggctagtctatttttggcccatcttacttgtaggattctttagggttcccaactggtttagttgttcattgctgtatctcaaaccacttcaatatttgtggcttaaaacaatagtgatttctggcaattatctgggtcgactgaacagttcttcatttggtattggctgggatcattcgtaaagctgcattcagctgggcacttggctggggcattttagtaagttttcacatggcatctctatacaatattccatccccgagggcctctccacatggcctatttctccactgggataaccttgacttaagcatggaggctagattctaacagggagaaatccaaaagtacaagtcccagtgagcaagttcatatttaatctttgtttgtttcacctttactaatgtactattgataaaaacaaatcacataagccagatgcagtggtgtacacctgtactctcacctactcaggaggctgagacaggagggttgcttgaggccaggagattgaggagggagtgtgctatgatcacacctgtgaatactgcactccagcctgggcaatgtagccagacccccatctctcaagacacaaacaaaagaaaacaaattatatggctaagcccgaaaccaatgtgaagaggaccacccataggcataaatcctggaaggtttggttcactagcagccagctatgtaacatattaccatatcaaatgaaatcctatggtgcttaccagagtacctcctctttaatggctcctgatctccaattcttgtcatctcagccctgtaagctctcttcagcttttgggcttctcagttgctgattaggaatcagcaaaaacattaaaggaaaagcaataccaaatgatgggttcacctctctgtacttcctttctctttgggattggtcctttgagttcacgttttcttagaaactttccagtgccttcaaactggtatttcctgtattcttcccagcttttctagttgttctcagtaggagggatggtcttaagcaagctgatctgtattgctggctcacagtggccaggggagtagaaagagctcaaagagaagtgactggttgggtcccaggacttctagtctcagaaaatccctcagtctctagcagggcagggcagaggagccccagaaccacctttcctcaaagtactttagcctatgcaagcttagactgttgtcctttcactgttaaccagtattaaccagttaaccagttcttctgcagacaaaagcatcaggaagtacccaccatgtaccagtgggcccttcttgatgctcttgattgcagaggagccctgcaacctgaataaatcctcctggaaggtaagtgggggagccctaattaaaactgtaattcaatgtctcgatattttggcaaatgaaggttcaggtgagttttaattagtttcagaaaaagcaaagtaaaatgatatttaatgtactggattttgatggatacaaatctatatccattatatactatatgtttgttttttctaaaaaaaaaaaaaaaaaaaaaaaaggcaaccagaaaattgtcatcaatgttcataccttgaatactctaattgagtattgactttttttggtaacagctttcttgagatgtataatttacataccatacaatttacccatttaaaatgtacgattctagttttcaatgcattcacagatatgtgcaactatcactgttggcaatttcagaacattttcatcacctaaaaggaaactctgtagcctttagctatcactctcccatttccctgtttcccccaacgcccccagagataagcaaccactaatctacttttggtctctatagatttgcctactctagaaaattcatataaatggaatcttatgtgatcttttgagtctgcttctttcacttagcatacctttacaagatttattcatgttgtagcatgcattagtacatcattccattttatggctgaatagtattccattatatggatattttgtttatctattcatgatggacatttgagttgtttccaacttttgggtattatgaatgatgctataaacatttaagtaaaagtttttgtgtagatatatgttttcatttctcttggacataaacctaggacttggattgcgggtcaaatgttaattctatatttaattttttgaggaactgccaaattgttttccaattttatattcccaccagctgtgtatgagggttttgatttctacacatcttctctaatacttagtaataagtattaagtatctgactttttttttttttgagatggagttttgctcttgttgcccaggctggagtgcaatggtgtgatcttggctcactgtgacctctgcctccagggttcaagtgattctcctgctttagcctcctgagtagctgggattacaggtgcctgccaccacgcctggctaattttgtatttttagtagaggtggggtttctccatattgttcaggctggtctcgaactcccaacttcaggtcatccgcccgcctcagcctcccaaaatactaggattacaggtgtgagccactgtgcccggtgtttgtattttttttttttttttttagtagaggcggggtttcaccgtgttggtcaggctggtctcgaactcctgacctcaagtgatttaccctccttggcctcccaaagtgctgggattacaggcatgagccaccacacccggtcaagtcttgtccttcttcaggacatttgtttctaaatattttaccttttggtgctattataaatggaattgttctcttaatttcacttttgaattgttcattgcaagtgtataaacatacaattgaattttatgtattgattttgtaacctgcaaccttgctgaatttgtttattatttataatagtttttgtgaattccttaggatttttaatacgcaagatcatgttgttatcttgtatattaatgatatataagataatatatctttccaatctggttgtcttttatttatttttcttgcctaattgccctgactagaacctccagtagagtgtagaatggaggtggtaagagcagccatccatgtcttgctactgatcttatggggaaaatacccggtctttcaccattgagaatgatgttagctgtgggtttttcatggatgcctgtatcaagttgagagaggtctcttttgttctttttttccttattattatttttttatcatgaaaggtattggatctttgtctccaaatgctttttcttcatctattgagataatcatgtcattaaaagaattctgttgatatgatgtgttgcattaattgattttcagatattaaaccaaccttgcattcctggagtaaatcccacttggtcgaggtgtataattcattatatatggtactgggattcagcttgctaatgttttcttttaaagcatagtggccaggcacggtggctcacgcctgtaatcccagcactttggtaggccgaggcgggcggattatgaggtcaggagatcaagaccatcctggctaacatggtgaaaccccatctctactaaaaatacaaaaaattagccaggcatggtggcaggcgcctgtagtcccagctactcaggaggctgaggtaggagaatggcgtgaacccgggaggcagaggttgcagtgcgctgagactacgccactgcactccagcctgggcggcagagtgagactctgtcttaaaataaaaaaacagaaaaacgataatattggggaaagagagcaattagttttatttttttaattttttattatttacttcattttatcatttttttttgagatggagtctcgctctgttgccaggctggagtgcagtggcatgatctttgctcactgcaacctccgcctcctgggttcaagtgattctcatgcctcagcctcccaagtagctgggattataggcacgtgccaccccaaccacctaatttttgtatttttagtagagatgaggttttaccatgtttgccaggatggtctcgatctcctggcctcatgatctgcccaccttggcctcccaaagtgctgggattacgggcatgagccaccgcacccaacctattttttttttttttttttgagatggagtctcattcactgtcgcccaggctggaatgcagtgttgtgatctcggctcactgcaacctccacctcctgggttcaagtgattcccctgcctcagcctcccaagcagctgggattacaggtgcatgccaccatgcctggctaatttttgtattttttgtagagacagggtttctccatgttggccaggctggtctcgaacttctgacctcaagtgatctgtccccgctccttggcctcccaaggtgctgggattacaggtgtgagccaccgtgtctggccaagagcaattacttttataggaatctaggttctgagtctgtgctgggaaaaaaaaaaaagtcagtatggtcaatggagaaagcttgaagaaaaataattcttaagtttccctgtcccttagtaaagacagtatattcctcaatggagagtcatttgaaatttaatgtggtattgtccttcacttaagaaataatgtgattgataatctgactgatctaatgacaacccaacattagcttttagctatttttccagcagcagcagcaatgagttgttctcagcccccatcactaaggcagacctatttcctgggcactgcaaattggttccactgcctccactttggaatacattttacttatagtagttgagctggattcatacctgatagtccatagcattaaaaaatgcatgatattggattgtcaaatagagaggagacatgggagttaagaccaaggttttgactaccaaacccaggacttttccttgattcattaggcaataggcaaccattaaatgttttgagtcagggaataccatgattgaagctgtactttaagaagattaaactggcattagtgcattggatataaaagatcaaataaacagctgggtgatgagaatgaaaagcagcttgcagaagtaaggtaaattctgcaggagctggtaattagatttgatgatcaagggaaagggaagactactagattttaagactgggtaattgaaacaatactggtggtattttctgaagtcagagttcgactagaaggaaaggtgatggctttggccttagatgagttgagatttaactaggaaagtttgcctgcagacttccacaatcatatcccatgcaaacaattggaaacaaaacagccaaagctaataagcatttacaaggaaaggacactggggctatttaatttagaaagtgaaaaaaatttagcaaaaaaagagaaaggtgaaaggatctatttatttctctgatgacctagttcctagcctttaactcagcatactgacctacccgtgacactatatgccaggtgaagcaagcaaagcttgttttgggagaagtgccccaagcacacactgtcctttttgagatggagtttcactcttgtcacccaggctggaatgcaatggtgcgatcttggctcactgcaacctctgcctcccaggttcaagcgattctcctgtctcagcctcccaagtagctgggattaaaggcgcctgccaccatgcctgcctggatcattttgtatttttagtagagataagggttcaccatgttggccacgctggccttgaactcttgacctcaggtgatccacccgccttggtctccaaagtgctgggattacaggcgtgagccaccaggcgcccagcccacaccatccatttttaccccattgatcctcattttcatctccctgctcctggatagctggttccatattccagctttccatattgcttttgatctgcattgtggtctcttctggctattggatacctctttccatgggctcttagaatgctcagatttcagcaattgcatagtttctagcagaagacttcctctgccagtccagcccctcaaaaccctcctgctcagattggccccagaatctctgccaggagatggagattggggcagtttatcttaatttgattagcaggtttagcttctgcaaagcacattcttacaaggaatatttgagaatatgtagtcataatgtaacagcttgcagttctctttcttattctataactgattgaaaattctaataagaaatatgtgtaccttgatggcaatgttgaaactcagttgtttagaaagatggactcccctatatttagctgaaaaatcagggtttgaggcttttagttccctctgaaaccatgaggacttagcccttgagatccagtttaattctaacatgatttagaagtctgtttcatttccctgatgttgagtcaccaggctggattaattttccagggtgttgtgctaattataggttagtggaggaatgggctaaaccaaaatggcaacaagcgaaaaagtagcaggttactctgagtgctgctggagtgtaaagctatttataacatcacaattgaatggctactattaattaataagcatcgcagtgaccttcaattttcaaagacgttcaccatcattttctagttaatctttcccatccattactgcattcgttttatatgaagggcagagctgatgaattacttgcctgaagtcatgtctgtggttaagccaaaattacactttaaacagatgaataataataaaaataatatatttgtggagtgtttttcaattttcaaaggatcttttccttcgttattttatgactctttattcttcatgcttactaagcatccctatgaaggttttctgctggttagctcaggatagcagaagagaggagggttcagtttatgggtatcttggttaaatttgaactgaataggaacataagaaacacaacattcaggagtttagaggtctgagttgtatgatctttgttcctcatcacctttttttgttaggttttcttggcctttgaggacccatagagcaaacattcagtcacattaagtctttgtttttcaaggctttgattttgttccattcaaacctaaaatgtatgaatccgcagaatttgatgtcaaaagaagcctcaatttaagaaagtttggttaatccaaagattacttacattagaatactggaatacaatctccaaatagcttagctgatcctggtgtctgctctgaaccttcatgctgtataccatttctgctccctttttctcactcaacacctgggcttttcttgacccttatagacccaggatgtccatacagtacagttgatcctcccagaaccttctatactcccacaagcaaagaaacacatagttgcatggatgcttaaaaggtcatagagtctaacattgtcatcttacaaataaaggaactgaggctcagggagtagaagtgacttttccaagtcttatagtaattgccagcgctggtgtaaaagctgtcagacttttgctcctgtagaaaaggaactgaaaggcatcagaaagtcaaactctcactgcagcaatatttaccgtagcacaactactgagttagccacatatatcatagagcagttcccaagatgttcacggatgttctttgacatagggttttgtggtcatattactttgtgtagttgggaattcatgatgcagagttgaagattggaaactctggaaagtctcttaggaaggattttgttaagcatttctcaaatcatttcttcgttattttcttcccaaagaaaatctagtaacagctcgtgtaattagtgttcattggtgatagtgacactttgatgaacaaatacatggtgtctgttaaagcagataccaagcagtcacaagcaggctgaactgttgagttctttgttgcaggttattttatcttcacaacatcttaggattaggtattactattcctactttacagatgggctttggacttgttgcatgtgacagaaattgagctcaaacttgcttcaaaggaaaggagtgttattagttcctggaactgagaagcttggaacattgaaaccaacaacgttctttctcctatctgtgcttctgtctttgtcaagtctattcatcccttttacagacagatgtcctcacaagaatgaggatatggctgtgcacagcttagattcactccgtaacactgcagctagagacgaaaggactactgccagccccacttaaccagatcctggagagggactctggccagcaaggccagcccctctgctgtctgtctctgtggaggaaaatgggtaccattgttaaccgaaaggggtcctgatccagactccaagagagggtttgagaacgaattcagggtgagtccatagagtaaagtgaaagcaagtttattagggaaataaagaaacaaaagaatggctattccataggcagagcatccctgagggctgctggttggctatttttactgttatttcttgattatatgctaaacaaggggtggattattcatgagtttcctggaaaagggaagaaccccagaactgagggttctactccctttcagaccatatagggtaacttccagatgttgccatggcatttgtaaactgtcatgatgctggcgtgtgtcttttagcatgctaatgcattataattagcatataatgagcaatgaggaattttgtcaccactttggttttggtggggtttagctgtcttcccctgccccccacccccccaatccagttttatccgcagggtctttgtgatctgtatcttgtgctgacctcttatcttatcttgtgacttaagaatgcctaacctccttggaatgcagcccagtaggtctcagccttattttacccagcccctattcaagatggagtcgctctggtttgaatgcttctgacgccgtgattggtttagactcaatctcacactctctttgtggcataggagatgtgttttcagaaatccagaaaggagcttagacaaaacagtagtctcagggaacatagctagttaagtgatggaactgagatttgaagtcagatctgtctgactccaaagtccatgttttttttgtttgttttctctgtggtttgttgtttctatgatgtggcttctgtcaccctgactctccttttgtcttttgtccctcaccaccttctgtagtttcccagtcctcctgactcataccagggaagcctcctgtgtccatatacaatgaaggctcagggacttctaactcctggtggactggctgattgagccctggaagtgtactttctccttcatttccctcctgactctcgctgggagagttgtagactcctgggaaacacaggtctatggcctgcctaagagaggaccagcccacaccaaagaaagtgccactgcctcctcctcctcagtggatgccaccaagccccgaggaggacaaccttttccttaatctccttgaaacccaggcaaactttgacaaaaggaaaggtgtttccagtgtgttgttaactgaaccttggttgcttggcagtatgcagttcttgtctaatttaccccaaggaaatgtctgtgtgatgtatttttaatttgctgaagaaggataagtgttcaaacctttgtacatttatgctgaaattaatttttcaaagtccacataacttcagtgctgtgggatagtccttaagaacagaaattatgaccaaccataataaatgacacatttttgtgaaatgtca

SEQ ID NO: 112 - DNA, 20 bp, Artificial sequence
  Synthetic oligonucleotide
caggcccacagcaggctcaa

SEQ ID NO: 113 - DNA, 20 bp, Artificial sequence
  Synthetic oligonucleotide
tggagctgatgggctttttg

SEQ ID NO: 114 - DNA, 20 bp, Artificial sequence
  Synthetic oligonucleotide
caggatctctgatgtgcagg

SEQ ID NO: 115 - DNA, 20 bp, Artificial sequence
  Synthetic oligonucleotide
gggatgagctcagccggatc

SEQ ID NO: 116 - DNA, 20 bp, Artificial sequence
  Synthetic oligonucleotide
tatcagggtaggtatcacat

SEQ ID NO: 117 - DNA, 20 bp, Artificial sequence
  Synthetic oligonucleotide
taaagatattgtcccgttgg

SEQ ID NO: 118 - DNA, 20 bp, Artificial sequence
  Synthetic oligonucleotide
ttaccaattgagcgacatct

SEQ ID NO: 119 - DNA, 20 bp, Artificial sequence
  Synthetic oligonucleotide
cccacaggagttagggctgc

SEQ ID NO: 120 - DNA, 20 bp, Artificial sequence
  Synthetic oligonucleotide
gctggtccagagagctttcc

SEQ ID NO: 121 - DNA, 20 bp, Artificial sequence
  Synthetic oligonucleotide
taccttgacattccatgtag

SEQ ID NO: 122 - DNA, 20 bp, Artificial sequence
  Synthetic oligonucleotide
gaaacacccaggtcatccag

SEQ ID NO: 123 - DNA, 20 bp, Artificial sequence
  Synthetic oligonucleotide
tagctgatgttgctgtagct

SEQ ID NO: 124 - DNA, 20 bp, Artificial sequence
  Synthetic oligonucleotide
tcaatcttacaacagcaaag

SEQ ID NO: 125 - DNA, 20 bp, Artificial sequence
  Synthetic oligonucleotide
tgctggtgctggaccagggc

SEQ ID NO: 126 - DNA, 20 bp, Artificial sequence
  Synthetic oligonucleotide
ccttccctgaaggttcctcc

SEQ ID NO: 127 - DNA, 20 bp, Artificial sequence
  Synthetic oligonucleotide
aaagccatcggcagtttcca

SEQ ID NO: 128 - DNA, 20 bp, Artificial sequence
  Synthetic oligonucleotide
agtcctgctcggcatgaatt

SEQ ID NO: 129 - DNA, 20 bp, Artificial sequence
  Synthetic oligonucleotide
gaaacctcggactttattca

SEQ ID NO: 130 - DNA, 20 bp, Artificial sequence
  Synthetic oligonucleotide
ttagagttgttcacagtcgg

SEQ ID NO: 131 - DNA, 20 bp, Artificial sequence
  Synthetic oligonucleotide
ctggaggaggaacagtttca

SEQ ID NO: 132 - DNA, 20 bp, Artificial sequence
  Synthetic oligonucleotide
tgtagccactgccaccacca

SEQ ID NO: 133 - DNA, 20 bp, Artificial sequence
  Synthetic oligonucleotide
acccattgcttctgagcaga

SEQ ID NO: 134 - DNA, 20 bp, Artificial sequence
  Synthetic oligonucleotide
cctttctaagatgacacatt

SEQ ID NO: 135 - DNA, 20 bp, Artificial sequence
  Synthetic oligonucleotide
acattaggaggccaactcag

SEQ ID NO: 136 - DNA, 20 bp, Artificial sequence
  Synthetic oligonucleotide
ccggaggatgaccagtgtgg

SEQ ID NO: 137 - DNA, 20 bp, Artificial sequence
  Synthetic oligonucleotide
gctgcgagcaccccttcatt

SEQ ID NO: 138 - DNA, 20 bp, Artificial sequence
  Synthetic oligonucleotide
aagggtacagtttgctctgc

SEQ ID NO: 139 - DNA, 20 bp, Artificial sequence
  Synthetic oligonucleotide
tgatgtctcatgactgagag

SEQ ID NO: 140 - DNA, 20 bp, Artificial sequence
  Synthetic oligonucleotide
gttggttctgcagctttatc

SEQ ID NO: 141 - DNA, 20 bp, Artificial sequence
  Synthetic oligonucleotide
ctttcacactgggtgagtat

SEQ ID NO: 142 - DNA, 20 bp, Artificial sequence
  Synthetic oligonucleotide
cacttccagtaagattacat

SEQ ID NO: 143 - DNA, 20 bp, Artificial sequence
  Synthetic oligonucleotide
catcttcaaaggcaactggc

SEQ ID NO: 144 - DNA, 20 bp, Artificial sequence
  Synthetic oligonucleotide
ctggcatagctgcaggcaaa

SEQ ID NO: 145 - DNA, 20 bp, Artificial sequence
  Synthetic oligonucleotide
ttcaagcccatatgtgaggc

SEQ ID NO: 146 - DNA, 20 bp, Artificial sequence
  Synthetic oligonucleotide
tgcagccagggagaggcaca

SEQ ID NO: 147 - DNA, 20 bp, Artificial sequence
  Synthetic oligonucleotide
gctgcttcctctgccagaag

SEQ ID NO: 148 - DNA, 20 bp, Artificial sequence
  Synthetic oligonucleotide
ttgtccataggttcagaggt

SEQ ID NO: 149 - DNA, 20 bp, Artificial sequence
  Synthetic oligonucleotide
caggacccatagtggtttgc

SEQ ID NO: 150 - DNA, 20 bp, Artificial sequence
  Synthetic oligonucleotide
tgctttatcccattgcaagc

SEQ ID NO: 151 - DNA, 20 bp, Artificial sequence
  Synthetic oligonucleotide
gagtctggacacatgatact

SEQ ID NO: 152 - DNA, 20 bp, Artificial sequence
  Synthetic oligonucleotide
gcctcaagtttaccagtagg

SEQ ID NO: 153 - DNA, 20 bp, Artificial sequence
  Synthetic oligonucleotide
ccccaagacattatttaagg

SEQ ID NO: 154 - DNA, 20 bp, Artificial sequence
  Synthetic oligonucleotide
agccactgatccatttattg

SEQ ID NO: 155 - DNA, 20 bp, Artificial sequence
  Synthetic oligonucleotide
gtggatcttggattggctgc

SEQ ID NO: 156 - DNA, 20 bp, Artificial sequence
  Synthetic oligonucleotide
tcccattgctggtgctggac

SEQ ID NO: 157 - DNA, 20 bp, Artificial sequence
  Synthetic oligonucleotide
tttatgctgggactagtgac

SEQ ID NO: 158 - DNA, 20 bp, Artificial sequence
  Synthetic oligonucleotide
taactcactaatttggtaaa

SEQ ID NO: 159 - DNA, 20 bp, Artificial sequence
  Synthetic oligonucleotide
cgtcacctacactgaggagc

SEQ ID NO: 160 - DNA, 20 bp, Artificial sequence
  Synthetic oligonucleotide
ctcagagctcaaaagttttc

SEQ ID NO: 161 - DNA, 20 bp, Artificial sequence
  Synthetic oligonucleotide
tccctctgagatcaagcggc

SEQ ID NO: 162 - DNA, 20 bp, Artificial sequence
  Synthetic oligonucleotide
cgggttgctttagagtgttc

SEQ ID NO: 163 - DNA, 20 bp, Artificial sequence
  Synthetic oligonucleotide
cattcaggtaatgtgtcaca

SEQ ID NO: 164 - DNA, 20 bp, Artificial sequence
  Synthetic oligonucleotide
caggtgaagccactcctgct

SEQ ID NO: 165 - DNA, 20 bp, Artificial sequence
  Synthetic oligonucleotide
caggcccagccaggtgctta

SEQ ID NO: 166 - DNA, 20 bp, Artificial sequence
  Synthetic oligonucleotide
aagaactttttaatatatag

SEQ ID NO: 167 - DNA, 20 bp, Artificial sequence
  Synthetic oligonucleotide
ctcattgtactgcttgctga

SEQ ID NO: 168 - DNA, 20 bp, Artificial sequence
  Synthetic oligonucleotide
agtctggcttggccatggca

SEQ ID NO: 169 - DNA, 20 bp, Artificial sequence
  Synthetic oligonucleotide
cccctaggcaaggtgggtcc

SEQ ID NO: 170 - DNA, 20 bp, Artificial sequence
  Synthetic oligonucleotide
gccagccccggcatcgaagg

SEQ ID NO: 171 - DNA, 20 bp, Artificial sequence
  Synthetic oligonucleotide
caaaagcacaccccgatgtc

SEQ ID NO: 172 - DNA, 20 bp, Artificial sequence
  Synthetic oligonucleotide
caccagcttgtccgccacag

SEQ ID NO: 173 - DNA, 20 bp, Artificial sequence
  Synthetic oligonucleotide
gatgcctgaggaagcgcgcc

SEQ ID NO: 174 - DNA, 20 bp, Artificial sequence
  Synthetic oligonucleotide
ggttcaggtagatgtacttc

SEQ ID NO: 175 - DNA, 20 bp, Artificial sequence
  Synthetic oligonucleotide
ggctgcccaaccactatggt

SEQ ID NO: 176 - DNA, 20 bp, Artificial sequence
  Synthetic oligonucleotide
gatactcatgataagggatt

SEQ ID NO: 177 - DNA, 20 bp, Artificial sequence
  Synthetic oligonucleotide
ttaccctcgcgggtccaggc

SEQ ID NO: 178 - DNA, 20 bp, Artificial sequence
  Synthetic oligonucleotide
caacccgagaatcacaagag

SEQ ID NO: 179 - DNA, 20 bp, Artificial sequence
  Synthetic oligonucleotide
gcccgttcctcacagcggat

SEQ ID NO: 180 - DNA, 20 bp, Artificial sequence
  Synthetic oligonucleotide
tcgctcagctgctctggtgt

SEQ ID NO: 181 - DNA, 20 bp, Artificial sequence
  Synthetic oligonucleotide
atgtggtgatcaacactggc

SEQ ID NO: 182 - DNA, 20 bp, Artificial sequence
  Synthetic oligonucleotide
gccgctgaagctgcacagta

SEQ ID NO: 183 - DNA, 20 bp, Artificial sequence
  Synthetic oligonucleotide
ggatgccccgtgggtagcac

SEQ ID NO: 184 - DNA, 20 bp, Artificial sequence
  Synthetic oligonucleotide
ggcccctgataggtaggctc

SEQ ID NO: 185 - DNA, 20 bp, Artificial sequence
  Synthetic oligonucleotide
gccaccgggtgagcgagccc

SEQ ID NO: 186 - DNA, 20 bp, Artificial sequence
  Synthetic oligonucleotide
ccgctctaactttcgcccga

SEQ ID NO: 187 - DNA, 20 bp, Artificial sequence
  Synthetic oligonucleotide
gggacaccagtgctgaccgc

SEQ ID NO: 188 - DNA, 20 bp, Artificial sequence
  Synthetic oligonucleotide
gagcttggtaggctccatct

SEQ ID NO: 189 - DNA, 20 bp, Artificial sequence
  Synthetic oligonucleotide
ggcgaagtgggcttttgctc

SEQ ID NO: 190 - DNA, 20 bp, Artificial sequence
  Synthetic oligonucleotide
cgtctaaggtgtgtgttgtg

SEQ ID NO: 191 - DNA, 20 bp, Artificial sequence
  Synthetic oligonucleotide
cgctccagccacgcgcagat

SEQ ID NO: 192 - DNA, 20 bp, Artificial sequence
  Synthetic oligonucleotide
ggcagaacgactcggttatc

SEQ ID NO: 193 - DNA, 26 bp, Homo sapiens
aatgggctggcactggtgccctcact

SEQ ID NO: 194 - DNA, 31 bp, Homo sapiens
ttttttttgtcttaaatttgttctgaccatg

SEQ ID NO: 195 - DNA, 15788 bp, Homo sapiens; identical to SEQ ID NO: 69

SEQ ID NO: 196 - DNA, 1285 bp, Homo sapiens
tttagaagagagatatcaccgtggtaagcaatgcaggtttgatagcaacaccagctcagacggtaattccacaggacgtaccggtacctcagtcacatctttgtcatgttcgaagctgctgtcagtatcaaaattcctagaagtgccaccctaagtaacatgaaatatataacataaaggacattcaatagaaactaatcattagttatatataacacgaagaacattcaataaatgctgattattagttatatataaaaattcagttccttttcttttatgttttcattatttattcccagtacaaagtatcaaaataataccttgggcattaaaaattttgtgtagttatctaaacagaaggtacagttatgctctccagaaatactcctttaaacaaaatataaaggtatatttcatgctaatggagaatgttttagaatattcttgtgtagatttaaactggtgctattataaattatgtgtgtgtgtgagtgtttgtgtatgtttgtgactgtgtttgccagtgttgtggtggtaagtgataaatgtataataatatgttgtaaatacattctttaataacaatttgtggtgacatttgctcactaataatggattgaaaaataatggcaagcagcctttgaaggaattaattagattaatcaattcaatgtcatcaacatcattaacattaatttctgttttggggcaaaaaaagaaaagtataacttctaataattgttcaaggaaaatgactcaaaatttcttctttcacagaggaaaggctagcagaagactcaccagaaaggttctgaagatacaaacaaagagcctgaaatgttggaaactttagggtcaagcattggtattagagccttggaaagagaatagagttgtcagtcaatttacattacactggaaactataataaattgggcaaatgcaatgcaaagaaaactgctgacagcagatatgttcctaaaatgtatgtagaatgatgtagttgttaatttaattagttgcttaaagccagacaatttctttccaaaaattctggcctgtcaaaagttaacgatcatctttcttaatctagcaaattaaatatgacactgaatgactttaaataacactgacacttccataggaatgttgatatgaagcatggtatttaattttttatgtaaaatatgaatgcacagaaagacatgaatgatgcatagtatgaaaacatgattcaaaaataaaaatatgactggtgaaataaaaactttagagaaatgtc

SEQ ID NO: 197 - DNA, 32767 bp, Homo sapiens
acacacaagcttgcagcctgcaagacagctttgcagagggaaatctactgccaagttttcagcttttccaggagctaggcggctttcttcaggaaaactctttgagccctctcaggatgaaggtacctatgtttcttaagctttcattttatatttatggtcaaggatctcagaatccttgtttaaaagaggagatggttgagtcagagcttgaactgccctcaggccaacagtgcctaagggcactgttctctgtggttctcagtgtggttttctgactagtccactggccagaaatagagtcttctttgagagtatctatcaaaaacaagttctgtaggactatggagcacttctagcaggactctaggatgttctcacccttcaccttagcttgtttctaatacaccaagtggtaaggacatgagtgaaagatactgtccacaccaggatggttttgggtcatctaactatttgacagagataggcccataagtgcaatcttgcattgtttattttaaaagaggaaaaaggcaggaaggattaagacaggaggagaattggggaagaaaggatattatgtttagaataaagacttaaaaatccacaatgagccaaaaggggaatcccactctttttgcatgaacctagttcctcttttacatatttgggaggacagtataatcagcttaggagactgagcaacttcaaggcatttggaagtcccctctaacccccatttcaaaaggaggttcttaatttaattcaaagtcctgaccacaaatgtgctgaatcagaccttggatgccttctgtctgccagcaggaatgggactcttgaaggtaccagttagcaggaagcctaattcactttctggtaagaaaaacaaagggaatgaccctaaattttggattatacaagtctgctcagatgatggtctgtcaactgctggttgtacagtcatccttgtgcgtcaataattgccaccccttccccaatcacaggggccacatcctcatcaaaaagaacacatgttaaacaccaaaaaacagatgtaatgcagtcagactgaaagtttctacaaggaaccttgcttaaatcactaaatactaaagatttcatttatattccatagccatggtctctaccccatatattttcaccctaagcattgtctatatgcacaaagacttatggagaacagcagataagcaaatgtgcctctaacctattggataattagaattagtttcatagagtaggaaagtctacaaaggaaagttgattggcagcaccaaggcaacctggaaaggacccacttgttggcatgtggacccattgaaacataagagggctcatctgggagcaactgcatattcctgatacaagggaaaaaacccttattatttggggagacaaacccaactcctaagttaaccagggtacaagtgaccccaaaatattaaatgatgaaaagagtggcaaagagatcctgatttcctactggggtagccgatatcaaatttttacccatgtgttcctgattgttctttattatctatattaaggagcatccagtgtttgtcctcccttgcccatagaaacaccacgtatttttttttttaagcaatctccatagtcgctaggggtcaggcctccctgagtcacctgacctcactccccatcgtggtcattatgcccaccttgttctgaaggttcttggtccctgcttttctgggatatcattacccacatttctttcagaaagcacaattccataatgacatctcctactgtcagttccagctcacagaggacagcttgttgtcaatgctggtgtcccgtcaccagcacattcattattgccttggtaaaaagaatgtcctccaggccctgcaggggaacatgatcagctcgtataaagttggttgtggtttcaggtcgtatgcggtagatccatattagcacaatcccctgctcaatagcctgtctaggcagctctggagtctctacttcatttaatatgggatatcactttttccaagcttccaaaagccatcccagcactatcacttagggtcttttccagggcattaaatcctatgtccgggggagtgctctcattttaacaaacacccccacatccagatttatattcctcccccagctggcccagcatccttgagatccatttccaggtcctctctcctggctcctgcctgaatgttagccaggttctgtagctcctgtggcatcctcacctgcctcgacaggcctggcacttccctaagaaggttctgctgagatttgaccctaactatgggtctggtggacaggagatgaggtgggtgcacctagcctcacttgcactgaggaagagaagtgtcttataagatgtgtgtctcatgtgaggcttctgcatagtcttcaaggaataaagggagctctgtctttgaacaaggggtgtgagctacttttgcaagcttaaagggactagagggatcaggagattcaaggttctcaagtccctctccccagatattcccattatcagaactttagtgcagaattctcagctaggctggcaatccagccttctctgaaattctgtttctattcaagttaactcctgtgcctgatctttggctgtaggtccagaacaaggatgcagcacatgaaccacctagggtacaaagtttaaggaagggcccatcctcacggtcacacacgttactgaccatgcactgtcataactctgggcctaagtgccttctaaaattttgtgccctaggtgcctcagcctagttctaatcctattcagctatgtctgtcctccagctgcagacatatgggtctgttcaaatgttgtcaaagagggcatgtggctcttgcatctttctttaaatcattggttattacatcctagtctgtcattttcttttctttttaataagtcagtggcacttagcagctataattattgtggaatgaatgtttgtcattctttccccaacacccctgaagtgcccaggtcactgcaccaactagagcttccacttccacctgtatgttaggtctctatcatattcctatatcaaatcaccatttacaccctgaaaaaaccatttatatcctggtggatgatggtagactaatgtaaacctaaccaagctattgtgccagatatgatattcttactagaacagatcaattgttccagctagtatgtggcactaggtgtgtgtttattgattcactgcatgcttttcaattcttaacagaaaggaggatcagggtagtttgaattcacttggaatgaaaagaattgtgcattcatgatcttgccccatactctctgtcacaatatatctgaagaaatcttgattatctggtcagtccataacatcacactgatccactaaactgatgacatcaggttaattagacttgaagagcagggaatggcaagtacccaggacagcctgaaacaggcaaactaggatggtgagagagaaactctacaagagatcaagtccctaccacatcaattaagtctttagggatccagtggtctgaagcatgctggcacatcctctcctcataccaccaagaaagatgcagagcacttggtaggcctctgtggatttccaagaagccacgtttgggaatattactctgattcatttgttgggagatccaaaaatctacattccatggaaggaacaagagaaagagagggctccacagcaaattcagggtatggcccttcattctattgtcatgggagcaaggttgtttccaatatggggaagactagaagtatcagggagtcaatattctcaggagtaacactcaaccaacaaagactcatagttgatgaataaatactcatttccttgcacctcgataatacagtgtgttccatatggtcctttaagtgtctccagggggacggagccccatttacccattgtagtaacccactaattaaagtactttttttggtcttgctctcttctctctctctgtgagacagagaggttcactgcaacctctgctgcccacatcacctccaaaataaactagagcatccaaattcttgtctcatggtctgctttcagggaaacccaatctaagacaaggttcaccgtggctggaattgtgggagggagggagaaatgaaatgacaggaagttgagaagcaggtaaggatcagatcatgtggggttttatagtatacaataagtttgcatttaattctaaaggcaatgggaagtcaatgacgtgtcctaattagagaaattgaatgaataaatttaagtttctaagaaaatattatcatggccactttgaaagaattatttgagagaaatagtaatggattcaaagagaacagttagggagtaataagggtgcttaggtgataaaggttacagtgagagaaaggaatgggctaattccagatacatttgagttagaggctacaggacttgctaataaattggttatgaggaccaagggaaaattatgatgccattttctgaaatggaaaggatgggatgcagacatgcttcaaatttcaaataaaatatttcttctttattttttatccttcctgccttgtaaggtctaggatccaggtgcttttcgacaggttgggtaggtgggatataagacctctgtggacactgataaaatccttttcacaagttgtgggggtaaataggctgtcacataaaaactagacagaaggtttttgatgaacttttttgttatttttgcattcatctcacagagttgaaatgttcttttgattgagcagtttggaaacagtctttttgtttaagctatatttgctaaaacaaattagctatatttgtttaaaacagaatatattttaattctgttcctgtcatattcatattttaggtatgacagctagaacactattgcccttcccaggttcattttattatataatatatggttttctaaagacaaaaacattcagttgcaatttgtaagtatctttactcctagccaaattacatcacacaggctgctggaagtgcatattctaaaaaggaagaagtaattccaaattgagccatgttctcctcatgcaggagaggaaatggtcagcttcctgggaagcacaggctatctgagggagagaacagatggtttatgcattactaacactgcagggcaggggaacactgagaacagtccagaagacactgctttctagacaaaacacagaaacatttcagagtctgcctcccaagccagctcttggaacttcccactccatggacccatgctgccctgacttcacgcaaggaaagaatagctccctttgaaacactagggaaaacagcagtcctgctggcattagctctaggccagaaatcactaaatacttatattaaacaagggtagaaattctaaaggcttagacttaggaattgtgagccgtacaggtagtttagctcatagaaaactgtctatagacattcacagtgtaactttcatttctgtagatcacatcaaaaatgacaaggttgaaagaggagtcagcttcagcaggacaacccctagtgagctagggcagtacaattatagtccctttccaaggtgtcttcactgtgtgtggtgcagaatggttaacattgaactactgcatgacttggaagaagctcaatcatctcccaaagccaaacatttattcttacagagtagactctatatgcctattgaaagtcagattcaaaaaactactttaaagttcatatggaaccaaaaaagagcccgcatcaccaagtcaatcctaagccaaaagaacacagctggaagcatcacgctacctgacttcaaactatactacgaggctacagtaaccaaaacagcatggtactggtaccaaaagagagatatagatcaatggaacagaacagagccctcagaaataatgccgcatatctacaaccatctgatctttgacaaacctgacaaaaacaagaaatggggaaaggattccctatttaataaatggtactgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccgaaagcaatggcaacaaaagccaaaattgacaaatgggatctaattaaactaaagagcttctgcacagcaaaagaaactaccattggagtgaacaggcaacctacaaaatgggaaaaaattttcgcaacctactcatctgacaaagggctaatatccagaatctacaatgaactcaaacaaatttacaagaaaaaaacaaacaacaccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacacctgttagaatggcaatcactaaaaagtcagaaaacaacaggtgctggagaggatgtggagaaataggaacacttttacactgttggtgggactgtaaactagttcaaccattgtggaagtcagtatggtgattccttagggatcttgaactagaaataccatttgacccgcccgtcccattactaggtacattcccaaaggattataaatcatgctgctataaagacacatgcacacgtatgtttattgtggcactattcacaatagcaaagacatggaaccaacccaaatgtccaaaaacgatagactggattaagaaaatgtggcacacatacaccatgaaatactatgcagccataaaaaatgatgagttcacatcctctgtagggacatggatgaaactggaaaccatcattctcagcaaactatcacaaggacaaaaaaccaaacaccacatgttctcactcataggtgggaattgaacaatgagaacacatggacacaggaaggggaacatcacactctggggactgttgtggggtggggggaggggggagggatagcattaggagatatacctaatgctaaatgaggagttaatgggtgcagcacaccaatatggcacatgtgtacatatgtaacaaacctgcacattgtgcacatgtaccctaaaacttaaagtataataataataataataataataaaagtcagattgctttaaatgtaacttgacttctgcccccaatgggattaatgtgcgatatagctcacagtactatcagtcattattataactctgttcttcccctcctttttttttttttagatagagttttacttttgttggccaggctggagtgcaatggcacgatctcggctcactgcaacctctgcctcccagattcaagtgactctcctgcctcagcctcctgagtagctgggattatacacacctgccaacatgcccggctaatttttatatttttagtagagatggggtttcaccacattggccatgcttgtctcaaactcctgactcaggtgatccaccctcctcggcctcccaaagtgttgggattacaggagtgagccaccatgcccaacctattcttctacttcttaaatgagtattagagcccacattttctagaactggaccagtcacagaaccatatgcccactggtaacaaccccaaaaggtagcaaaatctctgaatttctacttaattttatcttgggacatatgacactgctaggcatagttaggggcatggagatgatgtcatttctaccctatgtgctcctgagacacctctgagctggtcttcagctacagtggtagcctcctactttaagcatctatctgaacttctccacttgaggatttcctctggtgctacacatgcttgcttcatttgtatacagagaagattggaagagccagggatttaatgcacccagaggtaaccctcaaccagtaatgaatgggaataagtagagaaagagtccagcttccccatctcttggtaaggcaattctgagagatatcctcagcagatgcttagagagtcccagtgggaattaaactttagttgccatcagcagtatccttctcaacatgcactgtattgtctttcattccatggtagacaaggagatgcaccatacagatctgaggaatgtgaccagctgccccagctgtcagctccctcagggtctgcctgagtctgacagttgccttacctaaggtaatgcccttcctgggcagccgtcatctggtgacaacatgagatgagggtacaaaggtgtagtcattttggtcccatgcaggatggtgctgatggggaatacttgctccagggtgcactgccagattggccaaggttttgtcagggccatgtcatggtttgactgcccaatcctccttcttcctccttcctttcacagatgttaatccctaaaaaacatcttgcaccctaaagtctgcatagcacctgcttctagaatcaatctataacaactttcctatctcactctcccaactccctcacttgtgccaactgggaccatatatcaacctcctacacacaactccaactttttggaagggactcaaactagaaaatgagaaagagagcagttcttctttcactcctaattttcccttccttgtagaggtagctccagtaactaaaatagtcttggcttttctctccccactcattccctcctccctgaaagagtaaactgggtatgtgtagcccagcttgttcctctctgctttcaggagaggggctgcacacaggaatcacatattcttccccatttctgcatgctgtcagttttccatagacaatgcatgagttagagagtcctatagtggttagtgttactggactggctgtctacctgtctagtgctgtggcttagttttgagaagcccacttgtctgcagatataagtcacattctccaatgtctggtttatcagtaggaaagaggcgatattagccaccatctgctgatttttgttctgtggctctattgtttaaggactcaggcaagaaagaaaatgattatttacgaggttccaccaaacctccttgctcactttgaaagcaagctctagctgtgttgtgaggtcacctgggttgtaatcaggcaaggagaatgtggtggtcatggaaatgtcccactcagatgtcccatccagaaaccagctgcagggagcatagctgaccagcaacctcagtgctgctcctttggatctagcatggcattcactgatcagtgggagcccaggcaatgacagagcacagcaggactgctaaagctagacccatcctgcctgcctgatgcaggtctcatccaacaggcagctttgcctcggggactcctcatcagcctggtcaggactttgtcgaactgcactgcaatatgaggctcttcatgcccaaaacttcttcctttgctctgtcctttcacatgtgtcagatcagcatgatggtttgaaggctctccctgcctgcaactgctccttcctcctctatatttcaaaggcatctccccaaaccatgcagtctattccatcctggtgtctgatcattagagaacctgaaccaacagagtaactgcccaaagaggaagaatggaggagtgtcagggtgtggttttctcctgggtgttggaaccccacttgggatggctcatttgtaaagtgatacagaatcctggcactcatgtcttagttgcaggacttttccatgtaataattgtacattttgtgaaaaaactaaggagttttaattaaagacctacatccctcactttccaaggacctccagagccactttgatcaggccttgaacagggcaattaccatgttgagccatttttatagacctgattaactagaatctgaactttcttttctcctccacacagaagccctacagcttctttcagccatttctaactggagtagtaccaactgctcatgataaacagaccttttctgaaagcagtgccaaacctttagcacattattcttggctcatatagtccatacccctgtagaagggaaggaaacttgtgtaattgaaagtacaaggaccttcaattatacaacagttaggacagaaagataggcttgagctctagctgtcccattcacagctaagtgatgatcaggagaccacttattcagaggcttaatttcctattctggaaaatgaaaaggcctcccagggctttttgcaaatggtgaagaatacaaatgtatttcataaattgtggagcagaaaggttgtacaacagtgatgagtgggacagatctggtctacagatgtgttgggtttggcccacagagaatttctttttttaatctgaaaatttcagagacagtgtggctttctgacttatttcaaaaaatcctcattgcagaaattcaatggtgagaaacagcagctgccccaaggagtatatttcttccagttcccaatggtccccataactcacagcctcactcactgagatgtcacttactcacattacttgatgggatccggtaggtatgagtttgggacccctggggtagaagatgatgaaagtttcatcacctgtgaggggacaatcagattctactggagaagatccagagaggacagtctgtcaccactcaggatgtggatgtcatattaaggtaacactgaagtggtgcctgatggatcctgcctgaccatgagtcctttcatcagtccaagaatatgcacggtataggattgtgatgttgtgttttataattatatatttttgttttcatccttgttcttggcagagtgcttatgacccttgtaaggagatgtaggcccaccatacttgaaagcatttcaatgtacaacttcccagagctgcaagaatgttccaccgtcatgccattgtgctccaggagttacaagggttccttgtagattctcgatattagtcctttgtcagacgtgtagtttgcaaatattttctcccattcttcaggtttctgttcactctattatttcttttgccaggcagcagctttttaattaagtcccatttgtccacttttgaatggaacaatagacattggatatttgaaagggtgggaagatcaggggaagggatgagaaactacttaataaatacaatgtatactgtgggtgatgactgcacttaaagcccagactttaccactgcacaatatatccaagtaacaaaactgcagttgtacttcctaaatctattttttaagaaaagaaaaaaagaactgggaaattcttgtttcagggttcatggagtatagatttgttagatttgctagtatttgaaatgattgtagtcagacaaaaactactcccaaaggggaacaagaattattgctgtatctcttatgcctcccagacctgtgccttagtttggattccctgagaacccaaggcaagaactcgagtaatttacctgagagatagagggaactctgttaggagactgggaaagggagacagggaagcaaagtagccaataaagtgcattttatcaagccagctaccattgtcagcaactggagcatcattccaaggacagtctgtgctctggtggtgatcatagtttacagttcactaggaccctgtggtaccagtaccaagcaagagtgtttctagtttggagaccaggacctctaaccttgcagagcccagatttgtggggatgagaagcacagtgttcccttagtgggatgttggagatgatgatgagtaaagccactcctgcttccaatccttgcttcttggtccaaatgtgctccctgttggagtcacagtaccattgataggtctctccacagttcatgcagtacattcgggggaaagacactccacatgagctgcagcttcagcttcagctctgccttcagcaggcctttccaaagctctatgggaccagtgcttttaatggtgtggtttgtgatatgatcaagggatcccatggtcaggggtccatgaccatgcctccttcactgtaataagaggccttggtcagatgctgtattgtatgaattaggcattttgtaatcccctgaatagtggtgctgaatgacgtgctaagggcaaaaaaaggcaaacccatgacaggaatgtctgctcctatgagaatgagtcactagtctttctggaatggaagggttttagttaatttggttctaagtggctcagaaaagtagcacaatatcagggactcagtattggtctctgttgctaacaggttggatatctagaaggagcagtaactagattgttcttggtaagtgtgagtccacattgttgggcccatgcatcgcctccaactctgccactgtggtccttctttttatatgcaacacatgccatttctggggtggcagatgacaaaggttagcaaacaataactggcagagacatttggctcaatctggagatagggtgagggattattactttattagagtaactactctcagcccttttgcacattcttttttctcattaaagtattaatcaataacctcaatttctcatacatttctacaaatgctgtgttctgttatacccctccataactatctgcaggtatgccagatggttggctgccattccaaccttagctggcattatgataatcatgacactctggcttccagtgattgagggctgccaccctgcctttttggcttcagggaccccaccaccacattgttagcaattcggcaagatctgtaactgcacttactactatctgtaactggcctgctggggggagtgatggctgaacttcttgatgctgattcctggcatgccagtgcattcttaatggccttggcagatggctgtcttgtgtgtttcccacagaacataatcctatggtgcgtctttagtcatcacaaaatatatttaatctggtatgcccgaatccttgggctatttagtttctcccctcctgtcattgcaaaggtgtttcagcttggttcagcatgggcacttgcattttctaggcttctaggggcccttataatggtaagtttgcctgaaaccctgaggtctttgccagcatgttaaatccagtatgctaaaggggtaccctcaaatcaacaaactctccctccacttgtcttatgtgctgtctccccttaatctagacattcaaaatccaaatccatggttattctcctggcctctgccatttcatgctaaccaattcttgcagtttatttgggagtaagctgtcttacctgatcaggcccaatatgtccatggctgattatgctatgacttcacaccagctatcagcctggctatcagtagaacaggtagggggctgatcatgaggtagagcccctattaccttatggagaagaggccactgaaggggggaagcagaagtgtattagggtcctccagagagacaggccaataggataaatgggtagatggatagatggacaaatggataaataggagatttattgggaaaataggctcacatggttatggtggctgggaagtcctattcaggccatctgcaagctggagatactaggatgctggtagtgttgctcagtcccagtgtaaagagctcagaaccagggaagctgatggtgatggtgtaactttcttttctttttttttttttttttttgagaaggagtcttgctctgtcacggaggctggagtgcagtggcacaatcttggcttactgcaagctctgcctcctgggttcacgccattctcctgcctcagcctcctgagtagctgggactacaggtgcctgccaccatgcctggctaatgtttttgtatttttagtagagatggggtttcaccgtgctagccaagatggtctcgatctcctgacctcatgatctgcccatctcggcctcccaaagtgctgggattacaggcgtgagccaccgctcccagccctgatggtgtaactttcagtccacatctgaatgcctgagaactggggaacctggagtccaaagtctagagaatctagtgttctgatgtacaagggcaggagaagaagggtgttccaacttcagaaaaaagagggtaaattcatctttcctctgcctttttgttctatccaggctgttagctgattgaatggtgcctatgcacaatggatgagactgggtcttcctgagtccactgattcaaatgccaatctctttcagagacaccctcacagatgtacccaaaaataatgctttaccagctatcttggtatcctttaattcagttcacacctaaaattaaccatcacaaggaataagaggtgactatttcctaataggggagggaaggatgggccacatctgtagtatttaagggtttagaggaatacggagaatcacatagttccatctcatattaagcatcccaggtttgtccaatgaggttctcaccttggtacaacagaccttcctcagttaagaattccatcagctttgcatcttgacaactctattaaatcaaggtttgggtcttccacttttgttctttcactttgggagatacggactttttggaagcttctaaagaagccctctggccttcacacttagtttttaattgttaacaacctcatcttttttttattatctctctctagtgggtcaatgcaatttagtgccagccaaccaactctattgccctcctctgcattttcctgcaaaccaacccatacctgcttttcaagtggccaaatgattgttcttgccagggtgttcccctctactagaacattctctcaaatcagcctagagaacattttagcaattgggctgccactttcacaagtttgctggtgagcaaagttcctgacagaggccagatagtattttttggctctgtggaccagtctttgtagcaactacccaacttccttgtactgcaaaagcagccataggcaatacataaatgaatggatatgactgtgttgcaacaatttttaaaaaacaagtggttgtataattcaaaacgtatgaccttctgggaaagacaaaactatggagacaataaaaagactagtgactgatagattcagggatgaatagatggaactcaggttcattttaaggcagtgaaactattctgtatgatactataatagaggatatattatacatttgtcaaagctcatagaatgcaacacaaaaaaatgtaccataaactatggacttatgaggcttttaatttccatttttcttttagtttcagggggtacctgtgcagggtttgttacaagggtatattgtgtgatgctgaggtttaggcttctattaaacctatcaccatggtagtgaacatattatttaatagaaagtttttcaatccttgccctactccctccttttggaatccctagtgtctatggttcccatctgtatgtccatgtgaaccccaaatttaacttccacttataagtgagaacatgtgaaacttggttttctgtttctgtgttaatttacttaggataacaacctccagctgcatctatgtcctgaaaaggacacgattttgttctttttttatggctgcatagtattccatggtgtatatataccacacttgctttatccaatccaccattgacgagcacctggcttggttccatctctttgctattgcgaatggtgctatgatgaacatacgattgcatgtgtcttcttggtaaaatgatttttcttttggatatacactcagtaatgggattgctgggtggaatggtagttctgcttttggtttttcaaggaatcaccacactgctttccacaatggttgaactaatttacactcccacaaacagtgtataagcattccttcttcactgcaaccttgccagctacccattattttactttttaataatagccatcctgactggtgtgagatggtatctcattgtggttttgattagcatttctctgatgattagtgatgctgaacatattttcatatgtttcttgcccacatatatgtctttttttgaaaaatatctgttcatgtcctttgcccacttttgaatgggtttgttttttccttgttggttcatttaagttccttacagattctagatattagtcctttgtcagatgcatagtttgcaaatattttttcccattctgtaggttgtctctttactctgttgatagtttcctttgctgtgcagaagctctttagtttcattaagtctcacttatctcttttttattttgttgcatttgcttttggggtcttcatcataaattatttgcctaggccaatgtctagaagaatatttcctaggttttcttctagaatttttttagtttgaagtcttacatttaagtcattaatccatgttgagttaaatttgtatggtgaaacgtaggggtccagctttattcttctgtatatgcctagtcagctgtcccagcaccatttattgaatacagtcctttctccattgttttttttttttcaattttttcaaacatcagttggttgtaggtgtgcagctttacttcagggatctctattctatttcattagcctatgtgtttatttttgcatcagtaccatgctgttttggtgactgtagccttatagtataatttgaagtcgggaatgtgatgcctgcagctttcttccttttgcttagggttgccttggctattcaggctcttttatggttccatatgaactttagtttttcctaactctatgaaaaatgatgttggtaatttaataggagtcgcattggatctgtagattgcttagggcagtatggacattttaactatattggttcttccaacccaggagtgtggaatggttttccatttctttgtgtcatctatgattatttcagcaatgttttgtagtcctccttagagatcttttacctgcatggttaggtgtatctctaggtattttgtatgtgtgtgtgtggctgttgtaaatgggattgtgttcttgatttggctatcagcttaaatgttattggtgtatagaaatacagatttttgcacattgattttgtatcttgagaatttactgaaattgtttatcaagtctgagtcttttggcagaatctttagggttttctaggtgtagagctatattgtcagtgaagagaaataacttgacttcctcttttcctatgtggatgctttttttttctttttgcctgattgctctggataggatttgcagtattatgttgaataggagtggtgagagtgggcatccttgtcttattccagttcttaaggaaaatacttccagcttttgcctgttcagcatgatgttggctgtggatttcttatagatggctcttattattttgaggtatgttccttaagatgtagtctgttgagggtttttatcatgaaggggtgttggattttattgaatactttttctgcatctattgagatgatcatatggcttttgtttttaattctatttatatgatgaatcacatttgttgatttgcatatattgaaccatccttccatcacaggaataaagcccacttgatcgtgaattaactttttgatgtgctcctttttgatgttagtattttgttgagattttttgcatctatgtttatcagggatgttggtcaatagttttctttttatgttgtatctttgccaaatttgggtatcaggatgctactgctttcatagactgagttagagaggagtccctcctccttgattttttgaaatagcttcagaagtattggtatcagctcttctttgcatgtcttgtagaattcagctgcaaatccatcttgtctggggatttttttttggtcagcaggattttttttattactaatttcagaactcagtattggtttgttcaagatttgttcctccttggctcaatcttgggaagttgtgtgttttcttctagattttctaatctgtgtgcatagaaatgttcataatcgtttctgagatccttctgtatttctctgggttcagttgtgaaattacctttgttatttttgattttgcttagattttctctttattattctagctagtggtctatcaatcttgtttatcctttcaaagaaccaccttttaatttcattgaccctttgtatcattttctggggcctcaatttcatttagttttgctctgattttagttatttcttttcttctgttagctttgggtttggtttgtccttgtttttctagttttaggtgcaaggttaggtttttaatgtggtatctatcttcttgatgcaggtgtttaatgctataaactttcctcttaacactgcttttgctgtatcctagaggttatggtatgttatgcctctgttttcatttgttttaaagaattttatttgtgccttaatttcatcatgtacccaaaagtaattcagaagttgttttgtttccatatatttgtgtcattttgagagttccttttgatattaatttctatttttatttcactgtggtgtgagaagatgcttaatattgatatttttgattttaagacttgctttatgactgagcgtgtggtcaattttagatgagaagattgcagataagaacgtatattctgtggttgttggatggagtattctgtagatgtctattaggtacaattggttaaatgttgaattaaagtctggaatttttttagtttttctgggtgtgaatgatctgtctgaagatgtcaatgcggtgttgatgtcccacactattatcgtatggctgctaacttcttttgttaggtatagaattctgtgctttataagtctgggtgctccaatgttgggtgcatatatatttagagtagttaaattttcttgaattgaactctttatcattatataatgcccttttttattgtttctggtttaaagtctattttatcctatacaagaatagcaacccctgtttttttttgtttgtttagcatttgcatgatcagtctttctttccatgtctttactgtgagcctatggctatcattacctgtgagatgggtctcttgaagagaccagacagatcttgtgtcctgtgtttttatcaaatttgctaccctatatcttttaagtatggtatttagggcatttacattaaacgctaatgttgatatgtgaggttttattcctgtcatagtgttattagctagtttgtcttgattatgtggttgctttatggggtccatgggctatgtgctttcatgatagtatcagtcttttgtttccctgtttagacctcccttaagcatctcttttagggctggtcttggggtgatgaagtcctttagcaattgcttgtctgggaaagactttcttctttgtttatgaagcttagtttggtaagatatgaaattttggctgacatttctctttaagaatgctaaaaatgggccccaatctctgactgttaaggtttctgctgagaagtccattagtctgatgtgtttccctttataggtaacatgacccttttctctagctgcctctaagatgttttctttcacattgaccttggatagcctaatgactatgtgctttggggatggtaatcttgtatagtaacttgtaggacttctctagatttattgtatctgcatgttgtcctctctagcaaaattggggaaattttccagaattgtatcctcaaaaatacatttatcaagttgtttactttctcttctctcaagaatgccaataagtcatatatctgatcactttagatagccccatatttctcaaaggctttattcatttttaaatttttctttttctactgggttgattcaaaggaccattcttcaagctctgaaattttttccttagcttgttctagtctgttaaggcttccaattgtattttgaaattcctgtagtgaatttttcagttccagaagttctgtttgcttctttcttaatacagctgtgttatcttttaaatcttggattgtttttctgttcatgttggattttttctcttaaatctcattttctttgacatccatattgtgaattgaatgtctgtcatcctagacatttcattctgattaggatccgttgcttgggagctagcgagatcctgtggaggtgacaagacactctggctttttgtattgtcacagttcttgtgctggttccttctaacgtgagataattaatgcttctttttttgaatttgctattgtttggagcttcttgatttcctattcttttttcccttgggggtatgactgcagtgtatactgtgtataatagattggctttgtttctgggtgcttttagggagccaaggctctgtttgggttccttgattgcaaatatgttcctgtggtggtcttctcaggtgttgcttgttgtagcaatgtcattttgtttggtggtgtaattcaatcttctgtccagaaggtggtgctgaaaagtaagagccaacaggtaggagcaggggcaagggagaagtgaaaagtatccttccctagcaagtgttcaaccttcagtggggggtggagccactgtagttgcctaataagtggtctgtttcagcccacgttccctgggttcttatggaaagaggtgctgccaagtccacagtagtgtggaggggagagattacccattctccgtgtccatccctgggctttggtggtactgtctcaagggctggtgctgcactcatgtttcctttggcccgaggggtgctttggtgggctgtgctccccacttctttaggggaagaccatgccaggggttagctctctctggttctgggtgtctttggtggcagagtctgtatacattccttggttataggtaactttgtatagcggctcttccaaatgctggttgtagcatgtgggcagactcactgcctcctgtgtggctggggtggcagaggtctcaggaagcttttctcattccccactgttgagcacttgtgtctgcagattttctattgtgttgtgccattcaacctccaggccagtaggtatcttatacaggtaaaagccagctgcagccaatgcagatgtgcatatacctgatctttgtttactgggagaagctctgttgcctctggcaatctgtggggtgcacagtggtctgagcttcctgttcagctccagagtgggagactaagagggatggggcctgaccaggcaggtccacttacaggtcccccaataacaggcacgagcactagctccaaggtgggggggcccagtgggtggccaccaagtggccagaggtgtgcctagttatggagtttgaaaacttcctctgccccaagttctctgcctaaggaagaggagaggtgtaaactcctaatctagatgaattggtacttggaatgtctagagatatgtctgggcattgagaggagggtgagctagtgcaccacaatctccacacctgaaggtgggggtggctcaggcttctaatccaggcaagcaggtatgccaaatgcctggaaatatgcctcagcaaggagtggagaaactactgctgcaacaaggtctttgcaggggatgggaagggtggctctgtctcctactccgagagagcaggtgtacctcatgccagatgatatgcctggggtagaagcagagaaatcactgccacattaagatctttgcatgggaagggataggtggctcaagctcctaatctgtgagacctagtgtgctaaatgcctggagttctgtccaggtgtggagtggaggaagtgtcactgcaccgagttcactgcatgggaaagggatggaagctcaagctcctattccaaaggggcaggtatgccaaaggcctggagacatgtccaggcatggagcagggactgtgccactgcaccaagatctctgcacaggagggaagctcaggcaggtgagcacgtgtgctgaatgcctgaaaatatgtcccccagtagggagcagagtaacagagtgcaacaaagtcttttcaggaaaggggtcagctcaggcagctaatccaggtgagagtgtgtgccaaacacctagaggtaggcccatgcatggtgtgaagggagcaccactgcaccaagatctctgtagaggaaggatggggtagctcaggctgctaatccaggggaacaggtattgcaagtgcttggcgacatgcctcagcatagggtagagagggccccactgcaccacgatctcagaaaagcaggctggagcacccagcaatgatacacgcagactggttccaggttggcaaactggccctggcagcaagtcttgctgcccaggagaaactagcttcagcaactctcctactccagacctgcaatgaaggagagcccaattccagcacctactgctggggtgctttccacacctgctgctcaattctggctgtgggggctcttccccagctccatagaaagcactccaatctttggtctgagactaaaatgcctgtgtggccatgctgctgggttgctgaagaatggctgactttctatgagcctgggttcaaaatggcatcctcttctcagtcttgggtgtgggaaaatgcctgcagcttttcctagtgtctttcctgctcagtgtctccaagcctgtcctcaaattagctctggagcttgggagaaacaagatgctctcccttggccagagttgcatggatccctagtggatcggtgagttacagagggaggctctctacccctcttgtgtactggggctgcacccacttttatcagctggacactgtttgcccaccttcttctctccaggatctgggatgtcctttgctattttggtgaattcccattttccttcttgaactaaagctcatcaagttgatcgttatgcactattttgctccttccaagtcatttaggcacacaaagagcctctcatctgccatcttagggaaaaaaactgaacttttattaacattttaccaatattagctcatcaattgcaacaagtgtaccatagtaagccaagatgttaacaataggggaatcttgaggaaggagaggtgaatgagggaatttctcctaaatttaaatgaaaacttaaagttactaaaaaataaagacatctaaaaagctaatgggaccaggcatggtggctcatgcctgtaatcccagcactttgggaggccgaggcagatggatcacctgaggtcaggagttcaagaccagcctggccaacatggtgaaatctttccctactaaaaatacaaaaattagccaggcatggcagcgggcgcctatagtcccagctactcagggggctgaggcacaagaattgcttgaacctgggaggcagaggttgcagtgatttgagatcacgccactgcactccagcctgggtgacagagcaagattatgcctcaaataaattaaaagctaaagggaaaataaagcctttctaacacaaactttaaaacaaaacaggtggcaggtgagatctgttcctcaggctgcagtttattaacccatccccatctgcacagcccctacccccagattactgtgtatcacgtaacaaccaggatagggtcttcattgccaggttggaagtaagcaattcagtccctaaaccctatcttgctttctcataccactcttaggaccagttatgtctgttcaggtactccaggaaacagatgctgagatgaaattagtagtgtaagagacttgttaggggataacatctataaaaaataaagggggagaaagcaggatggggtggcttggaaagcttttggaccatgctacatacctgatagtatcttggtgaacctcagaaagctctggagcaaagattacccaccagaggagttcctacttggtcaaaatggccaggcaggccctagcatcccaaccatactacctcactggctgggagctgcccagggcaccacagagagaaggtccgtcaacagctctcctcatagctccactgcaagccctttcttgaaagggaatctgagcaaggtatctccatggttgcctcagggtgccagtttcttaaggcaatctccctcaggctctgaatcagagctgagttccgacaaactctagatcagcttatatgttccttacaaccaaggcaaaagccactctttaaaagaatgagaaaagtgcagttgcacacagcagcaacgacagcataggcaccaggattgtctcctacaagatcgcaaagattagaaaaaagccccatcaatggaggaatcatgacaaggcccaaatagaaagaatgcaaggtatgttagagattgattttcttattccttcactagtggaggaaacttaaaacactggatgtaagttcctgaagtcaacaattatcttcatctctggtcttctctttccacatcaactgaacactgctttgctatggctttgtagattatgtacttttctctcactcactttttggaattataggagttttttctgtgtaactcaaacctcctgaacctagggcctgtgtcttagtttgggtccctatcttagtctgtttaggctgcaacaaaataccataaactgggtggtttacagacaacagaaatttatgtctaagttttggaggctggaagtctaagatcaaagtgctgataggctcagagtctggtgaaggcttgtgtcctggtgcatagctgtcttttcaccatgttctcacatgttggaagcggtgcctgagcttcctcgggcttctttcataagggcactaatccgattcgtgagggctctgctttcatgacctaatcatctcctaaaggccccacctccttatatcatcaccttcaggattaggatttcaacataaattctggagaaacacaaacattcagatcatagcagcctcctaaaagcagagactaagataagaatttgggattgcctcctacataaactgcctgtgcccaggaaccaggagtgaaaaagaagtgaaacagggaaggagaaagagtcaatgtaaggcacattattgaaatctgcactccagcttttcactcttgaggaggggtctgtatgcttctcagacttttcacaaatagtaactcctcagctcttccaggctgcacatagaaaagagcatggattggtaaaagtcaagcccatcagaaaagccagtgtgagcctggggagcacactgcaaggatgaagtgggaggtaaatgtctacatgtctactacgggcctggctgaagccacaggtggctgaggggatacaatgtggtcatacaatgggtcaatttgacctaaactctaagtattcaaaatatgtcattcctttgggttaaagccattgcctttaaataaaacactatggtcaatggtgcacataagggataacacattgatctggatatgagctgctccaacagcttaagaaattcagaggaagttcaatagtttagcgagtcaagggataactgagaacatggtattatgaaagcaaaacattagacaccattgaatacatagggctttcttatttattttttttaagagacaaggtctcactaggttgcccaggctggtctcgaactcctgggctcaagcaatcctcccacagagctggaattacagatgtgagccactacaccccgtctatatataggacttttcatggttaccactgggatgcccccaaagacctcgttagccactaatcccatgacaactgaaaagttattcatggccttggattccaattcttttgtctcacgatctggttccctccttagtgctggcttctctcctagacgtttttccgttttcctgctatccatctgactcggaagcaaagatatctaagaaggccaacattagccttgaaccttgacattaggagaaatcagtgcccacaatagacagtgcaatattttgcatagacaaaaaatgattcatgttctgcagttgggtgtctggaagggtcttgacacagaacaaccaagctagtaggggagatggagtgccaccttcttcagtcccatcaccctgtacaaggttctgaatggatgtgacagggcaggttggttcaccttggtgcccttatcaccatcaggtaccttcttacaaaggagtcttccagaaaggatttacttatttttaaaactcctatagcttaatgtgtgagcctacaggacctgaaagagtatgcagttgtaatttctgcttacataaacttgattgtgtggtggtgtctgaacaaagttcactagactaaatcagtactcctagaatccagagctggtccaactctcagatctgagttaccttgggcaagtaatttacttgtatgctctagggaagctcagcaatgatacatgtcctattaggtattgattatcaaatgcaattatagaaaaacctattaataagtataaaccacttatctagtaagtcattttcttagatgttttcacttctatgcaaatcaccaaagttcactgtgtgtgtgtgccattaatagtaccaaagttgctatggaaatgcagactcgggttttccttctgtgtcacatagtattgtgtccagaattggtgggttcttggtttcactgacttcaagaatgaagctgcagaccctcgtggtgagtgttacagttcttaaaggcggcgtgtccggagtttgttccctctgatgttcagatgtgtttggagtttcttccttctagtgggttcgtggtctcactggctccaggagtgaagctgcagaccttcgcagtgagtgttgaatccaaagagtgagtagcagcaagatttattgcaaaaagtgaaagaacaaagctcccacagtgtggaaggggacccgagggggttgccactgctggctcaggcagcctacttttattgtcttatctggccccacccacatcctgctgattggtccattttacagagagccaattggtctgttttacagagagctgattggtccattttgacagggtgctgattggtgcgtttacaatccctgagctagacacaaaagttctccacgtccccactagattagctagatacagagtgtcgattggcgtatttacaaaccctgagctagacacagagtgctgattggtgcatttacaaaccttgagctagatacagagtgctgattggtgcattcacaatcccttagctagacataaaggttctccaagtccccaaaggattaactagatacagaatgccaattggtgcattcacaaaccctgagctagacacagggtgctgattggtgtgtttacaaaccttgagctagatacagagtgctgattggtgtatttacaatccttagctagacataaaggttctccaagtccccaccagactcaggagcccagctggcttcacccagtggatcctgcccggggccacaggtggagctgcctgccagtcccatgccatctgcctgcactcctcagctcttgggtggtccatgggactgggcaccatggagcagggagccgcactcctcggggaggctccggctgcacaggagcccacagcagggcagggggaggctcaggcatggtgggctgcaggtcccaagccctgccctgcgaggagacagctaaggcccagtgagaaatcgagcacagcagctgctggcccaggtgctaagcccctcactgccaggggcttgtgggctggccagccactccaagtgtggggcctgccgagcccacaccctcctggaacttgcgctggcccgcaagcaccgtgtgcagccctggttcccatcggcacctctccctccagacctctcagcaagctgagggagctggctctggccttggccagcccagaaaggggctcccacagtgcagtggtgggctgaagggctcctcaagcatggccagagtgggcgccaaggccgaggaggtgctgagaccaagcaagggctgtgagggctgccagcatgctgtcacctctcagtatcttatctcataaaagcccttcctcccatttccattctagtggaccccaaagcagttcatataagccatggatcatcatacttttggcaagatagcagggtccaaagtgggacccatccagtggatcatggagctatttaccactgtcaggaacacctctcccaaggcagctaaagaggtcagatgccttaaccagaaagcagagactcaagcaagtcggggtcatctgtgtattgctcacctgcttccagctttgttatctcagcatgtttttggagcataaattgtgtagtgaaggtcaacagagccataactgctggtgttctgaaaggcaatctctacaatttcctcactgacagaacttgtctttcctctggtctccttgaggttagttctcttctaagacctgcacctgttggtcaaagtcttgcttctcctctggattgtcattgctcttttacctttcagcatctcctccccatctaattcatttctgctcatcagtctctgatcatgccagttagctgagcctggccattatcctctcaataactatgtttaccaacatctgtagaacccagatgtccttctactacttctttagtcactgctgttgtgtctccccagaaagccctcccagaagcttcccagtatggctccatccaagccaagctgccgcaaagctcagggttctactgtatgattacacgctgccatctcctggccaaagcactgaacttgggcccagtgggtctggccccacagcttgaccttggttttaattatgtgctgtccccatccactctgccagctaggattagagagatgttcatgactacccacagctcataaggcacagaagaatttagagaattagctgatagtattgtcctgttggcccatctaaagaacacacctccctcagaatccaaacacctccctcataaaggaaaatcagctctggaatcctagatctcattttgtcttcagcatagctggtcaaataaatcacctgaaagggatatttaaaaagtactgccttaattttgggtgcttgtcttcactgggcttctaagcaacagtctctcctggtaaccaggattaacttgggtttctacacagtagctttggaattcaatttctagtggatgactgcatgagtaaaaaacagtcttctgttgagttgctaatccatttggtcgatgaactccagcatacataaagcctcccttcccaaatgacatattcaatgtttctaccaaggctaagcagcagagaccaaacatgctaactatccattctagtctaagttctaagccagctgaccctttagatgttatcctctcctattcttcattcccagaccttaatggctcatgaatggagctggctcttgccagcaacatttgccaggatctgtagaataccaactctactttaagaatttccttaggcgagggattccattccaagatggctgaataggaagagctccggtccgcagctcccagtgtgattgatgcagaagatgggatttctgcatttccaactgaggtacctggttcacctcattgggactggttggaaagtggatgcagcccacagagggtgagccaaaacagggcggggcatcgtctcactcaggaagcacaaggggttgggggatttccctttcctagccaagggaagctgtgacagacagtacctggaaaattgggacactcccacccaaatactgcacttttccaatggtcttagcaaatggcacaccaggagattatatcccatgcctggcttggcaggtcccacactaacggacccttgctcactgctagtgcagcagtctgagatcaacctgcattgcagcagcctggtggggggaggggcatctgccattgctgagccttgagtaggtaaacaaagcaggccagggaagcttgaactgggcggagcccactacagctcagaaaggccagttgcctctgtagattccacctctaggggcagggcatagctgaacaaaaggcagtagaaacttctgcagaattaaatgtccctgtctgacagctctgaagagaacagtggttctcccaacaaggtgtttgagctctgaaaacggacagactgcctccttaagtgggtccctgacccccatgtagcctaactgggagacacttcctagtaggggccttctgacacctcatacagatgggtgcccctctgggacaaagcttccagagaaaggaccaggcagcaatatttgctgttctgcagcctctgctggtgatacccaggcaaacagggtctggagtggacctccagcaaactccaacagacctgcagctgagggacctgactgttagaaggaaaactaacaaacagaaagaaatagcatcaacatcaacaaaaaagacatccacatcaaaaccccttctgtaggtcaccaacatcaaagaccaaaggaagataaaaccacaaagatggggagaaaccagagcagaaaagctgaaaattctaaaaaccagagtgcctcttctcctccaaaggatcactcctcctcaccagcaatggaacaaagctggacagagaatgactttgatgagctgacagaagtaggcctcagaaggttggtaataacaaacttctccgagctaaacgaggatgttcgaacccatggcaaggaagctaaaaaccttgaaaaaagattacatgaattgctaactacagtaaacagtgtagaaaagaccttaaatgacctgatggagcttaaaaccatggcacgcaaactacatgacacatgcacaagcttcaatagccaattcgatgaagtggaagtaagggtattagtgattgaagatcaaattaatgaaataaagttagaagagaagtttagagaaaaaagagtaaaaataaatgaacaaagcctacaagaaatatgggactatgtgaaaagaccaaatctacgtctgattggtgtacctgaaagtgacagggagaatggaaccaagatggaaaacactcttcaggatattatccaggagaacttccccaaccaagcaaggcaggccaacattcaaattcaggaaatatagagaacaccacagagatactcctccagaagagcaaccccaagaaacataattgtcagattcacgaagtttgaaatgaaggaaaaaatgttaagggcagccagagagaaagggttatccacaaagggaagcccatatgactaacagcggctctctcggcagaaactctacaagccagaagagagtgggggccaatattcaacattcttaaagaaaagaattttcaacccaaaatttcatatccagcaaagtaagcttcataagtacaggagaaataaaatcctttacagacaagcaaatgctgagagattttgtcaccaccagtcttgccttacaagagctcctgaaggaagcactaaacatggaaaggaaaaactggtaccagccactgcaaaaacatgccaaattgtaaagaccattgatgctaggaagaaactgcatcaactaatgggcaaaataaccagcaaacatcataatgagaggatcaaattcacacataacaatattaaccttaaatgtaaatgggctaaatgccccaattaaaagacatagactggtaaattggatagagtcaagacccatctgtgtgctgtattcaggagacccatctcatgtgcacagacacacagaggctcaaaataaaggattggaggaagatctaccaagtaaatggaaagcaaaaaaacaaaacaaaacgaaacaaaagcaggggttgcaatcctagtctctgataaaacggactttaaacaaaaaaagagcaaaagagacaaagaaggccattacataatggtaaagggatcaattcaacaagaagatctaactatcctaaatatatatgcacccaatacaggagcacccagattcataaagcaagtcctatgagacctacaaagagacttagactcccacacaataataatgggagactttaacaccccatggtcaatattagacagatcaatgagacagaaggttaacaaggttatccaggacttgaactcagctctgcaccaagcagacttaatagacatctacagaactctccaccccaaatcacgagaatatacattcttctcagtaccacatcatgcttattccaaaattgaccacatatttggaagtaaagcactcctcagcaaatgtgaaagaacgaaatcacaacgaactgtctctcagaccaagtgcaatcaaattagaactcaggattaagaaactcactcaaaactgcacaaccacatggaaactgaacaacctgctcctaaatgactactggttaaataacgaaatgaaggcagaaataaagatgttctttgaaactaatgagaacaaacacacaatgtaccagaatatctgggacacatttaaagcagtgtgtagagggaaatttatagcactaaatgcccacaagagaaagcttgaaagatctaaaattgacatcctaacatcacaattaaaagaactagagaagcaagaacaaacaaattcaaaagctagcagaaggcaagaaataactaagatcagagcagaactgaaggagacagagactcaaaaaaaacccttcaaaaaatagctggttttttgaaaagatcaac

SEQ ID NO: 198 - DNA, 37 bp, Homo sapiens
tttgttttgttttgttttgttttgttttgttttgctt

SEQ ID NO: 199 - DNA, 113 bp, Homo sapiens
attaggttgatggaaaagtaattgcgctttttgccacactagtaatagcaaaaaccacaattacgttttttttttcgccaacctaatatttaagtttacttttgcaccaactt

SEQ ID NO: 200 - DNA, 1575 bp, Homo sapiens
cactgcggcgccccggcccggcagtgccagcagcaggtcggcaccgccagcgccacgcttctcgggggccctggtgttccatggggtaccaatccaaagggttcggctcaactggtaagggcgagcagaggacctgggggagacggggctgacagaggaatgcaagctgaagctgtagcgccactcagacccctccacaggatttctgcgggaaactgcgcgccagcaccgcgtccccatgaagaaaacggagggtgacctgcgcgccacagggaacaaaagatgcgacagggagggaaaggggagtgggtgctgccacgatggggtaaatgggagagacagaatggtggcaggaaggggaaggatgagtaaagggggaaaaaagggaaatacagggtcgcctggagggggtcgaaagaagtgcagcgtgaggtgacgggtgcgcgcgctaaaggacaggaagcaatgcggaagggctgccgtttgggcgaagggaaagaagcagaggtaggtggaccacggggtggaccacctccggaatcttgcggcccgcgggcgggcaagaggcgcgcacgctccctgctcctcgccgcctgcccgcgtggtgctgcgcgcgctgcacccaacggccgcgtggtggggaagatgggaggggatgggggtaggccgccgagcatctcctgccccagaatctggcacgctgacggggacctagggacagacgaccgcacaacacgccacgttgcaggcgctgccaggccgggtgcctcacctagctccttcatgtattcatcaaagcctttgctgtccaccaggcgccatcttccttccagctgctgaactgtggccatggtgggtgcgggcgggctggcgtgcagagaggggtctgcgtcggcgtggcagcgtgctgtgaggcacccggcgccggcggctgctttataacggcggcccgcgctgggcggcgctatgcggccaatgggaggcgggcctcgcccggtccccgccccgcccgccgggcgccccctgggccttctcggggtcgggaggtgctaaccagctcctcttgccagggtacgcgacggcctctcgggcgcctcctgcaagcagggactcgcccggcgcgccccacgcctcatggacgccggcgcctgcacgtttcggcgcctctgcaggcccaggaagccagaggggtcacctggaggcctggccccgcctctcctgcacccctccgtttgacaacatatccaccgccgtttttcctttcaaaatacccggaccaatcgattagccctcgccggactcggactgcaggaagtgattgatcggctgtttggtttattgattcattaactacggtgcctccctgaccttctgctcctcgccagcgcacaagctcacaatccacaccctcctaagagaacctgctctcgccatccgcaggtctccctggcccaatagtggggatatacctgagttgagctagaggattttatccctgttgggatgggggacgtctcgggaagtgtggtttctaaactaaaagactgcaggaagtgtcaactttagtgactgtca

SEQ ID NO: 201 - DNA, 2171 bp, Homo sapiens
gatgatcaaaaaaggaaaaaaattaatcactaaggttggagaatatgtttatttaaacctagtgtctcccttaaattttataactagatttttgaccctcactcatctggctttccttgctatagacatgctttgcatacccagcttctagccacatcttccctaagaaaatttcacctggaatcagttccaaaagaaaatcttaagagatagagtatggatctgcatgttgtcagctacctaaagcagcaaaaattcctagatgagaataaaatcagggaaccttgcagtttaaggcacaccttaaatattaaatttttaatccttcaatgcatccagccaaaacaagaaattgcaaatagctaccatccatcaatgcaaggtttttttggtttgtttttcataataagattggttttaattaaagcacttataaagatggagttatattttgaactttgtccttttacttaaagcagttagagtcttacacatcataactgccacggctaaccattaaaattttccagctccttaaatgatccatcataaacttgtgcttgctgagttaactggactagaggatagctggagggaaaatgaggcattgcaaaagttacagtaataaaaagtgaatggcttcaaaataaggcagaggacataatggctcattttataataaaagctttcagtataaaattcatacatttcccttacttatatagatcttcctactttccagacatgtgtattattgtatattacatttgtcaatagctcatggcaacagatacacatagtttgggataacccttttatacctcatatgagcagtgttcaaaggtttaaaagcacaactccaaagggcacagcttgaaatggagcgggaggatgctagcaaagccaccccaataaacacaaaatcttagtaaaagcactatgtttaccaggcaatgcaacttcaaaacaaattccttagcaaccccaacctcttcaagcccgcttctaatcacattattactcctaagcctccttatatacaaaatcttaggctggccaagcccaaacacacagacacattaataatgagcatctctgtccttaaaaaatttcaaacataaaaaacctccaaatgatatgttcccactggaagaggccaaattcttttcttgtagattacccttttctatttttcattcctacctcccatgcagtattcctagattctcacaccatttgatcatttctctattttgatatttatctataagaattaatgatttttttcaagtcaaatctacaaaaccgtggatttgcttgcctctaagctatttatctcagtgagtcaggcccactgcttccatttttctggattagctttgaagaagaatcatcagcacttaataacctacctaaatccgactgaagatgctttcttgatcctatctctggtcctcctactttggcagtgggaagagctaccctataactcctcagagtcatgcacagagctgtaaaaccagcatgcagctgattttgtgcacttctctgaaggacccaagcagcaggatgggtaccttttgttcacccacccatagacaccacaggacactttttgttcacctgctcacttctgcattgaccaaacttaaagatacagattcaacagtatgtaggggaagtttccagtaaagtatattctgttttctacattggttaaatattgtaatttcatgcgggaactgggaggctaagtagttgttaccattaagaagagcaactgtgatcttacttccagcctattttggaaggtgggataaaaaatatttgtgccacaaatctcaaatcttgtctcctatcttacaaccttgaaatacatagttaattctgcagggtctcagacatcctactgagttgccaaatattgaacaccaagctgggcttgtcaacactcagggctacaaagaggagatctcaaaactaccatggcctcaggattctgaatgtgggtctgaaatccctacttcttactttggattaaaagctcacctgagctacacacatctgttgtcctagaatggatatttttatttagatatcaaccaattcaacttcactcctttattgagtcagtcaagaaatcaataaaattgacttcaaaaattgaaatc

SEQ ID NO: 202 - DNA, 31 bp, Homo sapiens
ggactcaatttgtaagcctctttattgcatt

SEQ ID NO: 203 - DNA, 32767 bp, Homo sapiens
gagagaggaggatgcagagcacagcacttagccaacctgcaatggacacgtagagtgagtgagaaatgaacctagtggtttagagcatctggaattgggggatggtcgattactgttgcaggacctaggctgtcctgctgcatagcagagcactctccacctgatacgaaataatctatgtcggaaagatcctattcaggggagtttaagatttcctccttccttttcttaatgaagttcctttcacctcatattgctacatttttttctctttacctgcaagaatctttccctggttcttcccagggctcatccttcaaatctcagctcatatgttacctcctcacagaggtccttcttgacctctttcccacccctaccccaaccccagccactatgattcacaccaaccatttcgctttttcacaaactgcatcacagtctgtaacaatcttattttctcttactcttcagttctgaattcacaatacagaatttttgctatcaaaaatgattcatagataactaatgtcatgctacttgtatttgtgaacatatgaaaattaaatgctttcaaaatatggaactttttcatttgtttaatatgacaaaaatagaccatgaatgttctatagcaagtcacatattttacatttttcaaaactacgttagtaaaagaaaaaactagctagaaatattggacagatgtccaaatgtttggatgtgcatcaagaacaaaccactgaaccttggtatttacccagtcaccattaagaggtcaacttgacattttggtttcttttcagatagttggggccaacagctcttacaacctttgacccaacccagttaaatagtagtttttgttactcattgatatacagtttttgttttatgtgctttttaaaattttactcagttcagtttaaaattttactccccaaatggtcttcctttataatgacagccagaattaatcctgacatttcagaaactattgaatggctaaccctttgttctgtgtccagggatataggtataatatcttgtcacagagtaaataatcaattcatacttgttaaattaatgaatgaaatcagtattataaaattaccaaatagctctttcatttgactttaatatatataactaatgacaataaaagatataagtgttctaattttaaaaatcaaagttttagccttgttagtttacctgtctacaaacatgtttattgcttaagaatttcagatatgtagaacttaaaatcagcatataagttttctattttcattgcctttgtaaatgtgttaaacaatactgacatttgagaagaaattcagaagctatgatactgttcttccagcctataatagatttggaaaatattctctagaaatctatctcttcaaatattaaattacaaaagtagaaagctttaggattctcttagttattagaataggatagaaagtcttgatgagaacaaccaaataaaatgttttaaaactgctatagaaataagcttgatttggaaacaaaattaagtttatttttgttttttttcttaaactttttttgttttctttaaattttctgtgtggtagtgcgtattgccaaatagcgtcccttaaaatgttgccttatctctgacattaaatgtgtaagcagcaggtaataggtacatttttcaacctatcttttacaaaaattctcatatgcaatttaaaaataacatgaactttcagaatggggttaggtgtttttttctgtctttttagattgtcttctttcaattaactaatttttaaaaagtgattacctatgaactgctaccctgttttaagagaatgtgagtaattagatggtacttagtatctataacactggacatgcagatgtgtgtgcacacacgtgtatgtgtagggtagagggcttttaaaaataattttgcatacaatgaaggacatctctcaattcctcatcactgcaacacaaccttcaaataaaaattacaaatgattcttttctgctctagaaaatttcaaccaaacacataactttcacagaaatagttgctatagaaatgcaaaggggacaaatactgaattatgctgtcaaaaaattgcaactaaagtagggcagtatcaaggtttatgtttaataatgctgactgtatgtattcttgactttatgtatactctaaattgaatgttctgagtcccaaattggaaggtacttcgctaccaaaatgaaaatattttagcatgcattctagattagaaaatcagtacatgccaagaaaggttcatttgtacaaaaatggtaaaatttaataaataatggattcaaataatgccaattacttttcttcatttcatacaaaatttcattttttaataatataccaaggtaataaatgctgtttatgacttattaaatttacatagtactgcagcttatcaataccctgtgaactgcaaaaaaacaaatacctttacagtaatattggtcatgaaaatagtggggaaaccttacaattgtgagaatgtgcaaatgttctcactaaggcagtaatgacccagacaactactgagtatgtgtcccctcaaatgcctcaaaattctgtaatgctcattgtgaaacacgtcagtgcacagtatttcaaaatttcagcacatacaaaatgtcattgtatgaaatgaagaaaagttacatttcctgcacaagatttgtagacaccttggctcacaagaataaatgctgcttcaggttttgacatgtctttcatttaatttgctaatgcgcttattttgaaatagtgtcctatgataacatttagggtaacattaacctttatgtttattaatgaaaagaagatcataggataaatctcctaaaaatgtttggctctgtttttagcttgtttggaaattatactttaaatactgaattgccaccaaagcctctggtaaatgtgaaggtagcgctcaaactcttgcagcctttgatcttgtcaattcgttttataagagagaaaaatttcatcagtcaactgcaaccttataattttaggaagaagtgattttagaagattcatacatcctatgttctaaaaccaaaatagccctattgttaaaaataagatagctgtggccaacagctcttaccacctttgtccccaagccagttaaatagtcgtaaatagttgatttttatattcatgttatgaatataaaaatcatattcataatataacatttaacctattcatgttacaaaacttaactgctggttaccaatattatcaatagaatctgctgaagagaataaaaagagggaggggagagagaaaaagaaacctctcagaaatacgatagaacattagtcacctctctacaccttcctctctgaaaatatcaatcctatgaattcaatacctttctattttacccagctttagcaagattataatcaaaattttatctgaatccatcttatacttaagtgagtttttcagattcagtttggaagaatggaagagcatgggttatggtgttgaatacgcaagagttcaaagtaaagctccaacatgtgctgtcaatcttggtcaagatgtaacacttctgttttttcatctataaaatcaaaagacacttgtcacataatgatctgaattttgtatcaatgctccattgaaattatcttcatgaagatcacccatactcttttaattctaaaatttcataaatatttagctctgattatatttcacctttttgacatatttgattgtttatcatttcacagttcttaaaagtgttcttttaatttaaagtgtttaaagtgtttttaaagtgctctttaattctattttggtttctgtgacctatccttttctgccttttttttttcctttctaggggtccatttttcactcttttgcagactgctctctctgctgttcattaagcgacctctgtgctcttctccctctgaactgtcttcccaaaatattttatccactattcctcctgcctcatggcttcaaccatcacctataagctgatgattgccctatatgtgcctgctttccacatctctgtcccaagctcctgcctattggataaattcactgggttgttctgagtgccatccaaaactccacccactttaacccaagatagaaagctggaacacatcccagactccttactctacctcattctgctctgctatcccactagtgatagcttattggttctacctctaaaatatgtatttcttcttatttctgccactgccatagttcagttcctccgggcagatcaatggaatagcctccatattattcagagtcttctcagtgttgtgataaagaatgtttgtggcaaatgctggaaccaaaatctcagtggtttagcacaataaacatgtatttcttgttcatgtcacaatccagcacaggttggtggacaggatctgcttcattcaggtgaccaggcttcttccttctagtagttataccaccccctagtagcttaaaatttcccccaaacccttgtatctggcaggcaggtgagggaagggagagtggagtttggttatgggcttgctgtatatacagtggtggagcagggacagcgtaactacaattaaaattcccattcaaaaaagggaatcagaggatgtacatgttcactaggccactacaattctacaatcctgtttggcaggcctcgagatgtcccctagcctggggagaggataaatttgtggattagattttaattctgctctctggaaataagtcttttgtctttttcttgtttgaccctcagcctttccctttagaagttcttattgtttatttattccttttggacacagctgaaatgagtgtagccaaagtaaaaaggtgattttaaaggtcagacaaagctgttttaatcagatattttggatttcttgacaatacaagttcttcaaaatcttggtaggcttctgttgtatttgcttctatgtacaattctcaggtcttttctccttttttttttttctctctctctctctccagctctctttggccattaatctgatctgtatctaagtcatagtgttcagctaaaaagtctttctgggccttgtggttctgtgtgggatctagaagcagatggatttccaccatcgttcactcaagtctggatactttctattgttttccatctggcttggaaactagccatttctgtctgagttcatctctttcttgaaacaccttaccaaaggaagccaataagagctatgacacagtaacactgtggttcttttaaaaccagtccccacaagcagcagttttcaaagcataatctgcacaattctggaaatcccaaagactcttttagtggatccatgaggtcaaaattattttcataataatattaagatgtatttgctttttctactgtattgacatttgcaccaatggtgccaaagcaatggtgagtaaaactgttggtgcttgtattcatctgttatcatgttgttaataaagacatacctgagaccgggtaatttataaagaaatgaggtttaatagactcacagttccacatgactggggaggcctcacaaatcacggtagacggcaaggaggagcaagtcatgtcttacatggatggcaacagtcaagaaaaagagagcttctgcaggggacctcctctttataaaaccatcagatctcataagacttattcactgtcatgagaaagactcacccccatcattcaattacctctcactaggtccctcccatgacatgtgggcattgtgggagctacaattcaagatgagatttgggttgtgacacagcaaaaccatatcagttctttagcataaatcaaggcaaaattaccaaattgtatcatatcattttattatgtcattgcatcactttcatcaccatgatctcacaggtttaaaaagttttgcttaagaataccctaatgaaacagttaaaatttatgcattttcttaaagctcaacacttgagttacaaatcttttaagtattctgtgggactacaaggaaagaacacataaagcacttctgctgcatacccaagtacaatggttgtcttgaggaaaagcaatgtgtgattgtttgagttgcaaactgaacttgtctctttttcgtggaataccacttttgcttgaaagaacaagtgataaacaaaatatggttattcatacttggatatttggcagtcattttcttgaaaataagtgaagtgagcctgtcacttgaaggcaaacaacctgacggtatttggtgccaatgataaaatctgagctttcaactgaaaattagaattttggaaaacttgtatccactactgtgagcttgacagcttctgaatacttaaagaatttttatgagatccatggtgatattaacaaatgttattttaaaaaatattatataaggaaatgtgcctattacataactcagtgaaataatattttccaatcaatacaagatattataaaatcatgcataggtaaaggatccatttaaagtggatttaatgtactagagtgtgaaaagtttattgatacggtttcagattccacgttgcaatatacttttataaaattttcacttttgagtcatgatataatataaaagaatgtcaacaattatgtgaaaagactattaaaatattccttcaaaagaaggagtattgttcttccaacaagaaatacctacacatctatatgggactagattttcttcacttatttcaattaagacaacatatcacaacagaatggatgaagaagcaagtaagaatctaaatgtcctctattaactagacaatatagagttttgcaaaaatgtaaaacaatgccgttctttttactatttattttgcaaatataattatcctaaaaatacatttttacagagaaaataaaattcttatacacttttggtgagaatataaactagtccaaccactatgaagaagagtatggcggttcctccaaaaactaaaatagaactaccatatgatccagcaatcccactactgggcatttatccaaaggaaaggaagtcagtgtatcaaaaagacatctgtacctccatgtttattacaacactatttacaagagccaagatacagaatcagcctaggtgtccaacaacagatgaatggataaagaaaatgtggtatgtatatgtatgtgtatatacatacatatatacacacacaatggactactattcagccatgaaagagaatgaaatcctgtcactctcagcaacatcgatgcaactggaattcattatgttaagtgaaataaaccattttctggtgctgaccagaaagttgaacaccacatgttctcacttacatgttgaaagtaaaaaaataagttgatctcacagaagtaattggctagaagaggagggggagaggggatagatatttattatataaaagatataaaattgtatataaaattatataaagatataaaattatagccaggtaggataagtaggttctttgtgttctataccactgtagaatgactatagttaacaataatatatagtttcaaatagctaagaagaggatattgaatgtttccaacacaaataaatgataaacgtttgagatgatggatatgataattaccctgatctgatcactttacatgtagcaaaacatcactatgcacaccacaaatatatccattatgacaattttaattttctttaatgttatttatgttaacatgatacttactattttcaattcattattttttaaatgtttatttcaattttaaatggtaatttttgctagatataacttataaacaaaagatttttatggtcctcaatagtttgtaaaagggtaaaacagctctgagaataaaaagtttgagaatcactgtcctagatatgaatcagcaaaatatggcctgcatataaaaaccagctcattgcctgttttataaagtttttttttttagaacacagccacaaccatttgcttacctgttgtcatgttgctttcatgttgtaatagcagagttaaataattgcaacagagatagtattactcccaaggccaactcctaaaattcttactatctggccttttacggaaagagtttgctgatccttgccctacagctttggttctcaatcctagctgttaaataatactaacgccgccttcccctcaacacatacacagaaaccatttaattaaatcagaatctctgggagtggtctttgagtaggaataagttttttaaattcctcaggtgattttgaaatgcagccaaggttaagaatcactgtgttaaactgtagagatctttaggcataatgtctgccttccaagttattccagacaacaacttataaaaattgctcccctttataacatagtttatttccagcccctaatagaagggtcctgcccatgggccaaacactaagtcaatgccacctgcactgatttgtatttttgttatatcatcaacaccctaccaccacattgaaattcaaaggtcatgttagagtgtttgctctggcaaatactttgcaaatttcagtggcttaacacaagaaaagctttatttctcatgcaaacggagtgcaatgtgcttggtagggatctctgctcctcttagggttctagctgcttctggctagagaccctgccatcccgcagtgcctccaagtactgtgccagatccctctacattcaaccagtagaagagagaaaagaaaaagcatggaggattacatgagaagtgttttaggggcccggataaggcacgcattaactcctactgcacagagcttggtcatattagccacaacaatacaaagaaggggccgggtgcagtggctcacacatgtaataccagcactttgggaggccgaggcaggcatattgcctgaggtcagaagttcgagaccagtctggctaacatggtgaaaccctgtctctattaaaaatacaaaaaaattagctgggcgaggtggcacacacctgtagtcccagctactcaagaggctgaggcaggagaatcgcttgaacccaagaggcggaggttgcagtgagctgagatcacgctactgtgctccagcctgagtgacagagcaagactctgtctcaaaaaaaaaaaaggaacaaaattcagtctacctctctaacaaagaggaaagcaaaacggtttggtgaaccgggaactggctttatcccttcatacactctttcgttactagtctcctatatggagcacccctcaggccccttgaggtaggtagaataacagcctaccagaaatgtccacatcctagtccccagaaccggtgaatatgttttatggaaaaaaatgaacttttgcagatgtgattaaagttaaggaccttgatatgaggagattttcctggattactcaggtagcctcaatctaatcacatgagcctttaaaatcaaagaacatttctggtctgtggttagagacatgtgaagatggaagactggtcagagagcgcaatgtggctggagaaagatggaggaagagagccgtgagccaagaaaaatgggcagcctctagaggctgggaaaggcaaagaaagggattttgtcgcttccagcctccagaaaggaatacggcgctgcccataccttgactttagtatagtgagacctgtgctggatgtcagtcctaaagaactataagataaattggtgttttaagtcactaactttgtggcaatttgttatagcagccattgaaaccatacacctttctcttccatgtttgtactgctgtcagtgacagtcctaaatttcaaatcttaatgggttattccttttctcaaattccttcaatcgcttctaactcattcacttaataaaaacacactaagcaactacaatgtgtcagacactctcccagccctctggattgccacttgagtgaggcaggcatggttgctgctgtactggagcttagcggatagcaactgcaagacgcaacttaaaactctttagcatgcctttagtgcctgcatgagctaactccaaaccacctgcataacaccatctcttggctcttctctgtcagaaaaaaaaaaagccataagacttctaacataacgaactcattaaacttctaagattccacagtattccatggcactttttaggacattcctggccacagtatgaaactttgttctgccctcccaactccttgtctacctagaaaacaatgacttctctctcaagagttatctcagacatcactccagagaaataagtccactcctagattccctcctgtatttctcattgcagagtttatatatccaattttgtatttattttactgaattacaattgtccctttccccaccttcattatggcttttaacagatttagagagaagttcctagtaaatttatttttaaataaaggttgagagttctcattcattcattcattctctcaaaataagttaattaaaacatatactttgccagaacttaatctgcaggaagatagatcgtatcattaaaaaaatcccaaaataggaaaacctggataagcttgtaacgaccccccttttttccaatagatcttccaacatatatctaccatccatttcaaagagcatgctttctagagaaacaaaatggtgaggaactctgagaaggctatgtaataaacatcacactcaatatggctataaaactatgattctgcatgttcctcatttaccaaacccctgaaatttactaaaactatgtgaaggtgtatagtaactgtaatttcaacatagacctacaaccaataccccaccagtggattaagtttatatggatcacatcatttagatagatttattccatatgcctacaagaactggcagaaaaagcagactttttgtaagcatttgaagtgtaagacatgaaaattatattgtgaaactattttgttgtaatttactattaagtttttcttgaaaaataagatcctggtctctctcaaacagtgacaagttttcatggaacggtcaagcactttatgcaaaattcacatcctacttagttaagtggacaagaatcatccccataaattattaaattccctcccatctggatattttatgttaaccacagtgaacattaatatattttattcagtaatatatctgttatatatgaatggtgatctgctaaataatttactatttatggagaacattttgataaattattactgtcattattgcagaaattaaactattctttagagtccaattttaatatattttcaagcatttcttgaacagtaattattttgtatctattatgtgtaaggtgcagaaggagattttttaaaaaaataaaaaactatcacttgtaaaataattaccagttggtgggtagagaaaaaatttattttgaccagagtaaaatttattctgaccacaggcacaagatttttaatgtacaaatcccagctgtcaatacatgaagtttccctgaaccttttcacttttcttttgttaagaactctcatccagcatctagcaggcgctggattcctaccggccctgcagtttagttttcctacacagttaatagtaattagctattgtcctcatcatcacttccaaacatgctattagttttccagtgggcattgattctgtaatatgcaatctaaccttctaaccactatagcacagaataaccagggaattatcccctaggaaaacaggagttcttttcacctctaagtcaatgatcattaaaaacaaccaatacactgtgaagcttgacaaatcacaatgggaatagggacccaacaaattgcagtggtgaagtcacaattatctagcaattaggtttatagctgtatccaccctttaaataatcaagtctacaaatgtacccacacttcttcctgcagaacttaatctggaaggtttctaaagctttctttcttattcaggtttctgaaagcaattgcatctgagtgaagtaataatgacaaaccttatgaagcagaaagaacagtaattcatttacttaagactaatttttaaaaggggagaataattgccaagctctatttccaaatggaatatgttctgagtcatcataaaaatttggctgccagaagagtatctagtttagtaaataatgaaggtgaatgcccaatgtttttggaatgctttcagcaacaggtaacaaacaggaagcctgactacagtggcttgaaaaaaatgagaagtatttttctcccataatgagaaatccagagtttagcagtgctgggctggttcagcagatcaatgatgccaaagactctgagatcactttactttgtcctcacaattacaaaaaagctgttgtggcttctacaattatatcccctttccaacaagaagaaagaggatgtagcaaggagaatgggtggtaccaatatttgaaagtaaaagttttattaggaagctcccaggaaacttctgtgtatgtttctttggctataattttgccccggagccagtccttgcagaaaggtggctggagagaaaagagatgcagagagaaaaagaagagcagcttttgacatttcagaaactgcagctatatagctaggccttgatgttgtgaaaagctagctatgttcataaataggccttgatgatatcctgttgaacataaacaagcttccaaatcaccaacatcagtgaccatgatgaactgaaaaaaaaaaaagaccactctataaccttgtctaagcacataaacaagatcattgtgcaaaccacaaaaataccaagcaccttcatagcctggctaatatcagtagctgctgcttctttcccagtttgattctttagcctcactttatttttcccatattatagataagatttttaaaataagcaatcatatatttacccccaattcctgatagcatccaattcagagcaaagccactttcttaagccctccccaaaaatcacctgagaccagatcctgtaataatccttccaaacaccctcttactgaaatgccccacatttcccatggtgtgtggtctcctttcttgcatctattaataagtcagacttgctcgattacaggtatgttcctggtggtctttagctggatgacattaacaacagattggatcaaccaaaccacagtatttgtcacacctttgtttcattctagtctatttataattaaaatgatgtgccttaatatggcatgcttcaaaatccttagctagaaaagtagccatggtatactgaacagagcatatgatgaaccatcaggggataaacactctagtccactctgcctaattagttaagtgaccctgggaaagtcatttaaaatgagaggaactgacctcacaataatccaaagaacccactaacactcacatgtctgagaaatggcgtaaaaataaagctccaagaaattaagtacattttccttctatttacattttgtaagtggcagaaccaggatttgaacccgggcagagtctaaaagctttccattgtaccatgttgcctcaacaggccccagcttcctctatgaactgactaggttggtaaaccagaaccagaatctagtaatggcccttttcattcaccaaagattctgaatgacaattaataatatttatatttattcttttttagtcccaccaggtctgtagatgaaaggtgcaagactaattcgaggtaatgtgcgtttatggagttttgatttttagcaagcgcttttctacatagcataaatcatagatttgatctatcatttgaacatccaagtcaaatcaattttcagttccctgtaatttaaaatatgacgactttacttaaggaattgtatgagatgctataccaagaaggactgaagaagtaaagccttaacttaagtaaggaaagcaagtgacatatcctttatctctactcaatgctaaactttaatacttttgcacacctgtttgggatcctttacaaataatagacaaatacatacaagaaatgaatttatccaatcacacaaataataaggacaaatataaaattgtatccattctaccaacaatttagtaaatattttttaaagaaataagccgtgtagaggatttgtggaaatatgcactgaaggaccagagaaagaaatgttattctttaactttcttttggaaggcaatatagaacacgtataaaacactaagatttttgcatatcatatttgacccacaaattcatcctatacaaaatcatagtggtgtagagagtgagccacaaaattgtttgtagaaatattcatagtggatgaaaattagtaaaaaggtaaaatgttagaaatttatttttaccagagtaaaatgtatttactactaataattatttattattctaagaagaatggtttaataaactatggtttatttatacaatgaaaatctgtgcaagtattaaaaatgaaatgaaaaagcactaagcaacataggcaaatgttcaaaatatattactaggttaaaaaatgtaaattacaaatatgtgattgtgtttttgttttatacatgtgtgtatataggagtaaatgaatttttaaaaggagaaatatgctgagtagttatctttggcaggatcatagatggttttattttcttctttttatttatctacattttccaaattctctaccaggaaaatatattacctttataataataaaaatatactaagtgaaattttaaaacaaatgctaatacatctcagtcaataaaaaatatactattcggtatttcaatactaaattcacttgtcctttaaaataaacaaacaactctggataaaagacaaacattctccatgaagtaaacctagctcacagatgccacgccaagggccatctttgttctgtcaaccatgaatgtccttttctttagaggtttgtttttcaaataattgttttaattatcttctctactttataatttggaaatctagcttaaaaggaatagtgtatgtgtaaacaaattctaaaaaacaaaatgatcaaaataagtatcgtttatgttataaaaatttttcttgtggtattacccacatgaacttctgagtgttgtaaagacagtttgtttacttaacatgttgtacttttatagtgttattttttgtaagccaatgcaatgttgccaatcaacaattgtgcaaatgatctttggagaatgatgttgtcaaaggaggaggttgtttttgggtcttctgttttctttaggcatttttctcttaaacataggaaggattttcaaaaatcaccatcaaaaaaagcctgtgccttatttaactgccacattaatgatagaaatttaagcatcactgaaaagagaagttgaataatttaccagcacagaacacattacaatagctaccttgtattggttgcctattgttacttatgttctttaaggtttattactttatttaaaccccacaggcatcctgcaaagcaaatatgattaccactgttttgcagatgaagaaaatgaagctcaggaagtttaaataatttgaaaactttgaaagtttaaataatttaataaaatagccataaaaataatcaggatttgaacacaggtctcagactccagtgctatgttctgttcactatgtacactatgggactggattctgatatgtctgtttttctcatttgttccatattgagcaccttagaaaatgtgtcttctcacatctataatatgaactaatgtgaagttattcaaatgcatgattctgaaaaaccttgaatgatttaggaaatcacccacaatatagttttgtatgtgacagtgagtatcagcatgtcactggtatcttcttcttccacagcttgagatacagtgttactctgcagaaaaatttcaaagtacaatttcaagttttccagtattttttttaattctttgccccagtatatccaattatccccatagtgtttcttctgtacaaaggatcaacactgtttgatttcatcttgctaatagatccaaaactaaatgtcccttcttaggctggaggtctacatgactgctctcaattctggttgttccagatcctccttactgtcttgtgttcaatgctgaagacctggtgtccatgcctaacataacctgaaggtgcctcttgaatggatcacatttggctttccttatgtccttgctcactatcatggctaccacgagagccaaggcaacccacagagatggacttgaagtgagaaatctactctgacctttgccagaacatccagctcagattttggcctaggtaaggagttcttaactgtgtcaaatttggcttgaactcccaaagttgcaactctttgcattcacggatacatccacttctattaggcaaatgggttaccaaaataatacggtttagacagattccaagtaaagctatctgtagaaccagaaccaaattttccttgatgcatttttccattcactggttggcttagtcacatcctcttaatgtattctttatcatatcagcattttttttgcactttattgacatcttgactaggtcagcattacccagtctatcccgtaggttttaataacttttaaactaaaaagaaaaaatatcttaaagtcggggtttctttcttaaaagtctttcctgtatagtatctcctatataacatccatgtaaataggctgcccaactttcctctgccaaaaatctaagctccatgtaccaaagatatgccagggggtgtcatttggttgcctctgtcttggatccctgagcccagggaaattgcataataatatcctgttccaaagttatattgtcttagtcagtttgatctgctttttaaacaaaaatacgttacactgggtggcttaagcaattgaacccacaaaacccagttccatgtccataaacataacttactctacagctttccttgagggaaaaaattacataatcttaataagtactactataataaattatattagatagatattaacttatatataatctagtttaagaataaaatagaataaactattggtttaaaggaggggtatccaatcttttggcttccctgagctgtattgtaagaataagaattatcttgggccacacataaaatacactagcattagcgataactgatgagctaaaaaaataaaaaaaaaatctcataatgttttaagaaaatttacgaatttgtgttgggaaacattcatagccatcctgggccacgaaggttagataagcttggtttaaaaaaggaagcacattaatactttcaggctaaaaagatatcatacagaaaattttatttgtgctagaagagatcagaagctacaagagcatatgaaaaaatgataggcaggaaccgctcaaaacaaagaccgcatgaggacctcctggccctgatactgttatacattttctcatcttctacaggaaagatttaggcagaaagactgtaaatattatatttctgtttgattaaaaaaactggtcctgcttaaagtatttctgaagatttcctcctgaaaaaaaatcaataataacaacaacaataacaacctctctcttcttttcttgggtcagtctggagatacatttcatttatatttgtgccagagaaagtttcttcgtcctttttcttttgttttaattagggggaaaatgttcttatcaactttacattatatcatcttatcttggttggccagaatcccagagaaacttgtataggttttaaatttctttacttttgctccctgtagagaagccatattttgctacactcagaaaaatttattgccaaagattgatgactccttacatgggaaatttaaatacacacagtgtctgcacttttagactgtttcaaatagtatatttaattttacattgacttccctaaaatcatctaatgatttattttaacctcttttatgcagaagacattctgataacaaaatgtgtaaattattcaagagaaggaaaacatgttactatcattaaagaaaaaccttatttctaaacaaagcatgattaaaatttagtccttacttctttacttatattttaattgtttttttaaaaatccttttgtttataaactaacacactgtaggaaaatagagaaaaataacctagcccttattattacaatgaatattttttaagacctgtaaactgctagtcattcctaaatcccagtggcagggagcaggggtggtggtagagagacttaaaaacagcaaaaacaaacacttcagccacactaaaatcagaattgcttgaaggaccctcatttcttttttaaatttaagttcttctaccccatctattcccattgtggtgatagaaataataaagctttaatttaaagtcgaaaattaatatattacaacagatttgagagcaaagcgctggaactagacaactttctgtaatcgaaacccacaacaaagataaattaaacttcctataattttataaattacagaaggaatacctgtaattacccacataaatgatgatgaaaatatttgcccgtaggaattggaatacatttgaagggaggctgccttgtttgccatgctgaaaaaagaaggcatgttgacacgcaggaaaatagtagtgcattttggatagcaatgagaaaaaggactttaaagaaacctgataaacaggacatggatgttttctatgaggagattcaacaagcccaactaaacaagaaatgacctgtgacaagcaaaactacccctccacacacacacacacacacacacacacacacacacacacactccaccttttcaaccagctcctaaagcgcactagctagcagataatcacctagagcaaaccaggtgtgatgtgcattttcatgtagatcaagcctgaaccatcccacccgcctcccatccccagtagaagacagttctacaggctctacaaaccacagaatgccagcatctagaaaactggcagagtttccaaatgttaatcccatcataaaagatgaacatcatttcagtccagctaaattagaaatataagatgatggaaatggcatgcattactcctataaccagtcatccaaaataaatgggctcatttatatatagctttgctatttaagagatatttgaaggcagtcaagcttaaagtataagttagaacatgtcatgtcaagcaacttagagaatctcataactaatgttatttttaccctgaatgtacagttcacattcattattccaggtagaagcttcatcagcatcccctagcacattatgaattcctaatccaagactctctcgtctataagcaatgtgtttcttctttttgctgtaaatgatatatggactccagagagcaaagtttctctgtaacacatcattccaaaaaggctcttcccacctccatccccagtagtaagcagattctttgcagagtttccatttacctacttgaacacaacggtgatttaaaaatctttatgtttattatacaatcataatgggatgaacacctttcataaagaatccagtgctcttcaaacagaagtaacttactttgtacagctacaaatatcttagtatctttttaagggaaagtatcatcaaatagaactattctcagggtagacccattaaaccagtcacaagataaagaacataggtaaatactgttcttaattgcctggacaacattctgtaactcaatcgaatactttctaaaactatatatgtccgtaaagtagtgtatcattttattttgtcacctagtacttaaaagcagtgttagaaagtgcattgagtcaaaagtgagcaattcaaattctacagctatgagcctctccatctttatttttttcttttgtcaaatattgtatgattctagaggctaaaacagttcctacaaatgcctacccagaaaggagaagcaagcaaaggaaagaagggagggaggaaggaagcatggaggtagggagaaagacaccatctacttggtcctgctctgtaatacttgaaggttctccctgtgattttattctgtctttggatctctaacaacccaacagccaccattagtcacaaaaacacatctgtgtttaaaaaactgtccacagaaaattgaagtgagtgatctatacatcacagaaacaaaaggagagagagatgtatatatatatatatatatcctttttctacactattatatataatagtagagaaaagcctcaacacaagaaataaggttattacacacaaaacttagatatcccggccaggcatggtagctcatgcctgtaatcccagtactttaggagaccaaggctggatgatcacttgaagccaggacttcaagaccatcctgggtaacatagtaagatcttatctctacaaaaaatacaaaaattagctgggcatggtggcacgcacctgtagtcctagttactcaggaagctgaggcaggaaaaccacttgagcataggagtttgaagctgcagcaagctatgttcatgccactgtactcctgcttaggtgacagagttagactctgtggagagaaaggaaaggaaagaggaaagagaaaaagaaagagaaaggaaaggaagagagagagagaaagagagaaagaaaagaaaaaaataaagttagatatgcagagattttgagatgacctacagaattcatatggatccacaatccttatagctagatccttatatgattgctccaaaaatgtacattctggacctagcacattagctagccccccaacaattcttaatttctagtagatatggcagaataatgttacatgaaatggtggtatcaagttgttatatgagaatgacaacataggaatcctaataaaatgcttgtagatggtctttgaggtcagttaaaaatcaccaaatatttttgacggcaatatctctagtacttgtacctctgtttatctgtcattatctcaagtcttagttcctattgattaaatctatttagcaacagttataaaatttttcttctagatgtgaaatggccatagggactctacttcctggttaacatgtcttaatgaatcaccacattttcatgttttcccacaggaaaggaacatggtaaaatagaaataggttaagatgtaatgatctccccctttcctgaatatgcctctgaatcgctctgtgtatacctctgcattctttcatttgcatataaggaaaccactatggcttatagcttttacaaactgatgccaataatggtcacatatcttacaaagatctagaatttattacaaagtaattaaaatcaataacaacaacaagaaaacaaacttccaaaaggtcaaaactttaaccaatctacataatcactaaaatttagcaccaagtattaaaagcaaagacataaaagcaatcctgtgatgaatttccatacacataaatattcactaagtaggaaaatacctgattaaagagttaaagaaattttatttgtaacactttccttaaagggatttttcttttccaaaatagtataaatcattgtattttagacctcctactatctactttattggtctaaagattattggtactttaatgataagttaaatacattttaacagaaagataattaaatgaacacttgaagtattaacataattacatatagtcaggcaaattctgtgtatgagatgaaatgtcattccaaaagtatctcattgctgtttttgtgtcacatttagacatgagacactgagtatatacttgtcggctaagtgttcacaaatcctactaagggcatgtattgggggacttggcattgccaggttgtagagagtacttgcatctccttgcatcaaatttggatgaaattctaaaaccatataggctgctccagaatacatccggcttctggtggataaataggtccaccatttctggttatttttctaagtaagttgtaaaaaccctccctatgtaaggcctatttgacaagtattttttctagtacataaaactagaatatgataaaaaatttttataaacataactcaacctaaaactcttgaaatatcttatggtttatgacaacacacacattcaattactggagacacatactaaatactacatatttgttgataaagctgaaactcctaaacctaccaaaaaggccttcaagactgccaccaattccattttcttcctccacagtggaagactaaaaactgccaatcaatgactaatctcccctgtttctgctatcagaacttgtctgtatacaagagcaatgtgctcatctctaggaggtgatgaacaaccattctaaggtgataatcacaatgttctttccctttgccatatagtcattttttcactctcctttgcaactaggagggatattttctaataaaagagaccaatggagctggactctccccttccctctttcttcttcttcctgcatggatatgatgcctggtgttgtggtagccatattaaaaaccgtggggccttcagccaaaggggaaaaagccagcaaatgaaggaaggagaatgcaaggtagaaagagcctatatccttgacagcatcatgaacaatgggagcaatgccagcaattttctatattcttacttcttgctctgtaggaaaaaataattccttatttactaaagccactgttggattgtggctggcaagatgtctgaataggaacagctccggtctgtagctcccagcgagatcaacgcagaaggtgggtgatttctgcatttccaactgaggtgcacagctcatctcactggaactggttagacagcgggtgcagcccatggagagtgagctgaagcagggtgggatgtcacctcacacaggaagcacaaggggtcagggaactccctcctctacccaaggaaagccctgagggactgtgctgtaaggaacagtgcaccctggccaagataatatgcttttcccacggtcttcgcaacctgcagaccaggagattccctccggtacctacatcaccagggccctgggtttcaagcacaaaactgggcagtcatttgggcagacatcgagctagctgcaggaaattttttcatactccagtggtgcctggaacaccagcaagacagaaaaagttagacccctggaaagggggctgaagtcagggagccaagtggtctagcttagaggatcccaccccaagggagcccagcaagctaagatccactggcttgaaattctcactgccagcagagcagtctgaagtcaatctggcatgctggagcttggtgggaggaggggcgtctgccattactgaggcttgagtaggtggttttcccctcacagtgtaaacaaagcggccaggaagtttgaactgggcggagcccaccacagcttggctaagccactgtagccagactgtctctctagattccttttctctgggcagggcatctctgaaagaaaggtggcagccccagtcaggggcttatagatcaaactcccatctccctgggacagagcacctgggggaaggggtggctgtgggcacaggttcagcagacttaaatgttcctgcctgctggctctgaaaagagcagcagatctcccagcacagcccttgagatctgctaagggacagactgcctcctcaagtgggtccctgaaccccgtgacttctgacagggagaaacctcccagcaggggtcagcagacacctcatataggaaagctccagctggcatctggcaggagcccctctaagatgaagcttccagaggaaggaacagcagcaatctttgctgttctgcagcctctgctggtgatacccaggcacacagggtctggagtggacctccagcaaactgcagcagacctgcagcagagaggcctgttagaaagaaaactaacaaacacaaaggaataggatcaatgtcaacaaaaaggacgtccacacaggaaccccatctgaaggtcaccaacatcaaagaccaaaggtagataaatccaggaagatgaggaaaaaccagcacaaaaaaaggctgaaaattccaaaaaccaaaatgcctcttctcctccaaaggatcacaactccttgccagcaagggaacaaaactggatggagaatgagtttgaccaattgaaggaagtaggcttcaggaggtgggtaataacaaactctgccgagctaaaggagcatgttctaacccaatgcaaggaagctaagaaccttggaaaaaagttagaggaattgctaactagaataaccagtttaaagaggaacataaatgacctgatggagctgaaaaacacagcacaagaactttgtgaagcatacacaaatatcaatagccaaattgatcaagcagaagaaaggatttcagagattgaagatcaccttaataaaataaagcatgaagacaagattagagaataaagaatgaaaaggaatgaacaaagcctccaagaaaatatggactatgtgaaaagaccaaacctatatttgattggtgtacatgaaagtgatggggagaatgaaaccaagttggaaaatactcttcaggatatcatccaggagaacttccccaacctagcaaggcaggccaacattcaaattcaggaaatacagagaacaccactaagatattactcaataagagcaaccccaagacacacaatcatcagattcaccaaggttgaaatgaagggaaaaatgttaagggcagccagagagaaaggtcaggttacccacaaagggaagcccatcagactaacagtggatctctctgcagaaaccctacaagccagaagtaagtaggggccaatattcaacactcttaaagaaaagaattttcaacccagaatttcatatccagccaaactaagcttcataagtgaaggagaaataaaatcctttacagacaagcaaatgctgagagattttgtcaccaccaggcctgccttacaggagatcctgaagaaagcactaaacatggaaaggagcaaccggtaccagccactgcaaaaacataacaaattgtaaagaccattgacattgtgaagaaactgcagcaactaatgggcaaaatagccagctagcatcataatgataggatccaattcacacataacaatattaaccttaaatgtaaacgggctaaatgccccaagacacagactggcaaactggataaagagtcaagaaccatcagtgtgttgtattcaggagacccatctcacatgcaaataaaggaatggaggaatatttagcaagtaaatggaaagaaaaaaaaagcaggggttgccatcctagtctctgataaaacagactttaaaccaacaaagataaaaaatgacaaaaaaggagcacccagactcatataataagatcttagagacctacaaagagacttagactcccacacaataataatgagaaactttaacaccccactgtcaatattagacaaatcaatgagacaaaaaagtaacaaggatattcaggacttcaattcagctctagaccaaatggacctaatagacatctacagaactctccaccccaaatcaaaagaatatacattcttctcagcaccacatcacacttattctaaaattgaccacataattggaagtaaaacactcttcagcaaacgcaaaagaatggaaatcataacagtctctcagaccacagtgaaatcaaattagaactcatgattaagaaactcactcaaaccacatgactacatggaagctgaacaacctgtttctgaatgactactgagtaaataacaaaattaaggcttaaataattgagctctttgaaaccaatgagaacaaacatacaatgtaccagaatctctgggacagagctaaagcagtgtttagtgggaaatgtatagcactaaatgcccacaggagaaaacagaaaagatctaaaattggcaccctaacatcacaattaaaagaactagagaagcaagagcaagcaaactaaaaaactagcagaagacaagaaataactaagattagagcagaactgaaggagatagagacataaaaagcccttcaaaaaatcaatgaatacaggagctggttttttcaaaagatcaacaaaatagaccagttgccagactagtaaagaagaaaggagagaagaatcaaatagacacgataaaaatgataaaggggatatcaccactgatcccacaaaaatgcaaactaccatcagagaatactataaaaacctccacgcaaatagactagaaaatctagaagaaatggataaattcctggatacatacaccctaccaagactaaacaaggaagaagtccaatccctgaatagaccaataacaagttctgaaatggaagcagtaattaatagcctaccaaccaaaaaaagtccaggaccagacagattcacagccgaattctaccagaggtacacagaagagctggtactattccttctgaaactattccagtcaacagaaaaagagggactcctccctaactcattttatgatgccagcatcatcctgataccaaaacctggcagagacacaacaacaacaaaaaagaaaatttcaggccaatattcctgaagaatgtcaatgtaaaaatcctcaataaaatactggcaaactgaatccagcagcccatcacaaagcttatccaccatgatcaagttggcttcatccctgggatgcaaggctggttcaacatctgcaaatcaataaacataatccatcacataaacagaaccaatgacaaaaaacacatgattatctcaatggatgcagaaaaggtcttcaacaaaatacaacaccccttcatgctaaaaactctcaataaactaggtattgatggaacatacatcaaaataataagagctatttatgactaacccacagccaatatcatattgaatgggcaaaaactggaagccctctctccccactcctattcaacacagtattggaagttctggctacgcaatcaggcaagagaaagaaataaagtgtattcaaataggaagagaggaagtcaaattgcctctgtttacagatgacatgattgtatatttagaaaaccccatcatctcagcccaaaatctccttaagctgataagcaacttcagtaaagtttcagatacaaaatcaatgtacaaaaattacaagcattcctttataccaataatagacaaaaatagagccaaattatgaatgaacttcattcacaattactacaaagagaataaaatacctaggaatacaacttacaagggacgtgaaggacctcttcaaggagaactacaaaccactcctcaaggaaataagagaggacacaaacaaatggaaaaacattccatgctcatggataggaaaaatcaacattgtgaaaattgccatactcaccaaagtaatttatagattctatgctatccctgtcaacctaccattgactttcttcaaagaattagaaaaaactactttaaatttcatatagaacaaaaaacagcccatatagccgagacaatcctaagcaaaaagaacaaagcaggaggcatcacgctacctgacttcaaactatactacaaagctacagtaaccaaaacagcatggtactggtaccaaaacagatatatagaccaataggacaggatagaggcctcagaaataatgccacacatgtacaaccatctgatcttcaacattcctgacaaaaacaagcaatggggaaaggatttcctatctaataaatggtgttgggaaaactggctagccatatgcagaaaactgaaaaatggattaaagacttaaatgtaagacctaaaaccataaaaaccctagaagaaaaactaggcaataccattcaggacataggcatgggcaaaggcttcatgactaaaacaccaaaagcaatggcaacaaaagccaaaagtgacaaatgggatctaattaaactaaacagcttctgcacagcaaaagaaactagcatcggagtgtacaggcaacctacgcaatgggagaaaatgtttgcaatctacccgtctgacaaagggctaatatccagaatctacaaagaatttaaataaatttacaagaaataaacaaccccatcaaaaaatgggcgaaggatatgaacataaatgtcttctcaaaagaaaacatttatgtggccaacaaacatatgaagaaaagctcatcatcactggtcattagagaaatgcaaattaaaaccacaatgagataccatcttacaccagttagaatggcaatcattaaaaagtcagtaaacaacagatgctggagaggatgtggagaaataggaacgcatttacactgttggtgggtgtgtaaattagttcaaccattgtggaagacagtgtggcaactcctcaaggatctagaaccagaaatgccatttgacccaacaatcccattactgggtatatactcaaaggattataaatcattctactataaagacatgcacacgtatgtttattgcagcactatttacaatagcaaaaacttgcaaccaacccaaatgcccatcaatgatagactggattaagaaaatgtggcacatatacaccatggaatactatgcagccataaaaaagaatgagttcatgtcctttgcagggacatggatgaaactggaaaccatcattctcaggaaactaatacaagaacagaaaaccaaacatggcatgttctcactcataagtggcagttgaacaatgagaacacatggacacagggaggggaatatcacaaactggggcctgtcagtgggtagaggggtaggggagggatagcattagcagaaatacctaatgtagatgatgggttgatgggtgcacaaaccaccaaggcacgtgtatacctatgtaacaaacctgcacgttctgcacatgtatcccacaacttaaagtataatttttaaaaggttgcctgcattagataaataatttaaaatgaaaatgccactgttagtcatgttctttattacctgcagccaacgcagcctattcaataacttctgcttcatgcctgcaatgcagtcccattggacattcatcattgccccaaacatcatacacttccctatcttcatatcttttttctacctagctttgcatatagtatttattacactttataaaatgaaagatatgaactggctgataaaatgttaagtttaaataagtggtccataatcagataaatcagtcaaaaattaatcgctttctacttatatgtaaggcacaatgctacagttgatttaaatgttgagtttttacttaatgattctatatgttcccaaatgacaatttcttgtgctttgtttttatacataaacaaaagacttcaatactagtttgatatacaagatggttgtctaaaggacaggaaccagctctcctgctgtgttttataaaatgtctacttattgctgatgctcaaccaatattaaattataataatactgctgtgggtatcatttaggttccctgacattgttacaacttgctattctgtttttgaagcgtatgagatcctataataaaattgttttatggaagtggatgcaaactacatacggtttgtcagtcagcttacctgggtctctttaggaatgtgttctgctcaaataaagacgtgttttaaaattctgtattggtatgattcaactgcaggaaagtaagactcataatttactataataaattacttctcaaaaacatttattatcagactgcaatgattctcaatcctaaaataaaaaatcattctttcctacaagtaaaccaaaggagggcaaaatgattttttaaatataaaactaagtttaaatcatagctctacctaaaagtattcctaggagattttttttatcattttttaaattattgcacttagaagaagcatataataaaaagaatttcgaactcattcacatagctattactttaaagggtatcatcgaaagttctgagatggtccagctggcatttgtcaaacctcaaagcttccaaggaagtctttatgtttcatggaattttgcttgaaattgctttagcatatcaacttaaggaatgattaagggaattaaagctagggattatccattcaactgtttgctcatccacactatttcagaaactctacaaatactttttctttggttgcttaactctatctttgtaatcagcccttcagctaaagtcaaaggggaattatctttattgaagaagtctaaaaaatttttggagaagttctttgtgatggaataaccgtcacttaaatccacttttattttactctttgacatttatcccagagaaatgaaaatgtatgcttatacagaagactgtataccaatgattatagtagctttatgagtaatagccaaaaaatggaagcaacccagatgttttgcagcaggtaaatagttaaactgcagtacatctataccatagaataccactcaacaataaaaagaacaaactattggtacactcagcaacctagatgactctccaaagaatcatactgaatttaaaaagccatttcccaaatgacaattacaaactgtgtgattctatttatataataatactttcgtaatgacaaaattttgaaactgtagaacagattagtggcttccagaggtttaggatggcataaggatagaaaggaagtggatatggctttaaaagggcaacataaagaatcttgtgattaggaaactgtttgtatcttaactgtatcaatgtcaatatcttggttgtgatatggtactatcattttataagattttatcattggggaaaaattaggtaaaaggatcactctgtattatttcttataactgcatacaagtctacaattatctgaaaatcaaaaaccttctgcccagcattgatttcctctttttataacaacaccctaatgtttcttgcagccacttttccttattttcagtccatgtggttcagatgttcaaagccaaccttggacttagtaggtggacctgtaattcagacccgatcaatgagcatagtctatctttttgaccatagtgattggttcatgaatagtcatatgatttaagttggtgcagtatactcaaacctatgggttttactaaactataagaaaggataagccctttttgctgaagttgctaagtattgttaagtaaaagctccaaccaacaggcccaccacatcaaatgtgccagtcagagaatgtagtacaaaggaaagcaaaaccaaaagatgcaaagactttagtcttaatgacaaagtttgtgaccctggattcaattgtgtctgaaagtagtatattctctggacttttcagttatatgaactaaaaatgccctgtttgtcagttaaaaaaaaagtttaattttaaaagatctttagtgaagattagaatcacattcagtatctaacacaggtatttctgtaaacaatgtagcaaagtttgaaacacttttcaccataacaaaaatatttcattattccactaccaacaattctgatttatattttatctcttaagtgcaatattagttctcctcctcttcaggtcttggtgtctcattaattatcttgaacaaagcgcttttggtgtatgctgtatttttgctgtacattttttattgagatgtaaactcttattgatttgtaagagatttttgtatattaagaataataggcctctttgtatcacatacatgaaaaatgcttttttctactggtcatctgtcattcaacctcacttggactgtttatctgatatagaagtacattttattttattttattttattttatttattttattttattttattttttgagacaggagtcttactctgtcaccaggctggagtgcagttgcacatctcagctcactgcaacctccgcctcccgggttcaagcaattcccctgcctcagcctccagagtagctgggactacaggcatgcaccaccacgcccggctaattttatgtattttagtagacacagggcttcaccattttggccaggatggtctcgagcccctgaccttgtgaatagatgtaatttttatatttacgtttgtcaatcttgttttttattgtttcagtttttttgtgttatgcttacaaaggccttcccaccctaatattacatttaaaatctaattatattttctgctgttagttttacaggcttttaaaacaagtacaaattatgtaaagaacactgtaggaatgatgtgtttccccaaattattacatattggataagcatttattcattaatgcatttttccctactgattcaaaatgctaactttattatatactaaatatccctatacatagttggatctgaggttagatgttttgtttctcaaccatctatttcctagccagttccacattgttttaacttcagtgtttttgtggtacatcttaacacctgacaaggcaaggctcattcttcatatttttgtttttcagaattcttctagctgttcttgcatgtttattcttcaaagtaaaatttgaaatcattttatca

SEQ ID NO: 204 - DNA, 93 bp, Homo sapiens
tattttattacgttggtgcaaacataattgtggtttgtgcaactacttttaatggcaaaaactgcgattacttttgcaccaacctaataaatt

SEQ ID NO: 205 - DNA, 312919 bp, Homo sapiens
tttccttattactagcatggaggggtgggactagaagacttctagtttcctcccagctcaatgaaagcaaagaatgctttcttcttaagttttattagtgtttctcagtatttctttaaccttccgtggatgaactgcctgatacactggaagtgcacaaatagatttaaaagtttcacttatgaggtaggtaattaggttttatccagttgcttacagcatgctaggtattgaggggaaagttaactagttttatcagcccctggtttgagtaagtagtagtcagtgttttgaggagttgggactagaagaaagaaaggagatttgttaaaaaataaaggtgggctgctgtgtacctaagcaaggacatcaaccttcagttatcaaacaataataattcacagaatggttttcagaaaatctaaacatagcaattaaaaatttcaagctgagatttgaagaaatctggaagtttatccttctgtctcaggaagattttatatttctgttttagcatttgaaactccagctcctgccgaatgcttctggtttcagagagctcacaatattataagtccaactgttttgtttccagtgttgatacactttacatgggtactgtgttttccagagagtggaaaagcactttgattatatacaatactcatgtgtgtatgatgggaaaagatagtcactctattttcttttttaggggaagattaacattcaactaaaggatactctgaatgatcattctacttgtgcatctgacaggttagaaacagactgcgagattacaatatattactactaattatttctcatattttcaaccttgatatgagctattttatgataagcccttgtctccaggaacctggaagtttcaagagctctaaaacaatcattcatagcagacttctttaccgtgaggctattcctgtgttcatgttaagatcacatcattctgaggaacatggctcaaaagaattaatttcaagaataagtaacattgtctaacattctggccgtagaagtgttttctcttcctatatcatgttttccacttgcgaggaaaatttttaatgaaaaacactttggcagcaaaaagaacaaagctggaggcattgtactacttgccttcaaaatagtatagtaatcaaaacagcatgatactggcataaaaacagacacataaaccaatggaacagagtagagagcccagaaataaatccacatatatatggccgtttgatttttgacaaagatgccaagaaaacacagtgggaaaaggtcagtctcttcaatagatagtgttgacaaaactgtgtatctacgtgcagaataaaaatggtcccttttctcaccatatacaaaagtcaactcaaaatggattaaagatttagatgtaagatatgaacatgtaataatactagcagaaaacataggggaaaactctatgacattggcctgggtaatgatttttttaatatgacccaaaagcataggcaaggaaagcaataatagacaaatgggattataccaaactaaaaagcttctgcatagctaaggaaacaacagagggaagagacaatcagtgaaataggagaaaatatttgcaagtaatacattttataagggattaatatccagaatatgtaagaaactcaacacaaaaagcattaaaaaattgcctaaaaacaaataacctaattaataagtagaggacctaaacagacacttctcaagagaagacatacagatggccaaaaggtatatgaaaaatgttcagtatcacttatcatcagggaaatgcaaattaaaaccacaatgagatatcacctcacacctgctagagtggctattaccaaaaagacaaaagatagttgttggtgaagatatggagagaaaggaaactttgtacattgttggtgggaaagtaaattagtatagccattatggaaaacagtatggaggttcctcaaagtttaaaaataggggaggaggtttaaaatggctgactagaaggatttcatgcctgcctcctctacttagaagaaccagaatagtgcatagacggtcataatttgaatatactatccaagagagaatgctggcatgcaacagggaaaggacagaaaacatgaaaagcaggaaagaggaaggaaaagtggcagcctgcctggctggcattggctgggagccagaagtgacttcacaacctggggaatgggtgagtgagagattttcagtggcctacatccccaccatggaatcgtgcagttctggccatgggagaaccccttgacccacccaaatcctgggactaacatacggagcttctggaagatgatgggacagaactgcttcagggagggagctcgcactgggtcccataccctttctgagacccaagctgctacatttaagactccatttccaaacctagcaaactgcatgctctcctggggctcagtggtaccaggactgaggaattatggaaacttgggctgttactgctgggacaggagagcaagctgagagccctcctgcagtcagccagggctaagaagcaagtgaggcatgagctgcagtggccaatttcagcaagcaagtgatgctgggatctgagatggagatgcaagtggggtgcaagctgctgctagaacttagtcacaagctgggtgggtgctcctgcagccaaagtggggtatgagctaggtgtgccaactactgccaccaaggcatgggggacaagccctgctgggtctggggtgtgaaaggaatgtgggttccctacttgccagaccagtctgtgggcattaaggatggctttacactctccaaggataagacctaagcacggctgctatgtatggcccttcacccaagcactctgcctcggacctgagggttgccgtgtcttaaccaactgcagctggtagctgttctcacagctggcgggcttaagcacaagaccacttggcccagctttgctcctcctcaaagacagagcacatagatcttcaaatcaaatcaattcaccacgacaggcacctgagcactcctcctgggagcctgagtttgggcctaacctcctggctgctaacatctcagctggcactttcctgcaagtgataactgtgggcttggagactggcccacccagcccatcaccaccaccatcagtgtcaacacatacaacttgggatctagagaattgtctcaccactgcaactgttgttgcccatgccatgccagcctcccaggcataagaacccacctgcccatcccatccactgctgccatttccagtatctgagcatgccattaggggtccaagaatcagcttgccagtaactaccagcataggtgccaacttatgctgccctggggcataaagataggcatgctcagcttattgctgccaccaattggggctgaagactgaagtacccagcatcctagttctcagcacaacttcaccacagcctccaataataaccatacctaacctaccaaggaaacaacatatatcaacaaggctgtttccagctaaagaaatcatatagagactactgagtacaccaaaatcaaagcttgagtatctgagcccttccctaaaagaggatattgaaaaataagaaaaagtaacagttacactagatgtgcagaaatcaatgttaaagacacagaaaacatgaaaaagcaagaaaatgcgatgccccaaaggaacaataattctttagcaatacatcttaatcaaaaagtagttttggaaatcaagacaaagaatacaaatgattgattttaaagaagctcagtgagatacaagagaattctgaaaaacaatacaaaaaacaaccaggaaaaaaatcaggatatgaatgagaaatttaccaaagagatgaaaacccacaaaagtataaaacttactagtaaagcaattattcagaggatgaaaagaaagcactcaaatggtaccactgcagaattctatcaaatgacaataagagaaaaaggaacaaagaatatataaaacaaccagaaaatcattaacaatatgacatgaacaaagcctcatataccaattataaccttgaacataaattatccacttaagatatagaatggctgaatggacaaaaaattctaattttatgttgtttacaaaaaaattcaccagtaaaggcatatatatttggcgagtaaatggacgggaaaaggtatttcatgtaaatagaagtgagcaggagtagctatacttacaccagataaaacatactttaagtcaaaaacaataaaagataaagaagatcattatataataaagggatcaattcagcaagagggtataataatactaaatatatatgcaccccaccctggaacaacctgattcataaggcaaatattactagatttaaagagagttagattgtaatacagtagtaggagacttcaacacccatctgtcaacactagacagatcattgaaacaggaaattaagaaacattggatttaaactgaacttcaaaccaaatgggtctaatgtataacaaatattctattcaacaactatagaaataccttcttcacatcagcacatggaacattcttcaggatagatcacatataagactataaaacaagtctccacaaacacaaaaatttaaattatatcaagtattttttcagattacaatggaataaaactagaaatcaataccaagaggaactttggaaattatacaaatacatggaaattagcaaacatgctcctaagtgaacttgggtcaatgaagaaattaagatggaaataaaaaagttccttgcaacaaatgaaagtggaaacacaacatatcaaaacccatgggggggattgttccaagatggccgaagaggaacagccccagtctaaagctcccactgtgagtgatgtagaagacaggtgatttctgcatttccaactgaggtactgggttcatctcattgggactggttggacagtgggtgcagcccacagagtgtgagctgaagcagggtggggcatcacctcacccgggaagtgcaagggttcagggaattccctttcctagccaagggaagctgtgacagacagtacctggaaaatcaggacactcccaccctaatactgttcttttccaacactcttagcaaacggtacaccaggagattatatcctgtgcctggctcggtgggtcccacacccatggagccttgctcactgctagcacagcagtctgagatccaactgcaaggtgacagtgaggctaggggaggggcgtccaccattgctgaggcttgactaggtaaacaaagcagctgggaacaaggcctgcatgcccctgtagactccacctctgagggcagggcctagctgaacaaaaggcagtaaaaacttctacagacttaaacgtccctgtctgacagctttgaagagagcattggttctcccagcatggagtttgagatctgagaatggacacactgcctcctcaagtagtccctgacccttgagtaacctcactgggagacaactcccagtaggggccaactgacccctcatacagccagatgcccctctgagacaaagcttccagaggaaggatcaggcatcaacatttgctgttctgcaatatttgctgttctgcagcctccgctggtgatacccaggcaaacagggtctggagtggacgtccagcaaactccaacagacctgcagctgagggtcctgattgttagaaggaaaactaacagaaaggaatagcatcaacatcaacaaaaaggacatccacaccaaaaccccatctgtaggtcaccaacatcaaagaccaaaggtagataaaaccacaaagatggggagaaaccagagaagaaaagctgaaaattctaaaaaccagagtacctcttctcctccaaaggattgcagctccttgccagcaacggaacaaagttggatggagaatgactttgatgggttgacagaagtaggcttcagaagatcggtaataacaaacttctctgagctaaaggaggatgtttgaacccatcgtaaggaagctaaaaaccttggaaaaagattggacgaatggctaactagaataaacagcgtagaaaagaccttaaatgacctgatggaactgaaaaccatggcatgagaactatgtgacatgtgcacaagctccagtagctgatttgatcaagtggaagaaagggtatcagtgattgaagatcaaatgaatgaaatgaagcaagaagagaagtttagagaaaaaagagtaaaaagaaatgaacaaagcctccaagaaatatgggactatgtgaaaagaccaaatctatgttagattggtgtacctgaaagtgatggggagaatggaaccaagttggaaaacactcttcaggatattatccaggagaacatccccaacctagtaaggcctagagcttgcccagagcttaaagtataataaaataataataataaaaaaaacaacaaacaaaataaactaaaacccatgggatacagcaaaaacagtgctaagagggaaattcatagcaataaaggcctacatcaaaaagattagcaattaacaacctaacaatgtacttcaagctactagaaaatcaagaacaaatcaaactccaaattagcagaagaaataataaaaatcagaggagttctaaatgaaatagacttaaaaaatgcaaaggatcaacaaaacaaaaaattggttctttaaaaaggtaaacaaaattgattaataaatacctatactaaccaagaagagaggagacccaaaaattaaatcagagaagaaaaaggagacattacaaccaatactatagaaattaaaaaaaaaatcaacagataattatgaacaattatatgctaacaaactggaaaacctagaggaaatagatacattcctggaaacatagaatctaccaagactgaataagaaagaaatagaaaaatgagtagcaatattgaatcagtaataaaaagtctcccaacaaagaaaagcccaggaccagatggagtcacagctaaattctaccaaatttacacagaataactaataccaatcctgaaattattccaaaaatattgaaaatgagggaattctttataactcattccatgagaccagcattatctgataaccaaagccagacgaagatacacagaaaaaaaaaaaacccaaaataaaaaaaaagcccactaccaaccaatattcctaatgaacctagatgcaaaaatcttcatcaaaatgctagcaaacaaaatccaacagcatataaaaaagataatatgccatggtcaagtggaatttataccagggatgcaaggatggttcaacatatgcaaatcaaaaaatgtgataaaacagaatgaaacaaatactgtatgatcatctcaacagaggcagagcatttgataaaatttaacatcttttcatgtaaaacctctcaacaaactggaaggaactttactccaaatgaaaaaggccacgtacaacacatcttccactaacataacactgaatgagaaaaaggcgaaagcctttcctcttagaactggaacaagataaggatgcatactttaaccactcctattcaacatggtactggaagttttaggctgagcaatcagttaaggaaaagaaccaaaaggtatcaaaatggaaaaagagaaagtcaaattctccctctttgctgataatatgatcatatatctagaaaaatctaaagaccaccaaaaaactttcagatttgataaatgagtttagtgagcttgcaagatacaaaattaatatataaaaaacagtagaatttctatgcacaagtggtgatctagttaagaaaggtatcaagaaaacaatttcatttaagacagctacaaaaaataaaatacctagtataaatttaaccaaggaggtaaaactttctacaagaaaaactacaaaaatcactattagaagaagttgaaatatacatcaacaaacgggaaaacatcttatgtttgtggatctgaggaatcaatattgttaaaataaccatattgccaaaagcaatctacagattcaatgctattccaatcaaactagacatgttattcttcacaacattgaaaaaacaatcctaaaattcttatgaaaccacaataaagcccacatagccaaagcaatcctaagcaataagaatgaagttggaggtatcacattatctgacttcaaaatatgttgcaagactatagtaaccaaaaacatatgctactggtataaaaatagacatatagaccaatggaacagaatagaacacccagaaataaacccacatatttacagccaattgatctttgacaaagcctacgagaacttatgttggggaaaagcaccctcttcaataaatggtgttgggaaaatttaatacttacatgccaaaagatgaaactgtacacctgtctctcaccatatacaaaagtacaactcaaaatggattaaagccttaaatataagaccccaaactaaaaaaaatgctagaagataacctggggaaaacactcctggacattggtctaggcaaaaaatttaagtcctcaaaagcacagataacaccaccaaaaatagacaaatgggactatgttaaactcctctgcctagcaaaggaaaacaatcagcagagtgaagagccaacctgttgtatgggagaaaatatttccaaactattcacgtgatagacaactaatacccagaatgtggaaggagctcaaacaacaggatttaaaacaaatactccaaataaaaaggcaaaagtcattaatacaaatttcttaaaataagacacacaaatggccaataggtttatgaaaacatgctgaacatcatgaatcatcaaagaaatgcaaatcaaatccacaatgagatattatcttatgccaatcagaatggctattatgaaaaagtcaaaatttaacacatgtttgcaaagatacaaagaaaaggtaactcttatatactgtgagaatataaactagtacagctgcaatgaaaaacagtatgcagatttcccaaaaactaaaaatagaactactgttcaattcagtaattctactactgagtatttacctaaagaaaaagaaatcagtacatgaaagagatacctgcactgaatctttcttgcagcactattcacaatagcaaagagatgaaaccaacctaaatgtccattagtggatgaatggctacagaaaatgtggtatatatatatacacacatgtatatatatatatatatatatatatatatatatatatatatgtatatatatatgtgtgtatatatatacatatatacacatatatatacatatatatacatatatacacatatatatacatatatacatatatacgtatatatatacatatatatacatatatatacatatatatacgtatatatatacgtatatatatacatatatacgtatatatgtgtatatatatgtatatatgtatatatatgtgtatatatatgtatatatatgtatatatatacgtgtgtatatatatatgtatatatatatacgtgtgtgtatatatatatgtatatatatatacgtgtgtgtgtatatatatatatatatatatatatatatataaaatggcatacttttcagccataaaagaataaaatcatgttatttgaggcaacatggatggaactggaggttattatgttaagtgatataagccaggcacaaaaagacaaacagtgcatttctcatatttttgtgggacctaaaaaatctgatcacatggatgtagagagtcgaaagatagataacagagactgggagatatggaaatggggaggtgtaaggatgaggagaagtgagttgaagggtacaaacatatagtaagagaaggaataaatgtagcatttgatggcacggtaggatgactatacttaacaaaaatatatactgtacttgggtgatgcacaccttaaataccctgacttgatcactatacattttgtccatgtaacaaacttctaacatacccctatacattcgcacaagtaaaaaaaaattaaaatagaactaccgtatgatccagtaatcctactactggctatatatccaaaggaaatacaatcagcatgtggaagagatatctgcgctcccatgttcactgcagcattgttcacaatagccaatatatggaagcaacctaagtgttaatcaatagatgaatgaattaagataatgtggtatatttacacaatggagtattattcagccttaaaaaacaaaattttgtcaagattttgtcaaaactcacctgatagacgactaatagccttaaaaaaggaaatttttgtcaaaattttaaattttatttgcaacaagtggatgaacctagaggacattatgttaagtgaaataagcaaggcacaggaagacaaatatcatatggtttcagttatattaaaatctaaaaacgttgaattcatagcaatagagagtaggatggtagttaccaggctggggcagggagtggggctggggagatattggtaaaaggaaagaaaatttcaggagtaaattcaagagatctattgtacaacatggtgactctaattaataaaaatgtgttatattcttgaaaattgctaagaggatacattttaagtgttctcaccacaaataagtatgtgaggtgatgtatatgtttattagctcaatttggcctttccaaaatgaaatatgaaatatacatatttcaaggtatcatgtcatgcatgataaatgtatacaacatttatttctcaactaaagagtaaatctgaaaaaaagaatacttcaggagaaaaagaatcttgtcacaagttcagagttataattctttttaaggtatttagtgcttgctcaacatgaaaacaaattaacgacataggattttgttttattttctgtttatgaggacagcagcaaaagagtggatgccacttattgggcagccactgagcactgggaattttggcattattcatccatgtagacttccaacaagtccacagaattgtgattcttgtttttcagatgacgaaactaggacacagagaggttaagcttcctgcccaaggtcatgtagctaataagagctggcctccctctctacaaaggttatatatcttttcttatactacatgggattttaaagaagtactatttttccattttaaaatgatttttcaatggcttaacaaaaaatatgctttcaagctattattagaaatgacctatggaatttatttagcatgcaattagaataagccacaaaatacatccattcgtgatttgaaaagcagtggttaggtttggagtagtaatttaggttctagtaggatcacctcttcagtattggaagggccttttaatcccctcatcaaattttcaagtgtaaggattccctttgccacatccactaggagaactacttgagctcatatagtgatagatatgcactactttaggtagaactttccatttttgaacagcttgaatgattggtaattctacacatttatgtattctttgccgttggcatattactcagctttttaacacattttgtttcattcatgaatgcttctgtttattttgagtccatgactgtcctatttactttcactcataggagcaatgaagatttttttctatacgaatatggtacatggggaagagtttttgggttaatgtttctaatttaatattatgtattatctttttgctgtttgttttggtgaacatatttcttgcagatttgacaataatgagtatttgcttttcttttttatgaagtcccttctataagatcgagctttgctaatgcagctctgtatttgcactgcacccttaaaaccagcatcttggaaggcaagaatatttctgacccataggaatagcttgccatcttagcaacagcagatctgtttgtgaatagataattacaaaatgaaaccttggcaaacaagaatgttcctttagttttaggaatggaaattttgacttttgatttacttattaattccaatatggaaaaacacaaaaaggaattttatgttacataccttcaattgcacttcttgtgctctttagatacatgtggcctgaagttttgatgattggaaaaaacaagcattgctgttttttttccttccaatttggaaaggtatcatatatttttaacttgagaccccttagtataaataaaatgcatccttgctttttaccacattcttcattctaatatataaggtgctagtgtgcagaagggaatatgaaatcaggtatgattccaaaaatgcatatgcaagacacatggataaaatcataaaattacactagaaccaattctaactcctacatgactagaatctatggaacatggttatgtgtctcctggttaagtatcaaccaccctctggatgtagttttagtgaagtttatatccctataattgttgtttgataggtagattttaccttttgtggataagtatgctctgtgatcagaattaaaggtgtgttcatcattacttttatctgatttttcactttgtcaaagaagattagaatagcatgtggaacttgattcaactgtgatattttgatatattaagaaatatatatttgggttttatccctagtttctggcatagaacttctaaaagccttggaatttccctagtgatgggagtaagagtagtttcttattcataataagctcctgtcacatacctgagtttatgctaataagacgacctgtggtgggtccctagatagcttcaggatgggagctggttgccagacgaaacaaccatatgattaaagggttggaactttgagcccagcccctgacccctggagagaggagaaaggctggagattgaattaatcacaaatggttaataactcagtcaatctcatgtattcataggggaatctcatgtattcataggggaatctccataaaactcctaaacaatggtatttaaggagattctggcttagagctgttcaagtaaattattgagcctgaggagggggtcatggaaactcttgatttatagtccattgaacagaactataggagactcaggacttgcattggtatctgaagtgagggtagtcttgtgggactgagtagggtctgtattaactctggttagttagtgctaaaaataaatggaatcattggatacccagttggtgtctggagagttagagaattagttgttggtatgggaaaaacaaaacaaaacaaaactatgcatttgatgtcagaaatatgggtagaaacagaccatggtatcaataatactgatttcttccaagaatcatccccttaaagggtttacaaatggataaaattgatattttcctaattattctcatttagagatattgtttcaaactcacagatattcatttcctctttaagataaattagcaatgagtgaactctttctcagttttctagctcttcctctaataatcatcttcactccaaaatggtagctagtggcctgtctatgagatacatttttaaaaatatgattggatttaaaatacattgcctattttatgtgctggatttatgtaataaccaccatttattgagtgctatagactggtcactgcgttttaatcttcaattctgagttaagtagcattatccccattttgcaactgaaaagactgatgattggagtggttaagtaacctgcctagtgtcattagtaagtaagagggattttctgaagaggtggaagtgaatattgatgggaaagggaaaggtgatcaggcagatgctatggtctgaacgtatctcccaagatttgtatgttgaaacttaacttgccatggtggagcccttagggatgggatgagtgcctttataaaagaggtaccagggaactgtcaccctcactttttgctcttctgccttaggtgaggacatggcaagaaggacctcaccagacaccaaatgccaacaccataattttggacttcccaacttctagaactgtagaaaatactgcccagtctcacgtattttgttaaagaaacacaaacagactgagacaacaaatgagtagaagttagtgtgaagggcagtaagaagaactggccatatttagtctgaggtatattgagttgagaacatgttacttatcttcagttaactaaattttggggcttatagttcttcttgcgtaattccaaagggaagaaaaatggtgagtgtatttttgcttgcatataatgatatagaggaaaatatacttctaggaagcagaattctatactcattttcaccccatccataagatgcccacatataagttttccgaagaaggacttattaattgtaattgtcataagatgactggataggatcatcgcagacaactttttctctaaaagtgtttaaatagacgccagactaattgcaaataatgttatagaaaatattagatttagaggtttggataaatagaccttagattctatgaaagtaaggatatagagcgtgttttaaaacaataatagttaaaaaaaaaatggtttctgagctgggtgccgtggctcacccttgtaatcccaacactttgggaggctgagacaggtggatcacaaagtcaggagttcgagacaagcctggccaacatggtgaaaccctgtctctactaaaaatacaaaaattagctgggcatggtggcatgcacctgtagtaccagctactagagaggctgaggcaggagaatcacttgaacccgggaggtgaaggttgcagtgagctgagatcatgccactgaacaccagcctgagtgacagagtgagactccatctcaaaaaaaaaaaagtttctgtatttatgtcctataaaatcttactgtgctatctataactttctaagtaatatccatttttttccgatgtgtaccaaacctttgtgaagcagtggaatgtttatgaagcagtatgataagcagctctccaggctgacatagctaatggttatttattgtaaatatacaattgtattgtacaaaacatatagccagtcagaataatcaaacctcttttttattccttgtcccatttttgtctcctaaattatctaagagttccggctaaagaagactttcagtggtgcattattcagggaactatctaggccatactttcagtaagaagttgaaaacaaaagaagttgataacaaacttattttcttctgttgtgggtttttagtacatattgatcacactataatatgagatttgaagttctttcaaatgttttcacgtcccaaggcatttgtgagaataaacttttttaatagtctctttttaaaatcagaaaaaggctagtaatgaagtgcaatcagaaggatgtttgtattctttctttaaacccacatgactttatgtcactggctacctgtagaatgacaccagcctcttagcacatttgcaagtgattaaacaacaaggctgattcaaaagacactcataaaattctgaccatttacagccatgcatatctgctggatggataacaaaccaacaaactttataagcgactatccaaattggatctcttttgttatttttagaacaagtgttaaccaagtatttcttttgaaatgttgaagcatttccttagtttaatttttacacattgaatttctgattggctttgaaagaagtctatataatgaggaaggcaattctcaaaatagtcagaagctatcttgaggagacttgatggaaacaagttaccaagtttgacctaaaactggagcataagtgttaaactgccccccaaatatactggaggacagaatgctcagggagatgctagaaggataaataaagaaaacagaaaaaaatggatggctgtggcctcatttttctactctgacagacaagcttaagtctgctaattgaggaaagttggacaagggaagatgatgttagggagagaacactaattttgtgtcttgttgggaaagacacaatctttgattatacattcttcacctttctaaatgctgtgccttctgatttgatgttttggaacctcttactaagcagtgagactgagtttttgagcacttgaagacattttcctgcttctgataaccagtgaacaaatacggtaatcaaacaatagacacatagacatgtactcagtaaggtaaagagcttggtaccttggtactatgggtcaatataatggatcacgataagacagaatgtttcatattaaggagaatatatagcctcagaggagatggaatatgtgtgcaccagagtttctctgtgtcctaatgtaattttttaccacataggtcatggctgattactctactaaattggtaacaaaataataggtttcattggggttttatcttaaaatgtgacatctgaaagtataaaatatttatgaaagttaggcagtatttataagtttgtggaattcttagaaaaaagaataaataaaatatgaagtccctttttctattaaattatattatgtcattttgatgtattttcacatttgacttttgtaacatgaaaaattttataaataaaaatacttgacagttctatcaaactaagggtagagtgcatatttcaattaagtatgactgcaagactacaatctcttaaataacactacaaccaaaactccacggtaattctaaagacaactaatctaagtcctaggtggaaatagacagacacttgaatatgtcttaaaaatgcaattttataaaggtggattaaatatgccaaagattttccagcattacaacaaaagggccatttaggcagctttataatcttatgtgtggatgttcatgtttattcctcgaattcttattaaccttgtaaataaatattcatattgtgcctaccgtcttgcagcaaaggacaagagaagacatgattgtggtctctggacactacaagtcttttatactttttatatcccacaaaaagtatccatcagccattatcatgctgtatttgtatattgagttcacaaaagatacagcttagccaaaatgtactctattttaggcctgtctagttgtctaaagcattgtgtttctctaggaaggtatgtcacttatttaagaactttatcctgttgggagcatcaagatattaattatccttattgcttctactcctcttatactatttttatcaaacatttggattgatagctatcatatcagtccaactgaactgctgcaagtagcagaaaatattcaatatggtagcatttgcaggagattattcttagagaatttggggtatggaatttatttatactaattttcatcggaacatatagttctttagatattgtttaattttagttatgtacccctcaaacacacacacaaaacaaagcaaatactcatacaacatacataggaaagctaaatccaggttttctttgaataatgaacaggttataaatcaaataaacagtcttcccattatgcactttggataacaaaatagtaatgatgaggtaaactcttaatgaatgatgaatatatgggcagttcctattatgtatacatatatcagatgaatttatcgatcccaggagacagtttttatttttttaataaaataagttttaatgtaataaattattatttattgaaaagttatgtgccaggcaccacacaaatgatgcacatgaattaactcatcatcataactttgagaaaataatggtatgtactatttttaaaatatatattatattataaaattgacatttggaaagggaatcatttagattagctcagagaaggagaatcagagtgatagagactcgtggacttattacaggggttagaccttacccatttatgggagccagtaaaacagtccgtgtaaggctgttgcttttgtatttgatgttgggcctgctgtcagcagagaaggcaataagataggaaagatggacataaagtggtgattggcaaggacagacttgactttgaggacacactggagaccatggggacagactggaatcaatatctgtctgccctgaacctctgtgatgcaggtaatctgcagtagaagcaggcatccttcactacatagctgcatgtgcacctaactcaggtttgacttgctgaagtaggagcctgatgacttggagacctggctgctgtcctgcaccaaaagatgaaccagcaggtcagtaacagtgttcatgggctgcagcagtatttgccctgtatcaaagtttacagcataaaagtgactaccactttgattctgcattcaaatcttgtaaaaatttccccttaactgacactaatctagaccataccaggggaagaattcttggaaacacattttcagtttagataaatagacaccctatatctctatagaaaggttaagcaacttagctagatcacacatttaataagccatagggccagtgtagtgcatagtcaggttgaatacatgggatgagtggaagcatcaaatgtcctaatgtcttgaggatgggttgtttggggcttggaaatgaatttctaggatatcctacaaagattccagaagtgtggtatcacacatctgagatgggaagtgaggaatgtgccagaaaccactgtgctagaagacatgaactcttactgcttattaattgtgcaaagtgaaataatttattcatttcttaactaaatacattgaaaaactatgtgtcaggcactgcaataagtatcagaaataaaattgtaaacaaaaaagacaaataaataaataaacaagccgtagggccaggattcacacccagttctgcctaacaccaaagtcttagatatcattaaccacagttcaaggggcctattgccttttactttgcaggtcaagagaatatattcaataagtaattcagcaaatatttgagaacttttttagtgttgaacactgtgggtaaacacaaagaacaaaaagacacagacccttgctttccagagcttattttaagagaaaatttggaagagctagaaaatagaagtggaaaaagggagtcagcagaaagctgatcagagaaaaacaagatcagagggcgggaagagagggtgcagatataaaggaaaagctttgtcctggttgtggtgggtgcacaatggttaactctatgctatccttgctcacaaggaactttctgtctaggtgagtggcttatactttagaggggaagaaggagcattaatgattggtcccatctgggattcttctcttagaaattgacccgtgttcctctgtggcagtcttactataaattatgagttcttacagtgttttcttctaaagatggagtcttagtctattagagctgctgtaacaaaaatgtcataaattgtatagattataaataacagaatcttatttctcatgtcctggaggctgggaagggcaagatcaaagtattggtagattggtgtctggtgagtgccaatttccacgttcatagaaggcaccgtctcactgtatcctcccatggtggaaaaggagctagctagctttccgaggtcccatcaataaaggcattcatcccattcatgaggactttgcccccatgacctaattacctcccaaaggccccacctcctaatgcccccatgacctaattacctcccaaaggccccacctcctaatgtcatcaccttggggattaggattttgccatacaaattttgtggggagacaaacattcagaccatatcagagccctcaagcctagaacacacacactgatgcagttcttagggaggtcagtacttcatatatcccagcattttctgtgaaaataataaatcatggtctctggagtaaatcctttctaaagtgttacaactatgtaggagtctcagtgttcacattattattcagcagaaacaccaaacgaatgtataataaatgtagcacttattcagtttacatatatgtattagaaataagcctgttttaaaaaattataatcaaaatgtagtttgaccttatttaaatattttctatctttttacttatatattaacagatattttccattttaatttccagtgctctggggtatatgatgaatgtccaatatagcacaaagcagtaaatttctctttattgttgttatttattgttgagacatgcttcattaaacagtccctgtcttgttactgaaacaacttagtatggttttgcacaactaatggttttcatcagcattcatcattgaattgttttccaccgaagaaattgggttggtgttttaaatgttgtctatgttagaatgggcaattatattaccaaaaaggtagatgggtaagttttaggaagaagctaatttaaatcagtcaataaaatggtctctgtagagagttgcatgatacttatagaaatctactgcttatgcttttatttaggaggttaaatacctattattttctctgcaacttgtcaatcagaaagaaatacaacattagttttggcttgcaatgattagaatgggcatttttttcttttgtgaaggaaagtgtaatgagctaagatccaggagtattatagtctagctgagttatctatgaccctccacagcctcatcaataaaatgacagaagggctgacatcttttctctaaatttccttcaaattctgatgctttatagttatgaaactatttatttttaccacaaaatatccctttcatatgttaaaaaggaatgaagacacacagagaattagcttaccaaaaagcattaggagggagtctcctataatggaaggagaacccagctgggaatgtgaagactagagttccagttttagctctgtcaatagctagctttgtgacctattcagtcttccataaagttattttcagttctaagattctgtgggctcaaccatgaagtaaaattcagcgtaaaggcatataactctacctgatattattaggaaataaactttggacgtaggaagatgtagggaaccttgggtgtgatgaattttgtttttttccttagcatctaccttgttaggtaggtgttaaaaactacatacatagctttctagattacttttgacatgactttgttgaggtttgaacaggtgtaggatcattaccctgaccccgtaaatcctctctgagtttggaactggttgagaaattgtcaagagtcagatagttcaggattaaatgatcagctattaacattggatttgtgtgtgagcttagatgcttcctaagtagtggaaaattgaattgtttctgtttttccttaagcttatgctttgggataatccatcagaacaacgtaaagaaggccaacttagatcgttactgcctcatctctactgaaccctagtagaggagacagggggataaggtgctccaagaaggaagtttgagccttgacccacgtatatttactacattaagtttaggatctagaagagaaggccagcggcaatgagagaagaggggaattcactacaaacaattgggatttgtggtctggaagaagtgtggatctgaatacagacctctgtaaagatattgttagttcaccctttcttggaggcctcaaaatatttgtcaccagggcctgttgccctcataaaagacccctattctctacatatcttagtgactataaaggggctgagccatacttccagtgtcttgttttaatctccccaattacctgtgtctctcctcctcatttaaaaaacacagaagatatgtgaggactctagaggaagtgttattccagaagccccttcttggaaacatgatactaggacattggcagttttccctaacagactttcttatctttctgcttgtggcagcaaatatttattagaaatacattttttcctattaacattaaagctgaatatactcaaggcaagctgatgtccataaacaattatgcatcagttagccagaaattttttttctgactcttgggtgttaatctggggaaaacatattaattcttgtttaaggattctatagaagtgttctggtcttctaaaaggtccttgtaagaatgagttagtataaggtttgctcatgaagctcaaagggctgtttagaaatcttcagatcatagtgagatttgtttctctgggggaactaacctaatacactgctaatcactgttgccctagtttctcctttacaaaagttttggactgtcatatttggttttatattagatcatgctagattagctttcttgcatgtagaagaaatcctgggagctttgatgatgatggcaaaaatacagatgccttggtgtagcaattgtgtaaatatggtgtagcctagagaaaaaggacagctctcatcctcccaaatgtccctttacctgtctttgtgaatatactttataaataatctccctcattctccttctatatacatcagaaaagataggattagaattgtgtcagagctgggcaagaatactaagggatgttggtgactagaagaccaggaagacaatgaaatagaaaggtatctagaaatctaaaggctagaaataaggtaaaatctaaaataaaactaggatttgtgctagcaaagcagagctgaccacgaattcaattaccaaaatctgtggctgttactttttgacgacactgaaaatctacacaagtagtcttgcagtgcatcaattaaatgcaaagaaaaaccgtaaagctaagtgctattccagatgtgtggaggatggagaagacaaagccctgtttttattacaatcttgagctggcttgcctgggttagaatcttggcttctcatgttatcttggataaattgtttaaagtattatatctgtgttttagtttcatcatctctaaaatgaggttaaaaatagtacctactcttctaagaatgtatattttggctggggtatggtaaagttagtgcagccgcaagagaaaacaagaacaaagcttagaaaggaatttattctactcacagggcccaatgaggtagtcaccacacaccatgcaggaccacagggggaaagcaccagtgtcagtcaagagccagaagacaggaacaaggggcaagtctaggccagagcctttcttgaggtttctgtgcgaaaaggaaggcagagcagagtaaacagtttaggattggccagtttgaatgattccagaggactttgggctataagggtgatctctagttgcctggtaactgggaagatttagggcaagggaaatattggtttgttgtgtgagagttagataaggagtttggggctgtagattcaggattggttggtttgtacgtgagagctgtgctctcagctaagaccttcgccgactctcagaattagccagctctagggaagatagtctctttctgggtctgtaaggccaccagattctagagcatcaagaactatagaaattaagaaaatgtagtttaataaagctggccctgttttgaatggatgcctcacagacgaatacagaatccaagaaatcacagcatacctaccttattgtgaggtttaatgatttaacacatacatagttgaatgacccagactggttgcatgtccccagtctaactgcatgagaggttggggcatagagaggagcacatagaatacttgaggaacacggctatctgtgctgtgcagatggggctcagaacaactatgctttgtagagcatataggagagtttggaaggccattgggatactttaaacaattggctgtggtgagtgctatattgcacagaataattaagttgaaacaatatatatatctacatgattttcaagcagctaattttataaaatgtgcttgtaagtatatagagcatcaaatggactaaaagttatatacagaattttaaacatttttactggtttgattggccttttgttgatatccaggatgaaaaacagggcacaaaagaaaatgcactaataagggatgttttattttacatcacaatagagatcagtagttactttggttgagacatgttggagacagccatgctgtctgtaggagggtaatgtgagcctttaggaagccatggatgtgacactatgaaggacaaattttgccatcgctgccaccacgcctgtgaaactgggttaaatggtggtggtggggaatggatgggttttggcctggaatctataagacctgagtatggatctgtctttgccacttcttaactatgtgactttgagccattccctatgtaagatggagacaacaatgatttgccaacctggtggtagggtttcaggagatgtttatgaaagtatttccagagagagctcatttccactctcctagttctgtttctatcataatggctgccccacaggtatcccaaatttcatataaacttcactaggaaagtagatatttcactcttgcaattcttatgttgtttcattgtatatgtaaatggataaaagtttaggctttgcattgtctgactttacttctctaagagttagtttactcatccttaaaatgatgatgataatagcatcaacctaatgggtagttacgataattaaatgcagttacacaagtaggacactcagttcctgacacataacaatcactcaataaatggttgctgttattagtttcatttcattacacatgaaggactttgatctacacttctgagatttagatgcaaaataatctatgactcattagcagaatcagtgagaaaataagcagaatgagtgactaatgttaagcagaaactattggtcaaaggaactgctatgaaaggacaaatgaatcttctatatcttcagcaagcctctactatagttcagggtgtttcatagagaaactataccactaataaaaagctattgacgttttgtaattctaaaaaaaaaatgccaccaaattccttacatatcttgattcacaatgaacttttattgttacattggcaacttaaagtaaaaataaaagagctattgtttcacttagatggaaattatttaagaaaaaaatactctgatgactgttcagttatataactaacaagcatctattcattgggcactgaagtaggtatctcaggagataaaatgtcaataataactaatatttgccatgaaaaaatgtattcaaagcaatgagaccaggctggtactgagagccccaaaacgttaattcttccttattcctcctgaggaaattttaagtgatttggagggataagacatatgaaaaataaggcttaatacaagaaacagttaaaagaaaacaaaaacaaaccctatcacttgagtagagcctgtagggaatggcataggatttccacggttcatcctcaagaaaagcttctaggggtggtgggattttaatgttcctgggagcagtagaaattgtgagataatgcctggtaattaccataaacttgaagccaaatagctgggaaaacatgttccaggacattgcagatcaaatcatatttctataaaaagaatctgctggatgttcagctgacagaatatcaaccataaaaggatagtttaatggatttcaatcattatctaaacacaaaatcacagagccaagtttatgtgcattgttaatcatatgctgtgaatccggtaaaagaaaatgtaatacaagcatcagatgagatgttttttcttttctgatttttaaatggtaacattttatttttgagaaccattaaaaaagagtgattgcttggagcagccatctaagggaagtccattctctttgtaaggaaacaaaatggtgctccagtggaagagctctggaaacagtgagtggttcatagagctactgaattccttgcttttgctaatactcaaattttaaaagaaaacatgtcccaatccaaggattcttgtgatatatttgtgttggtgtgtgtgtgtgtgtgtgtgtgtgtgtgtgtgtctaaattttaaatttatattttaaaccagcagtcacttttcccattttaaattatacaatcacttagttgtttcctgaactattttaaatcaacaagttttctttgaaaatatttttttaaaaaatagatcttgcagacttaagaaaataagagtattccttaaggtagatggtgtaaaataaataaaatcagtagatttctaacacgttcttgaatagaaaacacaaacggaaattatcccatttacatttataactaagcaacatttaatatctagaaatagtcttaagaaatgtaaaatgaacaagatatgtaaaattataacattttatatgataataaaagatttgagaacattacaaaacatttgattaagtggggagacacaatttagaaaaagtaggctttattttttaaaagaggtcaattctgtttgaatttattctatttgcattgtaatatcaatcaaaattctcatttgctgtgggaaggtggtgaggagcttgataaaatgatttcaaattttactttgaagaataaacatgcaagaacagctagaagaattctgaaaaacaaaaatatgaagaatgagccttgccttgtcaggtgttaagatgtaccacaaaaacactgaagttaaaacaatgtggaactggctaggaaatagatggttgagaaacaaaacatctaacctcagatccaactatgtatagggatatttagtatataataaagttagcattttgaatcagtagggaaaaatgcattaatgaataaatgcttatccaatatgtaataatttggggaaacacatcattcctacagtgttctttacataatttgtacttgttttaaaagcctgtaaaactaacagcagaaaatataattagattttaaatgtaatattagggtgggaaggcctttgtaagcataacacaaaaaaactgaaacaataaaaaacaagattgacaaacgtaaatataaaaattacatctattcacaaggtcaggggctcgagaccatcctggccaaaatggtgaagccctgtgtctactaaaatacataaaattagccgggcgtggtggtgcatgcctgtagtcccagctactctggaggctgaggcaggggaattgcttgaacccgggaggcggaggttgcagtgagctgagatgtgcaactgcactccagcctggtgacagagtaagactcctgtctcaaaaaataaaataaaataaaataaataaaataaaataaaataaaataaaatgtacttctatatcagataaacagtccaagtgaggttgaatgacagatgaccagtagaaaaaagcatttttcatgtatgtgatacaaagaggcctattattcttaatatacaaaaatctcttacaaatcaataagagtttacatctcaataaaaaatgtacagcaaaaatacagcatacaccaaaagcgctttgttcaagataattaatgagacaccaagacctgaagaggaggagaactaatattgcacttaagagataaaatataaatcagaattgttggtagtggaataatgaaatatttttgttatggtgaaaagtgtttcaaactttgctacattgtttacagaaatacctgtgttagatactgaatgtgattctaatcttcactaaagatcttttaaaattaaactttttttttaactgacaaacagggcatttttagttcatataactgaaaagtccagagaatatactactttcagacacaattgaatccagggtcacaaactttgtcattaagactaaagtctttgcatcttttggttttgctttcctttgtactacattctctgactggcacatttgatgtggtgggcctgttggttggagcttttacttaacaatacttagcaacttcagcaaaaagggcttatcctttcttatagtttagtaaaacccataggtttgagtatactgcaccaacttaaatcatatgactattcatgaaccaatcactatggtcaaaaagatagactatgctcattgatcgggtctgaattacaggtccacctactaagtccaaggttggctttgaacatctgaaccacatggactgaaaataaggaaaagtggctgcaagaaacattagggtgttgttataaaaagaggaaatcaatgctgggcagaaggtttttgattttcagataattgtagacttgtatgcagttataagaaataatacagagtgatccttttacctaatttttccccaatgataaaatcttataaaatgatagtaccatatcacaaccaagatattgacattgatacagttaagatacaaacagtttcctaatcacaagattctttatgttgcccttttaaagccatatccacttcctttctatccttatgccatcctaaacctctggaagccactaatctgttctacagtttcaaaattttgtcattacgaaagtattattatataaatagaatcacacagtttgtaattgtcatttgggaaatggctttttaaattcagtatgattctttggagagtcatctaggttgctgagtgtaccaatagtttgttctttttattgttgagtggtattctatggtatagatgtactgcagtttaactatttacctgctgcaaaacatctgggttgcttccattttttggctattactcataaagctactataatcattggtatacagtcttctgtataagcatacattttcatttctctgggataaatgtcaaagagtaaaataaaagtggatttaagtgacggttattccatcacaaagaacttctccaaaaattttttagacttcttcaataaagataattcccctttgactttagctgaagggctgattacaaagatagagttaagcaaccaaagaaaaagtatttgtagagtttctgaaatagtgtggatgagcaaacagttgaatggataatccctagctttaattcccttaatcattccttaagttgatatgctaaagcaatttcaagcaaaattccatgaaacataaagacttccttggaagctttgaggtttgacaaatgccagctggaccatctcagaactttcgatgataccctttaaagtaatagctatgtgaatgagttcgaaattctttttattatatgcttcttctaagtgcaataatttaaaaaatgataaaaaaaatctcctaggaatacttttaggtagagctatgatttaaacttagttttatatttaaaaaatcattttgccctcctttggtttacttgtaggaaagaatgattttttattttaggattgagaatcattgcagtctgataataaatgtttttgagaagtaatttattatagtaaattatgagtcttactttcctgcagttgaatcataccaatacagaattttaaaacacgtctttatttgagcagaacacattcctaaagagacccaggtaagctgactgacaaaccgtatgtagtttgcatccacttccataaaacaattttattataggatctcatacgcttcaaaaacagaatagcaagttgtaacaatgtcagggaacctaaatgatacccacagcagtattattataatttaatattggttgagcatcagcaataagtagacattttataaaacacagcaggagagctggttcctgtcctttagacaaccatcttgtatatcaaactagtattgaagtcttttgtttatgtataaaaacaaagcacaagaaattgtcatttgggaacatatagaatcattaagtaaaaactcaacatttaaatcaactgtagcattgtgccttacatataagtagaaagcgattaatttttgactgatttatctgattatggaccacttatttaaacttaacattttatcagccagttcatatctttcattttataaagtgtaataaatactatatgcaaagctaggtagaaaaaagatatgaagatagggaagtgtatgatgtttggggcaatgatgaatgtccaatgggactgcattgcaggcatgaagcagaagttattgaataggctgcgttggctgcaggtaataaagaacatgactaacagtggcattttcattttaaattatttatctaatgcaggcaaccttttaaaaattatactttaagttgtgggatacatgtgcagaacgtgcaggtttgttacataggtatacacgtgccttggtggtttgtgcacccatcaacccatcatctacattaggtatttctgctaatgctatccctcccctacccctctacccactgacaggccccagtttgtgatattcccctccctgtgtccatgtgttctcattgttcaactgccacttatgagtgagaacatgccatgtttggttttctgttcttgtattagtttcctgagaatgatggtttccagtttcatccatgtccctgcaaaggacatgaactcattcttttttatggctgcatagtattccatggtgtatatgtgccacattttcttaatccagtctatcattgatgggcatttgggttggttgcaagtttttgctattgtaaatagtgctgcaataaacatacgtgtgcatgtctttatagtagaatgatttataatcctttgagtatatacccagtaatgggattgttgggtcaaatggcatttctggttctagatccttgaggagttgccacactgtcttccacaatggttgaactaatttacacacccaccaacagtgtaaatgcgttcctatttctccacatcctctccagcatctgttgtttactgactttttaatgattgccattctaactggtgtaagatggtatctcattgtggttttaatttgcatttctctaatgaccagtgatgatgagcttttcttcatatgtttgttggccacataaatgttttcttttgagaagacatttatgttcatatccttcgcccattttttgatggggttgtttatttcttgtaaatttatttaaattctttgtagattctggatattagccctttgtcagacgggtagattgcaaacattttctcccattgcgtaggttgcctgtacactccgatgctagtttcttttgctgtgcagaagctgtttagtttaattagatcccatttgtcacttttggcttttgttgccattgcttttggtgttttagtcatgaagcctttgcccatgcctatgtcctgaatggtattgcctagtttttcttctagggtttttatggttttaggtcttacatttaagtctttaatccatttttcagttttctgcatatggctagccagttttcccaacaccatttattagataggaaatcctttccccattgcttgtttttgtcaggaatgttgaagatcagatggttgtacatgtgtggcattatttctgaggcctctatcctgtcctattggtctatatatctgttttggtaccagtaccatgctgttttggttactgtagctttgtagtatagtttgaagtcaggtagcgtgatgcctcctgctttgttctttttgcttaggattgtctcggctatatgggctgttttttgttctatatgaaatttaaagtagttttttctaattctttgaagaaagtcaatggtaggttgacagggatagcatagaatctataaattactttggtgagtatggcaattttcacaatgttgatttttcctatccatgagcatggaatgtttttccatttgtttgtgtcctctcttatttccttgaggagtggtttgtagttctccttgaagaggtccttcacgtcccttgtaagttgtattcctaggtattttattctctttgtagtaattgtgaatgaagttcattcataatttggctctatttttgtctattattggtataaaggaatgcttgtaatttttgtacattgattttgtatctgaaactttactgaagttgcttatcagcttaaggagattttgggctgagatgatggggttttctaaatatacaatcatgtcatctgtaaacagaggcaatttgacttcctctcttcctatttgaatacactttatttctttctcttgcctgattgcgtagccagaacttccaatactgtgttgaataggagtggggagagagggcttccagtttttgcccattcaatatgatattggctgtgggttagtcataaatagctcttattattttgatgtatgttccatcaatacctagtttattgagagtttttagcatgaaggggtgttgtattttgttgaagaccttttctgcatccattgagataatcatgtgttttttgtcattggttctgtttatgtgatggattatgtttattgatttgcagatgttgaaccagccttgcatcccagggatgaagccaacttgatcatggtggataagctttgtgatgggctgctggattcagtttgccagtattttattgaggatttttacattgacattcttcaggaatattggcctgaaattttcttttttgttgttgttgtgtctctgccaggttttggtatcaggatgatgctggcatcataaaatgagttagggaggagtccctctttttctgttgactggaatagtttcagaaggaatagtaccagctcttctgtgtacctctggtagaattcggctgtgaatctgtctggtcctggactttttttggttggtaggctattaattactgcttccatttcagaacttgttattggtctattcagggattggacttcttccttgtttagtcttggtagggtgtatgtatccaggaatttatccatttcttctagattttctagtctatttgcgtggaggtttttatagtattctctgatggtagtttgcatttttgtgggatcagtggtgatatcccctttatcatttttatcgtgtctatttgattcttctctcctttcttctttactagtctggcaactggtctattttgttgatcttttgaaaaaaccagctcctgtattcattgattttttgaagggctttttatgtctctatctccttcagttctgctctaatcttagttatttcttgtcttctgctagttttttagtttgcttgctcttgcttctctagttcttttaattgtgatgttagggtgccaattttagatcttttctgttttctcctgtgggcatttagtgctatacatttcccactaaacactgctttagctctgtcccagagattctggtacattgtatgtttgttctcattggtttcaaagagctcaattatttaagccttaattttgttatttactcagtagtcattcagaaacaggttgttcagcttccatgtagtcatgtggtttgagtgagtttcttaatcatgagttctaatttgatttcactgtggtctgagagactgttatgatttccattcttttgcgtttgctgaagagtgttttacttccaattatgtggtcaattttagaataagtgtgatgtggtgctgagaagaatgtatattcttttgatttggggtggagagttctgtagatgtctattaggtccatttggtctagagctgaattgaagtcctgaatatccttgttacttttttgtctcattgatttgtctaatattgacagtggggtgttaaagtttctcattattattgtgtgggagtctaagtctctttgtaggtctctaagatcttattatatgagtctgggtgctccttttttgtcattttttatctttgttggtttaaagtctgttttatcagagactaggatggcaacccctgctttttttttctttccatttacttgctaaatattcctccattcctttatttgcatgtgagatgggtctcctgaatacaacacactgatggttcttgactctttatccagtttgccagtctgtgtcttggggcatttagcccgtttacatttaaggttaatattgttatgtgtgaattggatcctatcattatgatgctagctggctattttgcccattagttgctgcagtttcttcacaatgtcaatggtctttacaatttgttatgtttttgcagtggctggtaccggttgctcctttccatgtttagtgctttcttcaggatctcctgtaaggcaggcctggtggtgacaaaatctctcagcatttgcttgtctgtaaaggattttatttctccttcacttatgaagcttagtttggctggatatgaaattctgggttgaaaattcttttctttaagagtgttgaatattggcccctacttacttctggcttgtagggtttctgcagagagatccactgttagtctgatgggcttccctttgtgggtaacctgacctttctctctggctgcccttaacatttttcccttcatttcaaccttggtgaatctgatgattgtgtgtcttggggttgctcttattgagtaatatcttagtggtgttctctgtatttcctgaatttgaatgttggcctgccttgctaggttggggaagttctcctggatgatatcctgaagagtattttccaacttggtttcattctccccatcactttcatgtacaccaatcaaatataggtttggtcttttcacatagtccatattttcttggaggctttgttcattccttttcattctttattctctaatcttgtcttcatgctttattttattaaggtgatcttcaatctctgaaatcctttcttctgcttgatcaatttggctattgatatttgtgtatgcttcacaaagttcttgtgctgtgtttttcagctccatcaggtcatttatgttcctctttaaactggttattctagttagcaattcctctaacttttttccaaggttcttagcttccttgcattgggttagaacatgctcctttagctcggcagagtttgttattacccacctcctgaagcctacttccttcaattggtcaaactcattctccatccagttttgttcccttgctggcaaggagttgtgatcctttggaggagaagaggcattttggtttttggaattttcagcctttttttgtgctggtttttcctcatcttcctggatttatctacctttggtctttgatgttggtgaccttcagatggggttcctgtgtggacgtcctttttgttgacattgatcctattcctttgtgtttgttagttttctttctaacaggcctctctgctgcaggtctgctgcagtttgctggaggtccactccagaccctgtgtgcctgggtatcaccagcagaggctgcagaacagcaaagattgctgctgttccttcctctggaagcttcatcttagaggggctcctgccagatgccagctggagctttcctatatgaggtgtctgctgacccctgctgggaggtttctccctgtcagaagtcacggggttcagggacccacttgaggaggcagtctgtcccttagcagatctcaagggctgtgctgggagatctgctgctcttttcagagccagcaggcaggaacatttaagtctgctgaacctgtgcccacagccaccccttcccccaggtgctctgtcccagggagatgggagtttgatctataagcccctgactggggctgccacctttctttcagagatgccctgcccagagaaaaggaatctagagagacagtctggctacagtggcttagccaagctgtggtgggctccgcccagttcaaacttcctggccgctttgtttacactgtgaggggaaaaccacctactcaagcctcagtaatggcagacgcccctcctcccaccaagctccagcatgccagattgacttcagactgctctgctggcagtgagaatttcaagccagtggatcttagcttgctgggctcccttggggtgggatcctctaagctagaccacttggctccctgacttcagccccctttccaggggtctaactttttctgtcttgctggtgttccaggcaccactggagtatgaaaaaatttcctgcagctagctcgatgtctgcccaaatgactgcccagttttgtgcttgaaacccagggccctggtgatgtaggtaccggagggaatctcctggtctgcaggttgcgaagaccgtgggaaaagcatattatcttggccagggtgcactgttccttacagcacagtccctcagggctttccttgggtagaggagggagttccctgaccccttgtgcttcctgtgtgaggtgacatcccaccctgcttcagctcactctccatgggctgcacccgctgtctaaccagttccagtgagatgagctgtgcacctcagttggaaatgcagaaatcacccaccttctgcgttgatctcgctgggagctacagaccggagctgttcctattcagacatcttgccagccacaatccaacagtggctttagtaaataaggaattattttttcctacagagcaagaagtaagaatatagaaaattgctggcattgctcccattgttcatgatgctgtcaaggatataggctctttctaccttgcattctccttccttcatttgctggctttttcccctttggctgaaggccccacggtttttaatatggctaccacaacaccaggcatcatatccatgcaggaagaagaagaaagagggaaggggagagtccagctccattggtctcttttattagaaaatatccctcctagttgcaaaggagagtgaaaaaatgactatatggcaaagggaaagaacattgtgattatcaccttagaatggttgttcatcacctcctagagatgagcacattgctcttgtatacagacaagttctgatagcagaaacaggggagattagtcattgattggcagtttttagtcttccactgtggaggaagaaaatggaattggtggcagtcttgaaggcctttttggtaggtttaggagtttcagctttatcaacaaatatgtagtatttagtatgtgtctccagtaattgaatgtgtgtgttgtcataaaccataagatatttcaagagttttaggttgagttatgtttataaaaattttttatcatattctagttttatgtactagaaaaaatacttgtcaaataggccttacatagggagggtttttacaacttacttagaaaaataaccagaaatggtggacctatttatccaccagaagccggatgtattctggagcagcctatatggttttagaatttcatccaaatttgatgcaaggagatgcaagtactctctacaacctggcaatgccaagtcccccaatacatgcccttagtaggatttgtgaacacttagccgacaagtatatactcagtgtctcatgtctaaatgtgacacaaaaacagcaatgagatacttttggaatgacatttcatctcatacacagaatttgcctgactatatgtaattatgttaatacttcaagtgttcatttaattatctttctgttaaaatgtatttaacttatcattaaagtaccaataatctttagaccaataaagtagatagtaggaggtctaaaatacaatgatttatactattttggaaaagaaaaatccctttaaggaaagtgttacaaataaaatttctttaactctttaatcaggtattttcctacttagtgaatatttatgtgtatggaaattcatcacaggattgcttttatgtctttgcttttaatacttggtgctaaattttagtgattatgtagattggttaaagttttgaccttttggaagtttgttttcttgttgttgttattgattttaattactttgtaataaattctagatctttgtaagatatgtgaccattattggcatcagtttgtaaaagctataagccatagtggtttccttatatgcaaatgaaagaatgcagaggtatacacagagcgattcagaggcatattcaggaaagggggagatcattacatcttaacctatttctattttaccatgttcctttcctgtgggaaaacatgaaaatgtggtgattcattaagacatgttaaccaggaagtagagtccctatggccatttcacatctagaagaaaaattttataactgttgctaaatagatttaatcaataggaactaagacttgagataatgacagataaacagaggtacaagtactagagatattgccgtcaaaaatatttggtgatttttaactgacctcaaagaccatctacaagcattttattaggattcctatgttgtcattctcatataacaacttgataccaccatttcatgtaacattattctgccatatctactagaaattaagaattgttggggggctagctaatgtgctaggtccagaatgtacatttttggagcaatcatataaggatctagctataaggattgtggatccatatgaattctgtaggtcatctcaaaatctctgcatatctaactttatttttttcttttctttctctctttctctctctctcttcctttcctttctctttctttttctctttcctctttcctttcctttctctccacagagtctaactctgtcacctaagcaggagtacagtggcatgaacatagcttgctgcagcttcaaactcctatgctcaagtggttttcctgcctcagcttcctgagtaactaggactacaggtgcgtgccaccatgcccagctaatttttgtattttttgtagagataagatcttactatgttacccaggatggtcttgaagtcctggcttcaagtgatcatccagccttggtctcctaaagtactgggattacaggcatgagctaccatgcctggccgggatatctaagttttgtgtgtaataaccttatttcttgtgttgaggcttttctctactattatatataatagtgtagaaaaaggatatatatatatatatatacatctctctctccttttgtttctgtgatgtatagatcactcacttcaattttctgtggacagttttttaaacacagatgtgtttttgtgactaatggtggctgttgggttgttagagatccaaagacagaataaaatcacagggagaaccttcaagtattacagagcaggaccaagtagatggtgtctttctccctacctccatgcttccttcctccctcccttctttcctttgcttgcttctcctttctgggtaggcatttgtaggaactgttttagcctctagaatcatacaatatttgacaaaagaaaaaaataaagatggagaggctcatagctgtagaatttgaattgctcacttttgactcaatgcactttctaacactgcttttaagtactaggtgacaaaataaaatgatacactactttacggacatatatagttttagaaagtattcgattgagttacagaatgttgtccaggcaattaagaacagtatttacctatgttctttatcttgtgactggtttaatgggtctaccctgagaatagttctatttgatgatactttcccttaaaaagatactaagatatttgtagctgtacaaagtaagttacttctgtttgaagagcactggattctttatgaaaggtgttcatcccattatgattgtataataaacataaagatttttaaatcaccgttgtgttcaagtaggtaaatggaaactctgcaaagaatctgcttactactggggatggaggtgggaagagcctttttggaatgatgtgttacagagaaactttgctctctggagtccatatatcatttacagcaaaaagaagaaacacattgcttatagacgagagagtcttggattaggaattcataatgtgctaggggatgctgatgaagcttctacctggaataatgaatgtgaactgtacattcagggtaaaaataacattagttatgagattctctaagttgcttgacatgacatgttctaacttatactttaagcttgactgccttcaaatatctcttaaatagcaaagctatatataaatgagcccatttattttggatgactggttataggagtaatgcatgccatttccatcatcttatatttctaatttagctggactgaaatgatgttcatcttttatgatgggattaacatttggaaactctgccagttttctagatgctggcattctgtggtttgtagagcctgtagaactgtcttctactggggatgggaggcgggtgggatggttcaggcttgatctacatgaaaatgcacatcacacctggtttgctctaggtgattatctgctagctagtgcgctttaggagctggttgaaaaggtggagtgtgtgtgtgtgtgtgtgtgtgtgtgtgtgtgtgtgtgtggaggggtagttttgcttgtcacaggtcatttcttgtttagttgggcttgttgaatctcctcatagaaaacatccatgtcctgtttatcaggtttctttaaagtcctttttctcattgctatccaaaatgcactactattttcctgcgtgtcaacatgccttcttttttcagcatggcaaacaaggcagcctcccttcaaatgtattccaattcctacgggcaaatattttcatcatcatttatgtgggtaattacaggtattccttctgtaatttataaaattataggaagtttaatttatctttgttgtgggtttcgattacagaaagttgtctagttccagcgctttgctctcaaatctgttgtaatatattaattttcgactttaaattaaagctttattatttctatcaccacaatgggaatagatggggtagaagaacttaaatttaaaaaagaaatgagggtccttcaagcaattctgattttagtgtggctgaagtgtttgtttttgctgtttttaagtctctctaccaccacccctgctccctgccactgggatttaggaatgactagcagtttacaggtcttaaaaaatattcattgtaataataagggctaggttatttttctctattttcctacagtgtgttagtttataaacaaaaggatttttaaaaaaacaattaaaatataagtaaagaagtaaggactaaattttaatcatgctttgtttagaaataaggtttttctttaatgatagtaacatgttttccttctcttgaataatttacacattttgttatcagaatgtcttctgcataaaagaggttaaaataaatcattagatgattttagggaagtcaatgtaaaattaaatatactatttgaaacagtctaaaagtgcagacactgtgtgtatttaaatttcccatgtaaggagtcatcaatctttggcaataaatttttctgagtgtagcaaaatatggcttctctacagggagcaaaagtaaagaaatttaaaacctatacaagtttctctgggattctggccaaccaagataagatgatataatgtaaagttgataagaacattttccccctaattaaaacaaaagaaaaaggacgaagaaactttctctggcacaaatataaatgaaatgtatctccagactgacccaagaaaagaagagagaggttgttattgttgttgttattattgattttttttcaggaggaaatcttcagaaatactttaagcaggaccagtttttttaatcaaacagaaatataatatttacagtctttctgcctaaatctttcctgtagaagatgagaaaatgtataacagtatcagggccaggaggtcctcatgcggtctttgttttgagcggttcctgcctatcattttttcatatgctcttgtagcttctgatctcttctagcacaaataaaattttctgtatgatatctttttagcctgaaagtattaatgtgcttccttttttaaaccaagcttatctaaccttcgtggcccaggatggctatgaatgtttcccaacacaaattcgtaaattttcttaaaacattatgagattttttttttatttttttagctcatcagttatcgctaatgctagtgtattttatgtgtggcccaagataattcttattcttacaatacagctcagggaagccaaaagattggatacccctcctttaaaccaatagtttattctattttattcttaaactagattatatataagttaatatctatctaatataatttattatagtagtacttattaagattatgtaattttttccctcaaggaaagctgtagagtaagttatgtttatggacatggaactgggttttgtgggttcaattgcttaagccacccagtgtaacgtatttttgtttaaaaagcagatcaaactgactaagacaatataactttggaacaggatattattatgcaatttccctgggctcagggatccaagacagaggcaaccaaatgacaccccctggcatatctttggtacatggagcttagatttttggcagaggaaagttgggcagcctatttacatggatgttatataggagatactatacaggaaagacttttaagaaagaaaccccgactttaagatattttttctttttagtttaaaagttattaaaacctacgggatagactgggtaatgctgacctagtcaagatgtcaataaagtgcaaaaaaaatgctgatatgataaagaatacattaagaggatgtgactaagccaaccagtgaatggaaaaatgcatcaaggaaaatttggttctggttctacagatagctttacttggaatctgtctaaaccgtattattttggtaacccatttgcctaatagaagtggatgtatccgtgaatgcaaagagttgcaactttgggagttcaagccaaatttgacacagttaagaactccttacctaggccaaaatctgagctggatgttctggcaaaggtcagagtagatttctcacttcaagtccatctctgtgggttgccttggctctcgtggtagccatgatagtgagcaaggacataaggaaagccaaatgtgatccattcaagaggcaccttcaggttatgttaggcatggacaccaggtcttcagcattgaacacaagacagtaaggaggatctggaacaaccagaattgagagcagtcatgtagacctccagcctaagaagggacatttagttttggatctattagcaagatgaaatcaaacagtgttgatcctttgtacagaagaaacactatggggataattggatatactggggcaaagaattaaaaaaaatactggaaaacttgaaattgtactttgaaatttttctgcagagtaacactgtatctcaagctgtggaagaagaagataccagtgacatgctgatactcactgtcacatacaaaactatattgtgggtgatttcctaaatcattcaaggtttttcagaatcatgcatttgaataacttcacattagttcatattatagatgtgagaagacacattttctaaggtgctcaatatggaacaaatgagaaaaacagacatatcagaatccagtcccatagtgtacatagtgaacagaacatagcactggagtctgagacctgtgttcaaatcctgattatttttatggctattttattaaattatttaaactttcaaagttttcaaattatttaaacttcctgagcttcattttcttcatctgcaaaacagtggtaatcatatttgctttgcaggatgcctgtggggtttaaataaagtaataaaccttaaagaacataagtaacaataggcaaccaatacaaggtagctattgtaatgtgttctgtgctggtaaattattcaacttctcttttcagtgatgcttaaatttctatcattaatgtggcagttaaataaggcacaggctttttttgatggtgatttttgaaaatccttcctatgtttaagagaaaaatgcctaaagaaaacagaagacccaaaaacaacctcctcctttgacaacatcattctccaaagatcatttgcacaattgttgattggcaacattgcattggcttacaaaaaataacactataaaagtacaacatgttaagtaaacaaactgtctttacaacactcagaagttcatgtgggtaataccacaagaaaaatttttataacataaacgatacttattttgatcattttgttttttagaatttgtttacacatacactattccttttaagctagatttccaaattataaagtagagaagataattaaaacaattatttgaaaaacaaacctctaaagaaaaggacattcatggttgacagaacaaagatggcccttggcgtggcatctgtgagctaggtttacttcatggagaatgtttgtcttttatccagagttgtttgtttattttaaaggacaagtgaatttagtattgaaataccgaatagtatattttttattgactgagatgtattagcatttgttttaaaatttcacttagtatatttttattattataaaggtaatatattttcctggtagagaatttggaaaatgtagataaataaaaagaagaaaataaaaccatctatgatcctgccaaagataactactcagcatatttctccttttaaaaattcatttactcctatatacacacatgtataaaacaaaaacacaatcacatatttgtaatttacattttttaacctagtaatatattttgaacatttgcctatgttgcttagtgctttttcatttcatttttaatacttgcacagattttcattgtataaataaaccatagtttattaaaccattcttcttagaataataaataattattagtagtaaatacattttactctggtaaaaataaatttctaacattttacctttttactaattttcatccactatgaatatttctacaaacaattttgtggctcactctctacaccactatgattttgtataggatgaatttgtgggtcaaatatgatatgcaaaaatcttagtgttttatacgtgttctatattgccttccaaaagaaagttaaagaataacatttctttctctggtccttcagtgcatatttccacaaatcctctacacggcttatttctttaaaaaatatttactaaattgttggtagaatggatacaattttatatttgtccttattatttgtgtgattggataaattcatttcttgtatgtatttgtctattatttgtaaaggatcccaaacaggtgtgcaaaagtattaaagtttagcattgagtagagataaaggatatgtcacttgctttccttacttaagttaaggctttacttcttcagtccttcttggtatagcatctcatacaattccttaagtaaagtcgtcatattttaaattacagggaactgaaaattgatttgacttggatgttcaaatgatagatcaaatctatgatttatgctatgtagaaaagcgcttgctaaaaatcaaaactccataaacgcacattacctcgaattagtcttgcacctttcatctacagacctggtgggactaaaaaagaataaatataaatattattaattgtcattcagaatctttggtgaatgaaaagggccattactagattctggttctggtttaccaacctagtcagttcatagaggaagctggggcctgttgaggcaacatggtacaatggaaagcttttagactctgcccgggttcaaatcctggttctgccacttacaaaatgtaaatagaaggaaaatgtacttaatttcttggagctttatttttacgccatttctcagacatgtgagtgttagtgggttctttggattattgtgaggtcagttcctctcattttaaatgactttcccagggtcacttaactaattaggcagagtggactagagtgtttatcccctgatggttcatcatatgctctgttcagtataccatggctacttttctagctaaggattttgaagcatgccatattaaggcacatcattttaattataaatagactagaatgaaacaaaggtgtgacaaatactgtggtttggttgatccaatctgttgttaatgtcatccagctaaagaccaccaggaacatacctgtaatcgagcaagtctgacttattaatagatgcaagaaaggagaccacacaccatgggaaatgtggggcatttcagtaagagggtgtttggaaggattattacaggatctggtctcaggtgatttttggggagggcttaagaaagtggctttgctctgaattggatgctatcaggaattgggggtaaatatatgattgcttattttaaaaatcttatctataatatgggaaaaataaagtgaggctaaagaatcaaactgggaaagaagcagcagctactgatattagccaggctatgaaggtgcttggtatttttgtggtttgcacaatgatcttgtttatgtgcttagacaaggttatagagtggtcttttttttttttcagttcatcatggtcactgatgttggtgatttggaagcttgtttatgttcaacaggatatcatcaaggcctatttatgaacatagctagcttttcacaacatcaaggcctagctatatagctgcagtttctgaaatgtcaaaagctgctcttctttttctctctgcatctcttttctctccagccacctttctgcaaggactggctccggggcaaaattatagccaaagaaacatacacagaagtttcctgggagcttcctaataaaacttttactttcaaatattggtaccacccattctccttgctacatcctctttcttcttgttggaaaggggatataattgtagaagccacaacagcttttttgtaattgtgaggacaaagtaaagtgatctcagagtctttggcatcattgatctgctgaaccagcccagcactgctaaactctggatttctcattatgggagaaaaatacttctcatttttttcaagccactgtagtcaggcttcctgtttgttacctgttgctgaaagcattccaaaaacattgggcattcaccttcattatttactaaactagatactcttctggcagccaaatttttatgatgactcagaacatattccatttggaaatagagcttggcaattattctccccttttaaaaattagtcttaagtaaatgaattactgttctttctgcttcataaggtttgtcattattacttcactcagatgcaattgctttcagaaacctgaataagaaagaaagctttagaaaccttccagattaagttctgcaggaagaagtgtgggtacatttgtagacttgattatttaaagggtggatacagctataaacctaattgctagataattgtgacttcaccactgcaatttgttgggtccctattcccattgtgatttgtcaagcttcacagtgtattggttgtttttaatgatcattgacttagaggtgaaaagaactcctgttttcctaggggataattccctggttattctgtgctatagtggttagaaggttagattgcatattacagaatcaatgcccactggaaaactaatagcatgtttggaagtgatgatgaggacaatagctaattactattaactgtgtaggaaaactaaactgcagggccggtaggaatccagcgcctgctagatgctggatgagagttcttaacaaaagaaaagtgaaaaggttcagggaaacttcatgtattgacagctgggatttgtacattaaaaatcttgtgcctgtggtcagaataaattttactctggtcaaaataaattttttctctacccaccaactggtaattattttacaagtgatagttttttatttttttaaaaaatctccttctgcaccttacacataatagatacaaaataattactgttcaagaaatgcttgaaaatatattaaaattggactctaaagaatagtttaatttctgcaataatgacagtaataatttatcaaaatgttctccataaatagtaaattatttagcagatcaccattcatatataacagatatattactgaataaaatatattaatgttcactgtggttaacataaaatatccagatgggagggaatttaataatttatggggatgattcttgtccacttaactaagtaggatgtgaattttgcataaagtgcttgaccgttccatgaaaacttgtcactgtttgagagagaccaggatcttatttttcaagaaaaacttaatagtaaattacaacaaaatagtttcacaatataattttcatgtcttacacttcaaatgcttacaaaaagtctgctttttctgccagttcttgtaggcatatggaataaatctatctaaatgatgtgatccatataaacttaatccactggtggggtattggttgtaggtctatgttgaaattacagttactatacaccttcacatagttttagtaaatttcaggggtttggtaaatgaggaacatgcagaatcatagttttatagccatattgagtgtgatgtttattacatagccttctcagagttcctcaccattttgtttctctagaaagcatgctctttgaaatggatggtagatatatgttggaagatctattggaaaaaaggggggtcgttacaagcttatccaggttttcctattttgggatttttttaatgatacgatctatcttcctgcagattaagttctggcaaagtatatgttttaattaacttattttgagagaatgaatgaatgaatgagaactctcaacctttatttaaaaataaatttactaggaacttctctctaaatctgttaaaagccataatgaaggtggggaaagggacaattgtaattcagtaaaataaatacaaaattggatatataaactctgcaatgagaaatacaggagggaatctaggagtggacttatttctctggagtgatgtctgagataactcttgagagagaagtcattgttttctaggtagacaaggagttgggagggcagaacaaagtttcatactgtggccaggaatgtcctaaaaagtgccatggaatactgtggaatcttagaagtttaatgagttcgttatgttagaagtcttatggctttttttttttctgacagagaagagccaagagatggtgttatgcaggtggtttggagttagctcatgcaggcactaaaggcatgctaaagagttttaagttgcgtcttgcagttgctatccgctaagctccagtacagcagcaaccatgcctgcctcactcaagtggcaatccagagggctgggagagtgtctgacacattgtagttgcttagtgtgtttttattaagtgaatgagttagaagcgattgaaggaatttgagaaaaggaataacccattaagatttgaaatttaggactgtcactgacagcagtacaaacatggaagagaaaggtgtatggtttcaatggctgctataacaaattgccacaaagttagtgacttaaaacaccaatttatcttatagttctttaggactgacatccagcacaggtctcactatactaaagtcaaggtatgggcagcgccgtattcctttctggaggctggaagcgacaaaatccctttctttgcctttcccagcctctagaggctgcccatttttcttggctcacggctctcttcctccatctttctccagccacattgcgctctctgaccagtcttccatcttcacatgtctctaaccacagaccagaaatgttctttgattttaaaggctcatgtgattagattgaggctacctgagtaatccaggaaaatctcctcatatcaaggtccttaactttaatcacatctgcaaaagttcatttttttccataaaacatattcaccggttctggggactaggatgtggacatttctggtaggctgttattctacctacctcaaggggcctgaggggtgctccatataggagactagtaacgaaagagtgtatgaagggataaagccagttcccggttcaccaaaccgttttgctttcctctttgttagagaggtagactgaattttgttccttttttttttttgagacagagtcttgctctgtcactcaggctggagcacagtagcgtgatctcagctcactgcaacctccgcctcttgggttcaagcgattctcctgcctcagcctcttgagtagctgggactacaggtgtgtgccacctcgcccagctaatttttttgtatttttaatagagacagggtttcaccatgttagccagactggtctcgaacttctgacctcaggcaatatgcctgcctcggcctcccaaagtgctggtattacatgtgtgagccactgcacccggccccttctttgtattgttgtggctaatatgaccaagctctgtgcagtaggagttaatgcgtgccttatccgggcccctaaaacacttctcatgtaatcctccatgctttttcttttctctcttctactggttgaatgtagagggatctggcacagtacttggaggcactgcgggatggcagggtctctagccagaagcagctagaaccctaagaggagcagagatccctaccaagcacattgcactccgtttgcatgagaaataaagcttttcttgtgttaagccactgaaatttgcaaagtatttgccagagcaaacactctaacatgacctttgaatttcaatgtggtggtagggtgttgatgatataacaaaaatacaaatcagtgcaggtggcattgacttagtgtttggcccatgggcaggacccttctattaggggctggaaataaactatgttataaaggggagcaatttttataagttgttgtctggaataacttggaaggcagacattatgcctaaagatctctacagtttaacacagtgattcttaaccttggctgcatttcaaaatcacctgaggaatttaaaaaacttattcctactcaaagaccactcccagagattctgatttaattaaatggtttctgtgtatgtgttgaggggaaggcggcgttagtattatttaacagctaggattgagaaccaaagctgtagggcaaggatcagcaaactctttccgtaaaaggccagatagtaagaattttaggagttggccttgggagtaatactatctctgttgcaattatttaactctgctattacaacatgaaagcaacatgacaacaggtaagcaaatggttgtggctgtgttctaaaaaaaaaaactttataaaacaggcaatgagctggtttttatatgcaggccatattttgctgattcatatctaggacagtgattctcaaactttttattctcagagctgttttacccttttacaaactattgaggaccataaaaatcttttgtttataagttatatctagcaaaaattaccatttaaaattgaaataaacatttaaaaaataatgaattgaaaatagtaagtatcatgttaacataaataacattaaagaaaattaaaattgtcataatggatatatttgtggtgtgcatagtgatgttttgctacatgtaaagtgatcagatcagggtaattatcatatccatcatctcaaacgtttatcatttatttgtgttggaaacattcaatatcctcttcttagctatttgaaactatatattattgttaactatagtcattctacagtggtatagaacacaaagaacctacttatcctacctggctataattttatatctttatataattttatatacaattttatatcttttatataataaatatctatcccctctccccctcctcttctagccaattacttctgtgagatcaacttatttttttactttcaacatgtaagtgagaacatgtggtgttcaactttctggtcagcaccagaaaatggtttatttcacttaacataatgaattccagttgcatcgatgttgctgagagtgacaggatttcattctctttcatggctgaatagtagtccattgtgtgtgtatatatgtatgtatatacacatacatatacataccacattttctttatccattcatctgttgttggacacctaggctgattctgtatcttggctcttgtaaatagtgttgtaataaacatggaggtacagatgtctttttgatacactgacttcctttcctttggataaatgcccagtagtgggattgctggatcatatggtagttctattttagtttttggaggaaccgccatactcttcttcatagtggttggactagtttatattctcaccaaaagtgtataagaattttattttctctgtaaaaatgtatttttaggataattatatttgcaaaataaatagtaaaaagaacggcattgttttacatttttgcaaaactctatattgtctagttaatagaggacatttagattcttacttgcttcttcatccattctgttgtgatatgttgtcttaattgaaataagtgaagaaaatctagtcccatatagatgtgtaggtatttcttgttggaagaacaatactccttcttttgaaggaatattttaatagtcttttcacataattgttgacattcttttatattatatcatgactcaaaagtgaaaattttataaaagtatattgcaacgtggaatctgaaaccgtatcaataaacttttcacactctagtacattaaatccactttaaatggatcctttacctatgcatgattttataatatcttgtattgattggaaaatattatttcactgagttatgtaataggcacatttccttatataatattttttaaaataacatttgttaatatcaccatggatctcataaaaattctttaagtattcagaagctgtcaagctcacagtagtggatacaagttttccaaaattctaattttcagttgaaagctcagattttatcattggcaccaaataccgtcaggttgtttgccttcaagtgacaggctcacttcacttattttcaagaaaatgactgccaaatatccaagtatgaataaccatattttgtttatcacttgttctttcaagcaaaagtggtattccacgaaaaagagacaagttcagtttgcaactcaaacaatcacacattgcttttcctcaagacaaccattgtacttgggtatgcagcagaagtgctttatgtgttctttccttgtagtcccacagaatacttaaaagatttgtaactcaagtgttgagctttaagaaaatgcataaattttaactgtttcattagggtattcttaagcaaaactttttaaacctgtgagatcatggtgatgaaagtgatgcaatgacataataaaatgatatgatacaatttggtaattttgccttgatttatgctaaagaactgatatggttttgctgtgtcacaacccaaatctcatcttgaattgtagctcccacaatgcccacatgtcatgggagggacctagtgagaggtaattgaatgatgggggtgagtctttctcatgacagtgaataagtcttatgagatctgatggttttataaagaggaggtcccctgcagaagctctctttttcttgactgttgccatccatgtaagacatgacttgctcctccttgccgtctaccgtgatttgtgaggcctccccagtcatgtggaactgtgagtctattaaacctcatttctttataaattacccggtctcaggtatgtctttattaacaacatgataacagatgaatacaagcaccaacagttttactcaccattgctttggcaccattggtgcaaatgtcaatacagtagaaaaagcaaatacatcttaatattattatgaaaataattttgacctcatggatccactaaaagagtctttgggatttccagaattgtgcagattatgctttgaaaactgctgcttgtggggactggttttaaaagaaccacagtgttactgtgtcatagctcttattggcttcctttggtaaggtgtttcaagaaagagatgaactcagacagaaatggctagtttccaagccagatggaaaacaatagaaagtatccagacttgagtgaacgatggtggaaatccatctgcttctagatcccacacagaaccacaaggcccagaaagactttttagctgaacactatgacttagatacagatcagattaatggccaaagagagctggagagagagagagagaaaaaaaaaaaaggagaaaagacctgagaattgtacatagaagcaaatacaacagaagcctaccaagattttgaagaacttgtattgtcaagaaatccaaaatatctgattaaaacagctttgtctgacctttaaaatcacctttttactttggctacactcatttcagctgtgtccaaaaggaataaataaacaataagaacttctaaagggaaaggctgagggtcaaacaagaaaaagacaaaagacttatttccagagagcagaattaaaatctaatccacaaatttatcctctccccaggctaggggacatctcgaggcctgccaaacaggattgtagaattgtagtggcctagtgaacatgtacatcctctgattcccttttttgaatgggaattttaattgtagttacgctgtccctgctccaccactgtatatacagcaagcccataaccaaactccactctcccttccctcacctgcctgccagatacaagggtttgggggaaattttaagctactagggggtggtataactactagaaggaagaagcctggtcacctgaatgaagcagatcctgtccaccaacctgtgctggattgtgacatgaacaagaaatacatgtttattgtgctaaaccactgagattttggttccagcatttgccacaaacattctttatcacaacactgagaagactctgaataatatggaggctattccattgatctgcccggaggaactgaactatggcagtggcagaaataagaagaaatacatattttagaggtagaaccaataagctatcactagtgggatagcagagcagaatgaggtagagtaaggagtctgggatgtgttccagctttctatcttgggttaaagtgggtggagttttggatggcactcagaacaacccagtgaatttatccaataggcaggagcttgggacagagatgtggaaagcaggcacatatagggcaatcatcagcttataggtgatggttgaagccatgaggcaggaggaatagtggataaaatattttgggaagacagttcagagggagaagagcacagaggtcgcttaatgaacagcagagagagcagtctgcaaaagagtgaaaaatggacccctagaaaggaaaaaaaaaaggcagaaaaggataggtcacagaaaccaaaatagaattaaagagcactttaaaaacactttaaacactttaaattaaaagaacacttttaagaactgtgaaatgataaacaatcaaatatgtcaaaaaggtgaaatataatcagagctaaatatttatgaaattttagaattaaaagagtatgggtgatcttcatgaagataatttcaatggagcattgatacaaaattcagatcattatgtgacaagtgtcttttgattttatagatgaaaaaacagaagtgttacatcttgaccaagattgacagcacatgttggagctttactttgaactcttgcgtattcaacaccataacccatgctcttccattcttccaaactgaatctgaaaaactcacttaagtataagatggattcagataaaattttgattataatcttgctaaagctgggtaaaatagaaaggtattgaattcataggattgatattttcagagaggaaggtgtagagaggtgactaatgttctatcgtatttctgagaggtttctttttctctctcccctccctctttttattctcttcagcagattctattgataatattggtaaccagcagttaagttttgtaacatgaataggttaaatgttatattatgaatatgatttttatattcataacatgaatataaaaatcaactatttacgactatttaactggcttggggacaaaggtggtaagagctgttggccacagctatcttatttttaacaatagggctattttggttttagaacataggatgtatgaatcttctaaaatcacttcttcctaaaattataaggttgcagttgactgatgaaatttttctctcttataaaacgaattgacaagatcaaaggctgcaagagtttgagcgctaccttcacatttaccagaggctttggtggcaattcagtatttaaagtataatttccaaacaagctaaaaacagagccaaacatttttaggagatttatcctatgatcttcttttcattaataaacataaaggttaatgttaccctaaatgttatcataggacactatttcaaaataagcgcattagcaaattaaatgaaagacatgtcaaaacctgaagcagcatttattcttgtgagccaaggtgtctacaaatcttgtgcaggaaatgtaacttttcttcatttcatacaatgacattttgtatgtgctgaaattttgaaatactgtgcactgacgtgtttcacaatgagcattacagaattttgaggcatttgaggggacacatactcagtagttgtctgggtcattactgccttagtgagaacatttgcacattctcacaattgtaaggtttccccactattttcatgaccaatattactgtaaaggtatttgtttttttgcagttcacagggtattgataagctgcagtactatgtaaatttaataagtcataaacagcatttattaccttggtatattattaaaaaatgaaattttgtatgaaatgaagaaaagtaattggcattatttgaatccattatttattaaattttaccatttttgtacaaatgaacctttcttggcatgtactgattttctaatctagaatgcatgctaaaatattttcattttggtagcgaagtaccttccaatttgggactcagaacattcaatttagagtatacataaagtcaagaatacatacagtcagcattattaaacataaaccttgatactgccctactttagttgcaattttttgacagcataattcagtatttgtcccctttgcatttctatagcaactatttctgtgaaagttatgtgtttggttgaaattttctagagcagaaaagaatcatttgtaatttttatttgaaggttgtgttgcagtgatgaggaattgagagatgtccttcattgtatgcaaaattatttttaaaagccctctaccctacacatacacgtgtgtgcacacacatctgcatgtccagtgttatagatactaagtaccatctaattactcacattctcttaaaacagggtagcagttcataggtaatcactttttaaaaattagttaattgaaagaagacaatctaaaaagacagaaaaaaacacctaaccccattctgaaagttcatgttatttttaaattgcatatgagaatttttgtaaaagataggttgaaaaatgtacctattacctgctgcttacacatttaatgtcagagataaggcaacattttaagggacgctatttggcaatacgcactaccacacagaaaatttaaagaaaacaaaaaaagtttaagaaaaaaaacaaaaataaacttaattttgtttccaaatcaagcttatttctatagcagttttaaaacattttatttggttgttctcatcaagactttctatcctattctaataactaagagaatcctaaagctttctacttttgtaatttaatatttgaagagatagatttctagagaatattttccaaatctattataggctggaagaacagtatcatagcttctgaatttcttctcaaatgtcagtattgtttaacacatttacaaaggcaatgaaaatagaaaacttatatgctgattttaagttctacatatctgaaattcttaagcaataaacatgtttgtagacaggtaaactaacaaggctaaaactttgatttttaaaattagaacacttatatcttttattgtcattagttatatatattaaagtcaaatgaaagagctatttggtaattttataatactgatttcattcattaatttaacaagtatgaattgattatttactctgtgacaagatattatacctatatccctggacacagaacaaagggttagccattcaatagtttctgaaatgtcaggattaattctggctgtcattataaaggaagaccatttggggagtaaaattttaaactgaactgagtaaaattttaaaaagcacataaaacaaaaactgtatatcaatgagtaacaaaaactactatttaactgggttgggtcaaaggttgtaagagctgttggccccaactatctgaaaagaaaccaaaatgtcaagttgacctcttaatggtgactgggtaaataccaaggttcagtggtttgttcttgatgcacatccaaacatttggacatctgtccaatatttctagctagttttttcttttactaacgtagttttgaaaaatgtaaaatatgtgacttgctatagaacattcatggtctatttttgtcatattaaacaaatgaaaaagttccatattttgaaagcatttaattttcatatgttcacaaatacaagtagcatgacattagttatctatgaatcatttttgatagcaaaaattctgtattgtgaattcagaactgaagagtaagagaaaataagattgttacagactgtgatgcagtttgtgaaaaagcgaaatggttggtgtgaatcatagtggctggggttggggtaggggtgggaaagaggtcaagaaggacctctgtgaggaggtaacatatgagctgagatttgaaggatgagccctgggaagaaccagggaaagattcttgcaggtaaagagaaaaaaatgtagcaatatgaggtgaaaggaacttcattaagaaaaggaaggaggaaatcttaaactcccctgaataggatctttccgacatagattatttcgtatcaggtggagagtgctctgctatgcagcaggacagcctaggtcctgcaacagtaatcgaccatcccccaattccagatgctctaaaccactaggttcatttctcactcactctacgtgtccattgcaggttggctaagtgctgtgctctgcatcctcctctctccaggacccacgcagacagagtagtcactatctggaacacagaggttttggtgacaaagcaaaaagagaaagcatggcaaattgcgtacaggctcttaaaggttctgaaaacttccattcacacttcattggccaaagctgtgacttatctcaagtcagcaaggaagtgtaattctccagtgtgcccggaagaggagtagaaccggaaatacgaatgagcgacagtaacatctcctagagggggtctgtgagcaacctggaattgtatgtacatttgtgtgtgtgtgtgtctgtgtcggtatgtgcgtgtctctggggagaagatccatttctttaatcagattttcaagggatctgtgacatgacaacgattaaaaaccactggaccagttgaaaactgccatgtaaacagataattactatacaagacaatttgcagcatgagtgagaggctgaaatgattaaagaattgtgcttctgtgtgtgtgtgtgtttgcacacatgcatgctcacacatggtgacaaggaaaaagctgagccaatgtgtagactgaaatgtagaaggcagagttcagagagtgatagattaaagacaccaaagtgtgaggggacatgcctgatgtaatgaggtccctgaagatgcctgaggagatggtgtccaatattctataacttcagggatttgaagagattactcttctttgacttgcaaaaaaaggagggaaaagctaggtgtcctcatgggtcagtttgctgatggaggggaagaagaggagctctattttgtttgtgataaatgagcaaggtcatctgcttagaatgaggggattgtagagcatgttaatagtttggaacagctgtaagggaaatctgaaactgagctgactggggagaaataaaaggaccgccagtagcacagagggcccagctgatactggagaacatagatttgtcagagtgccagtaaatggagttatgtgatttttctctgcccatgctcagctgcctggaagcgggagctgagaaagttaacagttggatggatgcagggctggggattggcagggcaggtgcagcaacatgttttacttataatttgaagttcaagagtctgaacaggcaaaagagctaattttgcctccaattttaaaagataagttggtaaataatggtgataatggtgagaataagctgtatatatagctataacctgtagttatcctttgtgagttgctattcttgctccctggagttcataactgatgcaactactataactatggctaaggataagtagtgtagcttatttcttattgcttaagtaaaattaatcatgcttcagccacatgagtttttttttatgttcctaatactcccttattcttctggtaaaatctggcagaaggaaggtaagagaaaaaaattaaacctctgaaaatgtaattacatactcagagacagaatcacttagctaagcatcttgctattaattagtacgttgtaaattttgctgccttggctgatactaagtcattgtgtttagaagagccattaaatgaagacaaaagaaaaacacctggagtagcttagctccaaagtagacctcaggctgaaatagcattgtattgcatttctcttttcccaattgcctgccaaattccccattttccctgatttctgtgaggttacatcataaacatttgataaaaaataatgttgctcttcataaaggctgcatatgcacactgaaggcaaacacagccctgatagtaattctggattaagctctgtcattttattttccatttcttcagaacagaggtttcttctctcaaatattgatgactgacagatgaggtgagcaagccaggtgtgatcatttagaattgcatttagggctgaaagtaaatgtgacttttcacatccttcctcaacacaaaggatttagcaggaggcaagcatgttaaaattctaaaaggagattattgctgcaaatggcttttccccagaagaccctctctcagaatttcagttgttgataactagcaggttttatctctaagaactaagatcattttctcatcacttctggcctgccaacttgtagactgtcttcagctgaagcagtgctgccagaatgaataactggagaagttactcaactctatttattttagagtatgataatttgagggaaaattaaaattgtcagttttccattacaccctcaagctctcagtgctggttatctcatcagacttaaaaaacatactttggcggaaaattgtgtaaacagacggaaaagccaagaaaaataaggaactaatgtctcatcaagggccacatggtatgtttagggcagagctgggcacctgaacatccttactgacccgaggacttcttgctctagtcccaggacagggagatgtgtagatgctgagtatctgaagtaaacactgggcagttatctgaggtctggttatctaagtggcaagggaaatggatatttaaatgttcaaattttgacctgcaatgatctgtaccagaggcctagagactctgagcgctctgagggcaaggacactgtagagttcatctttgtctacctggctccaagcccagtggctggcataagactagaaagccaatcaacgtttaagaaattctgaataaattcagatcctttaaaaatgttgtcggccgggcgcggtggctcacgcctgtaatcccagcactttgggaggtcgaggcgggcggatcacgaggtcaggagatcgagcccatcctggataacacggtgaaaccccgtctctactaaaaatacagaaaattagccgggcgtggtagcaggcgcctgtagtcccagctacttgggaggctgaggcaggagaatggcgtgaacccgggaggcggagcttgcagtgagccgagatcgcgccactgcactccagcctgggcgacagagcgagactccgcctcaaaaaaaaaaaaaagttgtcggataacctcatttctctactcagaatgctgcagtagcttctcatttcactcgaggtaaaagtcaaagccctgacagatctggtctttgctgcctcctctcccttcccgattctcgcccccacacaccctctggtggctccttgttcacaggaggcagctccctttgcaccggctgttctttaagcctgaactcttactctacatacctaacaggctacctcccttattttctttaaattttgttcaaatgtcacttttcattgagtaatatttccactgtcctttacaaaaattgcagctctgttacaccccccgccgttcacactggcgatcctgcttagcctgctacatcttttcataacacttatcactttctaactctaacttaccataccgtttactattagtatgtttatgttttgttgtctctctccttctaacaagggcaaggatttttgtcacttctgttcactggtattcccagtgtttcagccactgtctgacacatagaggatgctttgtaaataattgtatgaataaatgaacaaagctggattagtgaagcaagtgagtgtacatgtctcatagtgaaagagatgcactcttaaagacaggcgtaaaggttaaaggggccattagttttggtaaatttataaaggtgtacactcattttcatattcaaaagcccttgtaattctggataaactttgccaacctccagactcaaaactatggacttccaacctgttaactgtgaagttttcttggtaagaacgtgtggttcaattcttgatgaattcagacagtgagcacatgtgtggattggtatttctcaaagtagacttatgaggcccctgccttaggaacacttaagtactgtattccaattccccagccctttccagtttactgagtgattagatctccaggtgactcaaatccatgctaaaatttgagaattatcagtatataaaaatctgccaaaggtgatgagactataatagaacaggattgcccctgttgtagtataattattccacaggatgttgataagattgcagttagaaaaaaagtgttcgttaaaataataaaataaggtaatactgaattaaatgggtatttaagtaacaggagttcacagaacctttaataagctgacataattgtgcattcccaagagtaggctaaagtatgtagcatcacagatttattccatcatgaacatctctttttaggcaactcattagcttttggggagaggtgtttttttttttttcctttaaagaaaaagtctgggcacttctgttatacataatctctaatatttattcctgattctaacactgtataattctctataattttgttttctctcttgtcaactccccttagtttatagtctagttgcagctttttatacctaagaaaaaatatgaaatagtatttctatatttcatggtgtctaggactcatccttgcaaacaagaaaggtctttctgtgtatgagacatacacacacgtgctcacacacacacatacagaaagagagaaagagagagtgagattgtgaatgagaataaggtaaatgccagtccagagaggtgacacaaagaagcctgtacatggtgtacttaagtgagtgaatctgcttgttaaaagtaaaatttagtagatttgtaagtgagggttttgccttttatgtaaagtggtatgttagtgatatacacatataaaatcccactgggtgtaagcacatgtggggactggtttttctgtattgattaccattaatctattccttatgtcactttccattgctgtggcatggcccgtggaaacaagataggtatgtgcctggaataaacatctttttccctttctgaaagccgtgtgaagtctacagcacattacatccttctgtgtaatggaagtatccacacatggacaatcgctgtctacagatgtaatgaaccaagtgggaggtaatgagaagtgactgtcatgccatccctagggccccctttctcccaccacacaattacactgtgaccctagaggaaccaagaagactgtaacattctcccctttcctaatggtcttaaaatcagccctagcttaccagggataactaaaatgcagcattattcaattggcagtccagaggatgtccaaggaaatatatgtttataacatgggaggcagttctgtttacactcatacactgtttcctcagtgtggacttggcctcttgcctgaaagatgccagcacacgagggtcccttcctgttttcccttagtgtgtgattttggggtaagagctgttgctgtgtttgtaatgagagtccagggaggaggctggtggtcagaaccacatttgttaaatgtgtttaaaaaaaaaaaagctcctttaaataatgatgataagtgcagtgatagcaatgtatcacccattttatttctgagttttgtttcaaggagagcattgattacagcaaccaattttatgtgacttatgcttgtggtgagagggagatgtcagagctgaggaaaggtagagggttgcccactgagtcaacttgaagagagcacacaaaaaatgcaaaaaggtataagaattaaaattcttttctttgtcttcattttgctcttatagctgaggcttgcccacattctgggggaagtctgccaactgttccctgaatggtgaatggaaacaagctggtctgctgtgttgcttggcaaagacagaatagcagcacaggcttgctgctggctggacgacaccattttccactcctctgctcctctgcctggaggaagcccccaggtggcattagggagaattagcgtgtaaattacagggcctcctaatttctcaccacttcattagttgacagttcagtgaaagagctcccctgccattcacctcacgtctgtggcactgacacttctcatcagcagaagcagagttcagtcgtgttgtgttgacatgcttgtgacttttcggttcccctccttagtgtgtgctagtttattctctgaccctgttactagcaattatgtccttggatgtccctgcaacatctacctcaaaccttcttttggttcaaacttgattcagtgtcaccaggaaaagttagaaattgctcttgatcctgtccataccgttttacagaatgggttcaaactatgccacaaagaaaggaaaaataaaaataataccctatataaaaataaactcttctccataatattcttcatagctagtattttttgagtgcttattctgtgtcaggcattgttctaaatactccagagactgttaaatcttttttttttccttattgtttgtttcattcaggagaaatctgaggcacagagaggttaggtttattgcctaggacacacagcttttgaatattggaagtttggatccacaacccacactctaagtactggagcattttgccttacttagccaattacttagttaattcctgaattcattcaacaaactttcatgaagcaccagctatatataacttactatgccagagtttcttagtctatcaatccttccatttccattggtgagaagctatttgttgagtacttcctatctccccagggatatgctcatgtagatacaagagaaatgcaggatgggaccttaccatcagagaattgaagtacacgtagatagttgacaaacttttctctctaaagggccagacacaaaatatttttggctttggaggtcacgtggtttctgccccaacaagtgtgaagcagctgcaaatattatctaaatgaattagtatgtctattctgataaaactttacaaaaaaattagcaccagagcatatttggcccacaggctgcctgctgtggaggatagaagaagcccgaagaaaaatacgggaccataaatactgacggtacgactgagagtggagcttgtgcattattgcctgtccacatctgtgaggtcagtgaaataaggtgtcagggagcaagaacacctgtgtgcattttggtaattaggcaaattatttctagaggaggtggagcaggagccttccctcaagaatgggaagtatttgacatacacctgtgaggttgttaggtgggtgtcaccaactgccatagttcttattactatgtgtggcaggcaagttggttacgtaatgtccattttcctctccttccttgttaaccccatttttgtttggtgccactacaggttcagccctaagcaatggctcatagttgataacagtacatctcgataattgtgttctcaatttccctgcctcttttgcggttgaaagtggtcatgtgacctagttctgaccaattagaagtaggtttgcctgctgggtggagtcaggagggactcttgggaagacttttgcttgtctgatcaaaggaacagacaagttaatgtcacacctcccttatattttgttgccacaagtttaaacatgaagatgaactgggacagacatattggggccttgagggaggaagccaacgtgttatagatggagaatgtggacaaagaaaaagagcctggacctctgatgacaccagggagctactacatgggtgctgctgccaccctccagccttctaattttaagagtttactacttttattattattattattgatttaagtcactgttagttgaataacaaatgtgtctttaaaaatatttcgggaaatgtcaactagaaattacttctagaaatgttccatcatcttagatatttcagaaaattgtaccaaatcaaatgagattgtttctaatttctttcactttcttagtaatctttcttcacagtatactactaaggagaaaaaagtacattacagataaatattagcctatttttcatttaaatatcataaatgtcttaaagtaagaacaacaggttagtagtggttgtgtctgggtaattgacactagctgttggaattaggagtgtgtttattgttttgctttatttttctaacttttctatagaaaacatataaatgaaaaaatttaaaatcatactaaaaaatcaaactaattttatttttaatgcaagtttcttttctgacttatactattttcctaacctagtttttcctttggctaagctcatttccttttagttttctttcccatattgttttttgttcattagttgtgtactgtgcctgcttgcctgctttcctttcttttccctctcttcctccctccttcccttctgatatggtttggctgtgtccccacccaaatctcatcttgaattgtaactcctataatccccacacatcatgggaggaacccagtgggaggtgattgcattatgggggtgggtctttcctgcactgttcttgtgatagtgaatgagtctcatgagatcttattgttttaaagagttcccctgcacaagttctctctctttttgcctgctgccatccatttaagacatgcctttgctcctccttgccttctgccatgattgtgaggcttccccagccacatggaactgtaagtccaattaaacctctttcttttgtaaattgcccaatcttggcatgtctttatcagcagcatgaaaatggactaatcctccttccctccttcttttttctttcaacaagttcttgctttgtcactcagtctggagtgcagtggtgtgaacacagctcaccatagccttgacctcctgaactcaagccattcttccacctaagtctcccaagtagctaagactacatgcacccaccaccacacctggctaatttttgtatttttaatagagacaggttctcgccatgttgctcaggctagtctcgaactcctgggctcaagtgatcctcctgccttggccttccaaagtgctgtgattacaggtgtgagccaccacactcggcctatatactgtctttctacatttttttttttttcatttgaatgcagtctgtggtatgatgctgcaaacttcaagtttgttcttgaagtttgagccttatgttactaagtttcatcaaaccatcatcttcattcatttaataaatgttgttagtgccagccactatatgtgctttagaattaggaggaatgaacatcggaaactgtgctcttttctcttcctccgctttccttggactgacatacatctcgttctgtaagacccaatataaatgtgatttccttcataaaacctgaagttatcaactcaatgaattattaacccactcctctacatttctattacactattgtttctaactctattttcttatttgatagtatttgatgatatgtgtgtttattagtatatattcttgcctagactgtgggtttatttaggaggactactgcatcattttatctttgcctggtgtccatccctgtgttgctcctttaggcagccatatctgtaggaaagatgataagccacataaattgcatgcttggaaatgagctttctgagaataatatcctgaacctgacctatattttgccacaccatatctcgattgtcagtcacttctctcggactccagtgccactttgtggtgtcctttattttctcccctccttcaggtatacatcatcccttgtctcttctagactttctcaatcgtgccccttccccagcttttttactttgacacagctttttcttggaggttcagatcctggagaaagatctggagaccagttacattttatactgagcaagctttcaattgttagtctattcaataaataggtgggtaagcaagtgaatgctcagaggaaacagacatttaaaaacttaatgctttttatagtaagtttggggtgaaaggcaataaaaaacaataccattggctgtttgtggtatttattggaatgtgggaaggcacacaatataggcctgaaaacttcactgtggcatgtggccagtatactcctggtcacccagtccttctgcgtcaccattcttgttgatacagtaatcctctttaaataagggggaaataagaaaaacacaactctttgaactcaagttagatcaggaaattgtggcaatttctggaatgtcaagagtaaaaataagaaaggaagaattaatcctgctagcccaaaatgagaagctgtcaccatcaaagctgtaactctctaaatgaatataacacctctgaaaactctcacaactgtgccaagtatttacatgttctctctgaatgtggcatctacagcaagtggttttggtcgtgaagcacaccatctgtgtgattacccaccccttgctagagtactctgaactcagcagttgtacaacagatgcatttaaatatacagtattcctgctctcatagttcagaatgggtgttagaaactgagggaaaacaaccagcttccttgaaaactcagactccatctgacatttttccagacaccttttgtaaccatgctccatgctatcctgaaagataacaacattatcataatagatttacacatagttaaaccaggtcagcctgacccagaacatcagcagctgctgtcataatcattaatgagtcagttaatccagaaggtgaaaccagatcactgtttggttttcattcaagtgaagatcagtgtagtcatgggaaaaacaagggtacaggagtcagattataagcaatccagttagatgaaaaaaaatagttttactataattcattactatgatgtattagtagatgtgtctttgaaaagacaacactagatggtttttgaggaacttacacaattaagaatgaaggattgaattccatccccctcttttatgtttgtttaaatactgcacatgcattcaccaaggtgttttattcagggatgaattcatcctaaatgcaggactgagatctaaagttgcattcatcagaatgtgttccttagtaaatgctgttgatcccttctgaatcatggcctctcttgcctccaattgatgcagtaacataatgttctttcagctggtcatacgccatgctgaatgagggacggatatttcttacataaatagcataggtttttttttttcttcattttttcctgtaggcccctctcctgttttccccatagtagtggtgtatgggagacagggatagggtcaacattgaaaaacagcacatgccaggaatggactgatatcaagaatttaagaggagctacggataaaagatgtattatgcacatttatgcaataaaagcctgaaccgtaaatttaacatggccagaaaataaattgttattaacattttcctgcaaattctgggtaagacttgcattgtggtcatcatcatgaggcacattaacaatcttgggaagactcattgggaaccagtgttcacaggtggcctgatggttgaggaagcattgtaagtgatgttgtaaccatcattgtgtaaataataaatttaggaaactgcagaggcaagaagaattaaattgtatcaatacagactccaaagagccttggtattgtgagtcataacagcactgctactttcttctctcagtggaaaaaataagaaaaacacgagtgtttttgaactctaattaggtcagaaactggcagcaatttctggaaatggagaattaactctgctagcacaaaatgaggagttatcaccataaaaagaacatgacaagatgtttttcggacctgaacaggaagagatggtgccaggaccctatgaagaatcttcacctgccccaaatgagtgataaacaaatatgtaagtccctctcctctgcccattgttttaaatctccatcaatacattacctcacatgggactatggattctgaatacaattttgatcaaaatagttgtatagacagagactctgcacaaaaagatttgccacccaggactgcatataccccagaggtggccctggtctggaaagccagattaggtccttttaactgtttgataattaataagtaaaaactgaaataatatttagataatgtaacacaatcaaattttatttcagaattgtactatgcagagaggctgtgtgagatgagttaatagttgtgaaaggagtgatcataggcatgagaataggcgggaggcaaatgcaactgtcctcatgaggctgactcacattcaagtgaaggaattgagggtccagacctggcaggaaatgagatggtcatgtctttaacagaattcgtgatgtctgaaagagaaagatgagttttgaggggaaagaaaatatgtttggaattttacattttagaacattggttatttcatttgaattttgagaataatgacaatggtggaatatctgatgaaattttggttacactgaaatccaaaggtcttttgctataatttctcagaaactgtaattaaaccttgtagtaattagaaagtgtattcagacattcagcagacctgcctttatctaagcatttccaaattagttaaattagttcccaaaacaagtaggagagaaatggtttggttttctctgtttagagctaccttcatccttatctatatatagcacaaatttgagatccaatagaaggctactggtaaaaaggtaaccatcagttttgacttatttctgctgaggaaaatacaatttgaaatacatcaccaaatgattattcagtaacgatccttgacttccatactgccccagaatggaaacaggcccaatcaatattaacacatgggtacaggagcattgctaagagtggaagagaggtgtttagaggtaggggtgtgtgtggtgtgtgtgtgtgtgtgtgtgtgtgattagcacaatgtctcaggccctcaccagatggaaagtacccacagtggcaaacaattcaatatcaagcaagaatatgagagataaaaataattatcaatggttatgaaaatttgactaatatttatgttattgtaataaaggtcccagacagtcttggtgactaagattttcatagaatatttgttgtttttaccacgttgcgagttttcatacatcatgattactttggcaaaattcgaagtgctgcatactgaatgatgtggttcacagcagtggcagtaaaaggactctacctacaatcaaagagtcatactgggttattttggatttaaaaagatttagtaataggctaacattggaataaaattaaaatttaaaattaatgtttttgaagaatttgtaataacaatgataagttgtttttttgaagtttacaaaaactttctccccagcacttttcttattacatgtgtaagatgagttaatgggtgtgaaaggagtgatcacaggcatgagaatgggtgggagacaagtacaactgtccttatgagggctgactcataaacaagtgaaggaattgaaaatatggttgataaaagtaatgttttgatgatgagaaaaattaaagcacagagtttaagaaaatttgataaacttaattaagccaaaggcagaaaaaataagaactagaacttccaaccccctctattcacttttctcaatttaaaatttcatctttagaaggtgatgtttatcagacataaaatccaaatcaattagatctaaatgttgggaaccttgaaaggtttagtcattctactgtttaagttctgtaatgactaagaacgtatcttttccttgtgttcatcttcattgttcctattttacccagagggaaacattctttgagtaggtttatagtaagaatagacaaacaatttaaaactcagcttgttatactaatgattgacagctaactatgttgtataatgggaagatgtgttggctagataacagaacttattatagaccagtactcccattatctagttaagtgttttaggaaagactttctttattccctctccccatctcaccactctccttccctctcccttccttcttttccttctgttctttaagaaccccactgttctcacctgaggaaagattgaggataataaggcctaccacataactaactgaacctccatgttagagagctgttgggacaattatatgagacatgtaaataactttaccccttttttcctgtctcagtaaatactaccacaatccttccaggtcctcattaaaacctttggagtcatcctgttttttttcttctcccccaaacctatccaactacaagtccgttaagatgtaccccatatttactttctccttctccactgctaccattccatcgtaggccatccagaaaactataatcacctctaactggttaccttgcttcttctcttgtcctcattcaatttattctctatctagcagccaaaatgggctcttaaaaacaaaaataaaatcatgtaatttctctgttgaaaagtctccagccatttcccataacactcagaataaaatgcagattacctaccatggcctctgaggcaggttcaagatggccacagattctgtgacattcccatagaaaagagaagtgtctgactttcttccctttgaatgtgggctggccttaatgccttgtatgattaaccaaaaagggcaaagtggcaggagtgatgttctgagacttccaggagaggtcataagaaggcgtggagcttggatcaaggcctgctctgggggaaaccagtcatcacataagtctaacagtagttagagacagccacgagaccgccatgatgccaacttgtgagaagagcacgccatgtggagaggccctagaataggagatgccatgtgaacaaagagcaccaagggaacagacattgaatgaaatcacctagttttgcagctttagctgccccagtaatactacccgcatcagagataaatgtccagaagaactttcccatatcgctgaactccaaattgtgagcaaaataagatgtttgttttaagccactaagtttggagatatgtcacagaaatggatagccccatagcctctcatgccataaaagtgtaattctttcccctatcttggagttcatccccttccattttcccctttgcttgctgcccctgagctgctgtggcttctctgaacacgtcaagcttattcctgtgccaccaccttgacacgtgtcatagtctttacccaaattcggaccccagaccttttcatacttgtgtccttgtcatggagctgaagtgttaagtatcaatgggactttctgatcactccatctgaattagcctcaccatgcctacatcgttctacttcctcagtgtactttatttttcatagcacttataattccctgaaatgattttgttcctttatttatttcctactaacccttttgcaaatgcaaagtaaactttttgagaccagggtcttttctgtgtttttcacaaatgctatttatagggctatttatattcagtgctatttatattcaatatttttcaatgcatgcatgtaaaagtgcttcaaacctaaacaagttttattattattgcaccacaagaaactattgcaaaaaaccattgagagctggagaaatattgactagaatctgctcagacatgttctaataagatataccaataagatgtagagaattaaaaatatccaacaacatcaaactttaagtccacttgagtcaatcataacagtacattttcatgttaatatctcctttagaaaactgacagtttggttgtactatttttctattctcccttggcacatggctcaatctttagtttttttttttcttttaacatctgtcctttaataacaatattaaaagtaaggtgttttggggtttagccatccataaagttatgggacaaagagtccatgagactgttaagtgtgttaatcatttaatataggaggcactgacccctttcaaagaaggaagaataaactcacaatctgatttatgtgaatttttgttttgctttacattttaacacccagtgaccacttagggagaaggctatcaccaatcaatagtatttaggctactcaagaggagagataacagagagagcctaacatatttgtagaaagagcatctctacaaggatttaagagacaaaaaattttgattctgtttcaataaacttattggtgtgataaactgtgtaattgtcagtatgtaccaggagagcaagtttaatatatattacagtagtacacattttaatatagtcagccagagaaacttactgactagtaagaaactgaaatgttaaaatgaaaatccaggcgttgagattcctagaatctctgaaaccatcttgcatctctctctccatctgcctgtcaacgtgactttctgaaataactaatctcaaaggaagattttagaaaaaaaaatcatgtggatgtgttttttttcccctaataaatgccaatcttaggcagtgtttttgtcaggagtctctgttcaagctttaaaagccaaaagaaagatgaaaatgaatacaccaaaatgtaatttaaaatgcaaatgaaggatctgcagaaaagcagcaaaggctaattgtagtttttcttcatgcttggctctgtagacaaaatgtgttgatgttaccttcctcctgctgggaatgcccaggctgtagctgtattgccacactctgacctctcagattaaatacacttgatcttaaaaaaaaacccaaaccccagtcagaaatcagtaggtacttaaccctgtataggaataggtggagaggcaaccatatgtgacagtgtggttgttaacctctgaggaatagaatagaatagaatagaatagaatagaatagaatagaatagaatagaatagaatagaatagaaaacagtagtttcatattataaagaaagggcaactaatctatatactccaagggctcacgtagtatagatttttaaaaaatcgagtcctgaatcaaggacaccatttgtttttaaatgaccaaggcttcagaaatactttagattaagttggagtcaattctaaaatgtgcagttgtagcttctttcttttttttcagtcctgtcatacctggacactatgtgctctacattttgtggtgagattggataaatgcattacttgcagcaaaaccttgttcactcttttaaaatcttagaacttgtccaattaaaaaaaagcacaaaataatttgtaaattccaacttttactttgctttttttcttttcctggaatggatggatgttataataaatacaagcaacattttatcacaaatgtgagtggtcttgcatatgtgcattaagacagcctactcaaaggtattacataaagtcctggagaaagaatggatttaccaaataaaataactgcttggaaaagtttaggtccaaaaattataatttagaattatttttaatagctctgggactcaagtgggatccatttctccattatatgtattaattagggccacagaacctgtggacagaagagattgttttctaattctcattcttcactatcaaaactttgaccaccgttaatagagttctactggttcttcatgctatttcctgccctccagtatgggtaatactgcattagaaattggtcagatggaaacaagaaggagcctataaagggaagagtgtggataattgtatgaaccacaccaggacataatgtggtctcagatgtctccacatatgccaagattgagaggctgttgggatcctaagttagggaggacacagagattcccttgtacagcttaagacagcacaagggcttgggactcacagctattgtattatgttgctttggacctatttcttcaatttcttcgtcttccaagatttaccatctgtgtcttatcctgcctgagagccatggctccttttagtaacacatacttgtacacgttaagaggaaaggaagacttccttgttaaactctatcaattactctgttcagggaatcacatccacctgtttgcatgtctgatgtggtgtgtttgagggtttggccagcacatgaagaagaggaaaaggagttgaagttcgcttctgaactttgtgggacatagtttaaccacatgaagaacaagatttaaagcaagtttataggtccagtcttaaaatacgcaaaactgtattagggttcttcatgcataactggtttattttctctgggatttcttgcctttggttctaaagttttgaacccattattttttcttttgaggaggggaggaagtgaactctggtgtttccttctcagaagccacatgactgagttcactggtgtgaaaataaaacccttttataacaacactcagaaatacattgttttcttctagtaattatttttccatgaatattttactttgttttataaaattaagactagggctgtccttaactgcctctgatgaacagaatgaggagacattctaaacacatttgtttagttgtttatttacgatgtgttataaatatgatacatatgacatcaaattgaaaaataaaatcaggggaggtaagagaagtcctaatgcagaaggataacagaaggttaatcagaaaataaaatttttatgaaaaggaaaattttatgaaatgaatgaaatgaattttatgaaaatgaaaattttatgaaaatgctcataaaaatcccactttagtcctctcgttaatctttggttgtcagtgttgctttacattgacagttctcacctttctcaagtgcttgaatgttcccttcccacccgaacgaaaggctaatttcctacttttctcagatagccagttgttatttctaatgtgaacctggcagtctgaataacaacaaagataccttattttaaagtctacaattattggctacaaaatatccaaatatccttttctgtatcactagctcaggacaaagtctatccaaaataagtaacgaatctaagatattaagatattatttgatttagcctctacatgattgtcaaatgtgttttagtatgtatgtttctctgaattcttccttccttaggaccctcacattaaagtattttatttatgataatctttcccttatgcacctccatagaatgattttaataactgtagtaacacattattttccttaatgattgcaaacactatagtattactatgcattaggcactatggtaaatactaattgttaacccatttatactttaacaaccctggattataaatactatgactgtctacattttacaaattaggaaactgaggcacagaggaattgattagctgaacaaagacaacacagccagtaagcttggaattgcaattcaaaagcagccggtgtgggtccagaattaatgttattaaccacattgatgtgctttttttctataataattactaaaacttgtgtgtttatcatcaacagtgtaatggaagagtaaagtaatatatctccactgttattatagtagtggtattattggtagtgtagcacttactctacctagtatctacgtgatgccttgaaattgaggtgccaaggaaaacagattattttcagccactgggaaatttgtatagggttacgtggctatgcagtgtgttttagattcctagatctgaagaaataactctgtgtcaaaggtggtttgcacagatttctggatcattatgaggagccctgtgggagcacagcatctgtagtggggtccagctctggatttagttacatgactttgggcgagttatctgatctctataaaactctgattctttctttataaaaaatcagataattatgatccctcaggatgctgggaggtgatattaaaaactgacaactgtcatgtgctgtatcaataaaagttttgctagagttttagcagagaaaaataattgtagacttgaatcaccactttgcatataacagttaaggcaagtagaagtcaaaggaacctgcactgtagaggtttccacattgtaagtaggcatatccaatgtgtgtcattcttgtatggaccaaatggcaatagtttattagcagtgaatgtgctattgattatattaacagatgcattagatttttataatgcagacttaaaaaataaaacatatgaccgagattgatagttcctacttcagtatccattttcctgtcttgccttagtaacaaacctggcacattgtggcctagaaattaaaaatgtacaaacaaacgacattacccttctttctttgcaactaggtatcactatgtgactaagttttggaaaatataatgtaagtggaaatattttgttgaaattatgggaagattgtttaaagggaaccaagtcagtagggaagatttttttttatccctttatatttactccctcttttgccgtgactgtggatatgatgtttggaactccagcatgagcttcatgggctatgaaacaaaagtgaaagacagctttcttttccatcttgcaagatggcagacgaaaaagttgataagctggatactaaggaggaaaaacctgatgccaagaaggctgatgccagtggtaacattaaaaaggctaaccttcaggctaaaaagtccaagaagaggaaggcccactgcagccaaggtcctgttctcatcacaggaattggcagatatttttggtctgccatgtattcccaaaaggccatgaacaagaagtactcaactgctaaatacagaattgaaagattcttgcaactgttacaaaaccagttgatggtgacaagaatggtggtaacccggtggttaaactttgcataatgtgtagctatgatcctattgaagatgtgccttcaaagccgttgagccacagcaagaaacccttcaatcggcatgtgagaaaactataggctagcatctttcctgggaccattctgatcatcctcactgaatgccacagaggcaagcaggtggtttttctgaagcagctgggcaatggcttgcaacttgtgactggaatactggtcctcaatctagttcctctatgaagaacacaccaaaaatttgtcattggcacttccacaaaaattgatatcagcagtgtgaaaatcccaaaacatctcactgatgtatacttcaagaaaaagcagctgtggaaacacagacactaggaaggtgagatttttgaccaagaaaatgagaaatacaagactatagagcagtgcaaggctgatcagagagctgtggactcacaaactttaccaaaaatcaaagcgagctgtcagctccagggctacctgtgatctgtttgccccaatgaatggagtttatcctcaaatattggtgctgtaaatttcttacaaagaacccaattaaataaccaatatatttttaagtagaagatgggatttataacaatggagcagaattatagcagccagaattcttgatgatatcatgggttccttgtatcagttatgggctatttcaagatttcttttatgataagaatattaaaagaaaaaaaactaaagacatttaaataactggtattttgatatcaattaccaaatcagtcttaacttgcataccatattactaatcttcaattaaattaagtaaaaatttttatatagttattgagtgtacatcagcttgtgaaaatacattgttattgagttttgattgaatctaaggtctgactatcctgaagtagcaaaggaatcttaaagttattaaatatatgtacttaagttaaaaaggcatttttctgcattagatcactgaattcagaaaatttatatatagaatcagacttgaagctgtaataatatctactatttataaccaacactttggttttagtaaaataacattatgttaaattaagttgataactttattatattcatagttttgactacatctattttattatcaatgttgtttatctctaagcataagaagtttttatttaatatgaaaaggagcttccatgattattattttcttttagaagggaagaataattttttcaagtttgaaaaataacacttctgagtatgacaaaaattatattactatattagctataaatcaatctgaagacaatagatagaattgatagagaacagagaattcagctacaacagtttttgctgaagtatccctgtcctgaatccgtctccctgtcctaaatccagaaggtttttttcctgacttactaagaaatttatatcgtcactttatttaagcaaaacaaactctaggattgcctgagaaatgtctccatcattgtaatagtaactttaaaaattagcccctttatcttcatccaactgtctttctcttccaactatatctggcctgttccagactatattctctcttgtatttacttttaattcagtcttgaggtctcctctggagagtggctataagctctagccttgccctgatggggttccaggagtgaccatagttgatgtttacaatatggctttcacaggattcttctttatcctggcggatggcctaacacctaagtatctgacctgtgaccaggcgtccctctcctgggaaacttgtttatgccatcggatgcactgtggttcttctctaatctgtgcccagtttatccctaccaagacagccaccttccagaacagcactgatcagaaggagagttcggttcagatgtattagtcaggtgagacagaggtggcagcacaacaaacacgtaaaataacagaagaaatttttactacttaccaatcttagagaaaagagggcaatacgtcttgcaggaccagtggggtctgggacacacatgctcaactagcaggtggggagcaagagagagaggagggaccagaggaccaaagcctttattggggttcagggtgttacccaaacaggtttcccagggcaagttctaattggtgggtttaaagcaagcaggcacgtgttccaggacgtcatgctatgactgagaagtggtcagtgtgacatatctgaacagagtgggaggtctgtggggacagtcaagtaggttggacctagctgtcccatgtggaaagggtcaccaggaagttgttgttgcacaaggcaaacatctggatcaatcacattgaggaactggtaggaggcagagaattggaaactgtcaagagtgactatgccctgtttctgtataagaaagtccaacttatacttaaaatgaatacggaggcaatataaaattataagaattcactagatcctgaattccagagccatttttttctggtaagaaacaagccacttcttgattagccatgcatgggggtattattgttatagtagcaaacacaaccatgtgaaaataattaagattcaccctcaatggtggagaatggctggttgcttcataatgcaagctgtggcagaaatggagtgaacacgctgactctcaaggagagctcaatggcccttataacttttctggaaggaacaccataatgtgtaatagaaccaacactggctttggaggaagaaactcatgggtttgaagctccactctgccacttagttctgtatgtctgttggtaaataatttgccctctctgaacggaagtttccttgtacataaaataggggtaataatacttatcttggaagactgttgtgaagattatggattgtatggacttatgggcaaaatgctaatgcaggacctgacaccgcaggtgttcagctcatggtagctgttattattaccagcctcgattgtgactttcttatattgtgatgaagaaatgcaatgaaagcctcaaggtctcaaaggtgaaagaggcaaaaaattaagaaacagggcaaagtaataataccacagtgaatcaacttatatccttgtcatgttcctgttttcaagggaggatgttgtctttttctccccttcacaatctagcccatgacaagcatcctctaaggtggctgtgtataacatggcactatggtggaggaaaaaagtgctaccaatttattaccaattacagtttataatctgggatgaggttaaaaatacttgataactgaatagcagaagcacctgtgttgcacacaccaactactagcctatatcagcctcacttctttccaagaacagtcagaatgaacacttagactatgccagcgtggaccttttcactaagtaagcagctgttttgatatattaggaaatgcctgaataagaaggaacacgactgtaactacatgactttactactcttatgcgagctgcttggagacatactctgtaaaatgtatcaacttttgcttggttttcactttcaaaaattgtttctgtcaacaaggaaaatttccagttccttaacaagtggaaaataatcagagttttaatcttgcacctcatagtaatagcgtagtaactggtattttctcagtatgcgcaccaaatattaaaaaaaaaaacttgagaactttcaccttggcaaatatgtaattttaaaagatcataggcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaagatcataggagacagagtaaccaaatatccaatatttcaatttagtctaaaatcagcagtaattcaagtaaataggaactgggtggtttttttaaatatgaaaatgcgactttgtttctaaaatttggcttggagacatgttaaattggtctgggaagtttctaagaatccctttaccttcaggctgaggagaaacatttagcaagctcacactaacagtgttggaaagggaagaagtataggaaaccaaaactcagtttttgattagcactatactcatgatacttctaaagacaaatcggttgtttccaaatcctttggctggtcggaatcctagggaatttgcccattgttggcactgtggtctttggagtgtatttgtatactggaaacccaaaggatgcaggaaacgtgggttggttacatattctaaacctcttaagggtgacaaaaaagcacccacagctctgcagggtatggtattttaggaagaatcattgcttgtactgtgctgtattcccatttaatgtacgttaggaatgtctgaaaggtattcaaaacctccagattcactttctattgactagatggaccatactggtagagctcctggtacgctgattctcaatctgaagccaagggtacagctagggctgtgttttctctgccagtacagtgaattaatcgtgggataactggcagaattcagctctgggtcaattttcagtacaaactctattactgtgtctaacaaggctgtatgaactgcctatttatgtatgcagaaatgctctatatagacaacattatctggtataaactgaactgcacttgtgccaagaaaatagctccacatgctgcagacatcttggctctcttctgctgcttttcaggtggtgtgaattctggcaggagccaaaagtcaaactccaggatagagcctgggtctctggcccaccagctatggtgggcagcttcatagagcacatgaggcagctccagttggcaagcagccccttccttttaattaaagccattggcaccttcggtaggggagaaacagaaatgggaatgagttggtcttcactgtacactgagggtgtcaaaactgatatcttcattaaaatagcttaagctgaacttatctgaaaatatcaaaaatttattacagggagtctaaagctttattatcatcatcatcattggggagggatcaggggcagacttatataatatcttgaagactcctaggctcctggagtgaaactgttatgacttggcaccaatgttgctagaacatcttgtaagcaggtacaatgccaaatgaacacatgtgaacaagaatgctcagcaaggaggaaatgtttattttatcagtgagtatcataactagaaataggatagaactgatccatctgcttcatggacacagccatccaggcttcaagacaatagataactggtgcagaagttggtggcaaaaagaaaaaaaaaaaaagattgtgcatctgtcccctagtcaagcctactaaacaagcattttctaaggtctaagcatattttacctgcccatgctcccagagaagggaaacattggaaatcaaatctgtatgctttgctgctcattagacattgttattctctgggcaagtagggagaagagtggctaattgttttgctgccttttgcatgtatattattgatgaagactacatagtttcattgatagttcataaatttgcagataatatgagaaggaaaaggaaattcagtgtgtgtcaagagcagacaacttggtttatttcttcttatatggtaccctaacattgtctttggagagagttttccttttctttcctttttaaagtacaactttattgaaatataagtgacatacattatactgcatatatgtaaagtgtaaaattgataaggttatgtatctatccatgaaatatcacaagtaagataattaacatattcatcactcccaaaggttttcttatgccttgttgtaatcctttcttcctgttacaccccatctttctcactctctttcccttttcccaggcaaccactcagctgctttttgttcctatagattactttgcattttctagaattttatctaattaggatcatataaaatgtcttcttttttgtctagtttctttaacttattacacttattttgagattcatccatatgattatgtgccaacagttcattcttttgtattgtagagcagtagcctgttacatggataaaggaccatttgttttttcattcacattttgatggtatttggattttttccattttttttttactattacaaataaaactgctatgaacattcaagtacaatactttgcatggacagttgcttttatttctcttgggtaaatatctaggagtaaaatggctgactcttatttatttaagaaactgtctacctgttttccaaagcggttgcgctgttttacatttccatcagcagtgtataaggttctagttcttccacattcttatagacattagatatggtaagttttaaaattttattcatcttaataggtgtgtcatggtacctcaatgcagttttaattttcatttccttaatgactaatgatgttgaacatcttttcatctgtttatttgcagtcagcatgaattctttgggggaggtgtctgttcaaatattttgcccattaaaatttttttcttattgagttttgagatttctttatgtatcctttaagttcatcctttatcaaatatatgatttgcaaatcttgtcttcctaatctgtggcatttcactctcttaatggcatttttaaaagagggggtttttaattttgatgaagtccaatttctcaattttgttttgatagatcttacttttggtgcagtactcaaggagtcttagcttaacctaaggtcccgttcttctacatttcctgtttctctctctttttattccttggtgcctggagcagaagtggcagagctggtttgtagatgtgaagagattcctgttttctgcattcaatagctctgtgcaatctggctacttgccatttggatttaaagcattagaaaaaagacaggagcaggagacttgaaaagtttctgtgaaacctcacattataactaagaaaagaaagccactaattgctttcagagaacttgtcaagaaggtttcagatgtactcgcagtcggtttttccaagaaaaagcaaaagcagttttatacggtattttgaaatgttaaccagatttcttaaaacttgtgttttgatagctaaacaataatagaaataaaatctggtaaaagttgttacctaattcagtgaacttttcaaagtttttattttcttatttttatggaaaagaataaccaaaacattcacagagtgaaaagtctgcaatactagggcaaagcacttgtttggcacaacaggaaaataactgcatcataccagagtgggaatacatgcagctcttctctagtttctaaatctgaaagcagcattattatcaggtggtgattacatttttggagtgaaacagtgaatttgtcaaagcacttatctattctgcttttggtaatactagcttatgcttttttcttttccaaatgctttttatataaactatctgatggcattctcatcactgacattactatacatattagagaagttaggaacttgaagaaaagttaagtattttgctcaaggtaacattgccagttagcagaaaaaccaggatataaacattttctttctctaatagtttctccgctgttaggtgctgctccttaaaaaaaacaaagcacctctttctgtcagtgggatgtttaactgtacccacttctgcttctgttaatatccatcaatagatgagagttaaaatattctttctcttactttgtgttctctctaatttagattttatatttttgtaatatgagcttagagaatgactcaaaataaacaatgttggtactgaatgagcagttctaaaaacttaaaatttaattcacttaggttataataatgcagatctcaatattccatttggtcacaattttaggaaatatttgttattaattataattctggtataaactacatttgttgaaattgctttaattcaaggcagcttctataggatatttttcaaaacatcccagtgttctgagtgaccaaatacagaaataaagcctgtcccttaagacatctaccttaaaggaaaccttataactgtgaaaagaaaattatttgaaaagtttccatttaacttaattaaatatttatagagcagataatctaaaagagttgcttagttaatgctaggtgatccttttactgaatatctattttgatcttatcactcatattgctcattacttttaagacttttgatcattttacagaagacttgggtcttctgtgttctgaggtttaggtttaaaactatgacactacaccgaggagggtgtctattgctaaagctggtttaaatagtttaacatgcagtcagaaaatttgttttgcattgacaatataaaagctagctgaagggtatggaaatgctcatataggagggagggagagaaggttaaatttcttgccatgggccacgctggagcaactgttaacaatttaaacaaggattttttttttttaaccaaaaccgtgcaagcatggtttctttccttgaggcaggcaaaggacatggctgggctcatacatttttagcagctggcatgttaatgagataatttctattgaaatgagctaaatactattaccatttgtggacttccagctgattctaaggcatttattgaacttcaaaaagtgctccagaatcaattcaaagtacatttttagattcatgtgtatgttggtacctatatacatgaacagtcaatgtttatgcttatgtgacttggctcatgaagtgtccagatttcttaaagcttgtgttttgatagctaaacaataatagaaataaaatctggtaaaagttgttacctaattcagtgaacttttcaaagtttttattttcttatttttatagaaaagaataaccaaaacattcacggagtgaaaagtctgcaatactagggcaaagcacttgtttggcacaacaggaaaataactgtgtcataccagagtgggaacacacttgagaatttcagatttaaactcattatttttaattataacactgtcataacaaagcaccatagagtttgtggcttaaacaacagagatttattttcttacagttctgaaggccagaagtccctgatcagtgtctgatgagggcttttttcttcgctttctgatggctgccttctctgtgtatcctcacgtggccttccctcattgagtacatgtggagaaaaagagagacaccaagctctctggtgtctcctttttacaatggcattaatctcatcatgagggcatcaccctcatttaaccctaagtacctcccaaagatcccactccaaataccatgacattgggggttaaagtttcaacatatacatttgagggggagacagacattcagtccataagaaatggcatatgtggcatccatatgtggggaagttgtccctcagctgttgtaaatgtgggtctggactcaagagtgagatctgatgtggagttagatatatcttgatagatatagatgagtttcctctgcaggtcactgtttccccaacttctctttactgtgagtattgtcaaggtctcagccccaggaattcttacttctcatgctactacaacactccctggcaatctcatacttgcttatggcttctaccaccacattcaaattggttaaaaataatgcaaaacttcccaatctagtgtcctattttttctgacatttcttccaactatatcctaaacatttccttctaaatgtccgtattggtgtctgacacttgagaatttcagatttaaactcattattttttctgaaatatccaccctcaataacaaataagtaaactttttatttcctctgcctaaaataacaacaccactcatcattcaggtgaccattcagtgatgaagccctgtctccctgtactcgtttcctattgctatcacatatcaccacaattgtagtagcttaaacagtacaaatttattatgtacagtttggaggtcagaagtctgacacgtttctaactgggctaacataaggtgtcggcagggctgtgttcctttctggaggctctgggggaatctatttctttgccagctggaggccgcccacattccttggttcatggcctttcttccaccttcaaagtcttcaacatcaagccgagtcattttcagactgccgtctctgtttcttcggatttcctctcctacttttaagtataaacttgtgattaattgggctcacccagataattcagagtaaccatgctattttaagttcaggtgatcatcttccttaattccacctacatccttaacttatctttgtcatgtgacataacatattcacaggttctggggtttaggacttggacatctctgaggggccataattcttcttcccacactctcctctattccatatcccatgaacccacaaccccttcaacataccttatcctgctttatttttcttcattgcatttattattatctaatgtatgattatagatttacttattttttgcttcctgcactggaatgcaagcatcacaaggcaaagacttcgtcttctctgtggctgcatctagagccatgccagagacatagtaggtgctcaagaaatatcctttgaatacatgaatgaaagaaaatctggtttctcactgaagactgtcagtttgacctagatggcgtgtttccatatccattcccttttattcatattcactgtcctttgtattatttcactttttttccctcaagaattttcaccattttagtaaattaatagacagtgtacttcagtttctatcctgtttctaaatcacaaatctgttcatcttaaccttctacttaaaacccttcaatggctctttggcaaagtttatgagattatgtgtaatccgcctctgcccatcatttcctcatattcttctttacactacatactccatgttccagagattctggaatatttgttcatgtttcgtatcttaccttctttgactatataaagaaatatcccttctccacattgagttcctctttttccataatttcagtggaaatctctgcaaaaagttaactacttcctcctttgaggctatcattgtcaggaataacaggaagggtggctcagactgtgaacatatatgagatattttggatatttcttaattctaaaagaaagatttaaatttagattctgctgatagaattcagattattgtgttattactcatattgtgactttatttatttttttgagatggagtctcactctattgcccaggctggagtgcagtggtgtgatctcagttcatcgcaatctctgcttcctggggttcaagtgattctcctgcctcagcctccctcgtagctgggattatagatgtacaccacaacacctggctaattttttttgaatttttagtagaggcagagtttcaccatgttggccgggctggtctcgaactcctgatttcaaatggtcaggctcagcctccaaaagtgctgggattacaggcatcagccaccatgcctggcaatattgtgactttttaaatcattctttttctctccccaactcccacggacatacatagcctactcgggtcttttgagtttgtgaggctcattgaatttcagattatgccattgatatttaatattcatcattttattgtactagacattatatatattacaagtaaatatatttttataaattatatatgtctttatttttttttactctgtgggctcttatgtcagtttttctgggctcaaatgttaactcttactttgccagctatgtaaccattgagtgagtgagttaagctctctcagtctcatctttttcatctggaaaatggagataataatagtctcattttataaattgattggtaaataacacatgtagcatgcttaatcagtgctaggcacatgtgcctaatatgtgttagtctttattattattctagaaggtgaattttctgagggaaaatactatttgtaattcacctctgtatcctcataatcaggcataattttgatacatagcagacaatgaatacatatttgttgagcaatgaatatatattaactattctcagagtgtcagaacatagttaatgtatgggaaaccaatccagaaataagccttatggtgaaaagattttaaaaattatgatactaatttccttctttctttttcccctcattctgtgaattagaattttgacttagatagaatgcatcaatatataattagatggtgttatcgaatgtgaaatttaataaacaaaaactaatttgttggaattatttgttcagtaaataaatatttatcaagggactagtacatgtagggcattcttgtaggtactggagtcgcaatgttgcattctttgtaactggaatcagacacatttttctacatatttctaagcagagtaaatgacggggtctgctaaggcctggaatctgctctgttttctcctcattaagccttcagggacaaacttagaccagagtgaaaggggaacaagctaagtgtgctgttctctgtcaagtcccatgttgtttgtaccaggatgaccttgactttgtgggaggcatcatccagactcccctgctcagctttctgagcatggattgctgcaggactaggtgtcttccctctctctgtttcttctggttcttagccctattagcctcccttttctcccccaacagaaaatctctttcacagacatggtccaaagtgactctggtaattttcctgattttcaggcttttaaacaaggttggctcttgaagtactacttcagaatagagtgcagctcttggctggctagtcctcttattgcaagccatttccatatctttggcatataatcgacatttgtaagtaaaagccggcttatatgaatcccggttcatctttaattactgactcctgagatccctaggactgaatatctcgccatatgcccattccagaattgtatagtattcttctgctatgcagttgcaatctacccaagccttagagtagaaaatctgattatattctccgtgtactttctctgtcaggaatagtttaccctattataatcttctaaccagcaccctctatgggaaatagtctctctaatatctgagtatggctatgtaatctgagaaacgtcatatagtgaaacttacactgtttaacagtcctttccctgattagcaacattaatcagcaactcagccacccacccctacttatttctgtctcagttgcttcatatgtagaaggagagtgatactagtacctagcgcttaggcttgctgcatggataaaatgaattaacatgtgttgtgcttagcatgcttccagcactttgtaagtgctcaataaatgatagtttttatggttcttattagtattattacatagttcccaagggacaaaaagatattagttgtaagtgttcctaatatattcttttatttaattgggatattgtagattcattaaaaaaacttttgagaacaattttagatttacggaaaagttgcaaagacagtctagagcattcctatgtaccccacacccagtttctcccattgttaacaccggacattactatggtacctttgtcaccactaagaaaccaacattgatacattactatcaactccatactttgttggaattcactggtttttctctcatgtctccatcctgggctcccatgcatgatactaggttaagctcagtcattatgtctccttaggtccccccggcagtgacaatttctgagattttccttgtttttgttgactgtcagttttgaagagtgctggttgggtattttgtagaattctctttgttttgaatttgtcatgatattttttcatggctagactggagttatatgttatcaagaagacagtggaagcaaagtgcccttctcatcacattttatgattaatacagtacatactattaatctgacttatgttgatagtaaccttgatcatctggctgaggtaatattatgtttcttcatggtaaagttaattttactttgttttaaaagaaatttgtcatagatctttgggaggtgtgcaaaatataaaacatctcacatgtcaaatgtaagaataccaaaggcttactttaatagagaagcagaatcctacctctcatttggaatatattccttgaatcctatcagaaccaactattgtgatgaaaagatagaaagcacatcacctcactactgcttccaacatgcttttttgcccctttcttcacacagttggctggaaagctaggcaggtatgaaattggtggtaggaattaaaggagaacatacagcttagaagatttaaataatggcaaatgggtcaggaagaaaattgtgtggtaaacataattaggatgtcagtgaaggaggaatgtctcagggatgaggcttcttactgaagaaatggggtactatgaataaggagggcttgaaggacagggttatgggttaagactaaatgaaatgaggaaacaaactatgtatgaaatggggaaagaacatcctaggtgcaggcatagcaagtataaaggcctagaggctttgctgatgtgttctaagaatggtaaaaatacattctaattgccagtgatttctagatgcttcttaggaacttactctggttatgaactctgcagaaaatttagcctggttctgaactgtgtgaagtcatggatgtgtttttggaccaaaatattgtcatactgtcttaactttgaacaggctaaactcattttttctttcttgacatttttcccaaatgagtctttggaaatactaagaaaaaattaatacagcaaggatttgacttcattgcttactcctggaaattctctaactccccaggaatatccgtggagattttcctctaaaatatattgctctctaaaatgtttcattaactctcagctgtgggttcaatcttgtgatcagcgtgtccagggaagccagagaagcttttgttaagcttgtttatttgtagcaggtgtttgaatttgacatttgatttgacttaaccatattttgggagactgcaaattaagaaagcttctgaaatatgcagaatctgttatgcagaaacatacttacagatatatgggtggaattaaaggaaaaagctttcaataaaactcttctttttacttgaggtttgaaaaggcttgatacttttgtaatgatccacagccagctgatttcagttcaggaggctaaaagggatataataagaaacccgttcttgtaaaatttcagtctgtctgaaacaagtctgagcaggaaatgtttgtgagaaacctgttctctcagagtcttccctcctggttcctcatttcaggaggcttcttccacacccaaatgaatatctgaaaggttagtgattttttttcatccatattaagactattaatagaaaataggctggtgggtccaagttttcaatacagcctagtgacatagcatttcttgtttgctcctgatcagttcaacatggtttcatcattcttgaaagctgactttgatattcaaacttaggaaaactgtaagcatttcatgtccctctctccgttgcagaccctgttcattggcactcccctctaagctgtgaaagcagaaccacatctgtcttgttctctactatgtctctccctcagagaaatgcctgccacatggaatgtgtccagtgaaaatgtattaaatatatgaatgactagtacataacaactgtgtggcatctaatttggagaactcaaaagccataccaggctctaggaattctttacccagaattcaccatctcatgtctccagcattcatgcaattttcatcctaggaatgactcaaattaattactcttaataactcttaaggtaaggaggtagataattttataaaaattatttttatataaatccattaaaacaaaagaatgtcacatgatgtgtttgcaatcagattattactttactactaattttatgttcataagaattatattgccaataagattggtaatagtaataacaataaataatctttagtccttaaaatttaaagccatacactatattagaaccaactaaatattaagtactataatagatgctatggttgaatacagaagaatctaaagaaatagatgtttaattctgagtcatttaataataataataatatttgctgaacacctatcatgtgacaaacactgaactaaatctatacattaaataatttagtcctcataaaaggtctatgagctagttactactggtttccacattttacaaatgaggaagttaaggtttgggaagattaagtaaattgtccattttcaagctaataggaaatgatgaaagtagaagttgaacttgcttttttgatatcacaagctactctttttccttggacatttaacttcattgtttgttcttcaagtttatattttagttgaggattcagaacatacacatgaaatagtacttgccaaacaatacgtaaatgaccatagtaactataatacagatttccaaaacccgagaaggtatgttcaactgaaaaggaaattcatattggaagcatttcctcaagaaagtaagtttgaatccatatgggaaactgggaagtaatttttgtgtaggtgaatataagagatagaccgcaactaattaggttaaaagataagtctttacttttcaaatttataattctaggctcctggttagataatagtaacaacagtaacaaaaataataccactttatatctgtataacatgtaagggtttaagcagacacaatttgattttatttgtagattaatgatccttcgtatgctatgatcctctttaatattagaaaaaagcaactagaacaaacttcatgataaagcttggaaaagcacagtatttgagaaccttaacattcaatatatgctgaagtaatgaaaaccatccatagtcttgccatgaattccttttaaattgcttatgaaattgtgagagtcagcctgcaaattcttcccttctctactccaccctatcccatctcacccagttcccagcacacacacagttctgctatttttgaaaagaaagaaaaaagtctccacattattggtgtggtttctatgatcatgggcagaactgctcagaatattcaccaactatgggagtatacattatctgactcaattcaagtctggtctttgccagtaggaaacccttgtgttaatttctatttctattattgtcaaagatgacacttccacttctctattttatttttgcgtctttcatatttacgaattcaaatttcatattttcttcagaggaggtacatgtgtttgtaataaggaaagtctccaattcatgaggactccttttgtctactttccccttttcagaaaagcgtgttaaattaactaaagaaataattggagaaaaagcaagttagaatattatagaaaagaataaaatgatgaaacatatgtttcattttatttcttttttgagacagagtgagaccttgtctcatatatatatacatatatatataccttgtcatatatataccttgtcatatatatgtcacatatatataccttgtcatatatgtatcagacaaggtctcactctgtcacccaggctggagtgcaatcatgtgattatagctcacttcagccttgaactcctaggctcaagtgatcttcttgcctcagcctcctgagtatatgggactacaagtgtgcaccaccatacctagtaatttgttcattattattattatttgtagagatgagatctcactatatttcccagggtctttttttttaagcatgctgataggatatagataggaatgaaaggggcaacagagatttgcctttacaatgatgtaaaatgctaccaaaccttcagtaataatattcagtcattagtggaattgagtgacagtataaactatgtgtcatagatttctgcattaatccacagtgagtcttagcatttttgtatattttacaacatataggagaaaatagatgttgttaaagagtatctcctgaatttacaaaataataaatttaaaaagcaattgtctatccactccttctataagacataatgaataagagccttgtatgatggcacaaagcaaaccatcattagacaggggtgataagaaagaaaagagtagctttaagccagagggagaaaatagtgaatgagaagaccaagttttatttcaggaataaactggatttataccagaaaaattatttgttttgatatgaaaatcatacctttgggttaacacctctcctagtaatctagattaatttaatatccatttgtaatacattttagtgtccttcataaatgctaaaaataagtgtacttacacatttaccagtgtgtggtcccccatgggaaggaaagggaaataaatagagggattagaagtcacttctgggtcacgtgttccccaataccattttattcttgatcctacatacctactggtgttcacagaataataaaaaataaagactccaaattcctttctaattctagatgcattttttaccttacatgtggtatatttaataaacttaaatatcagagctattccacctcttaatataatatttacatttgaacctgcatagcaaggtggcccttttcattgtattagtgtttagttattttaataaatattgaaattgagtaacagaagcaataacaaaaaatgaatattgaatatatacttattcccactcaaaattaaactaaaatcagttgcatcaagctttcagtcatatttgtgtcaaacatttatgtttttcctaaaagcagtaaacaaaaactaagggtgccaatgtttcttaaccgaaaccttaaaatattatctttatatttggggagatttagaacctgagaacaagatttctatgcattttaaagtgaggcctatttattcttaactgccaaaagaacttatagtaaggatttataaatttaggacaggttggcagtggatgggtaggttaaggctataaaaatgttcattaaatattttttaatgaatgaaattaggtaatctaaattcattcattaaaaaatatttaatgaatgttttctatgctccatacctctttgctaaatcctagagatgtccataatggcgaacaaagccagacccatcctgctgtcttttagctagcagtctagaagggaagaaaatattagttcatcaacaaacgtgtgaaaccgccactgtgagaagtactctgagggggaggtaagtgctgtaatgagtggattttaaacagttggggtgtcagagaagtcttcctcaaggaagatgcctaaatgagatctgcaagttgaataagcagataggtgacaaggtgtgtccctgacagtgaaagcaggagtaggagaacagtgaattgaaaccgacaacactcagacaaatgggaagcaggggctggggacataagtagaaagcagatcatacaggtccttgtaggccacatgaagaatttatctttattctaaggtaggtgacttaatcaaacctcctgccttgcattttgaaagaagcactctagctgctttgtggtgaattggttatagctagtatggggtagttaggttagagggaggcagtcccagcaggcaattattaggcaagtccaggcaagtgatattgtgtcaggggttagtgggagtgggtatggaaaaggtaaagggattcaaaagatctataagagataggtacattgccatggctagatgatagagcggttatgggctctctccctctttatgtatgaattcacatatcatatattactcatattctccatcgacattatataatacacatatactatggatatatgtagataaatgtaaacgtgtaggagtgtgtgtatacatatatgtgtatgtgtgtgtgtgtgtatatatatatatatatatatttatttatttatttatttatttatttcagagtagtgcctaataaaggatgctcaaatagagcaatactttatggttaatatctcttttacagcagatcttcacgctttctcttatttttccctactaagtacagtagtcaggaatttcatgtaaacagacaatatgggataattgagtgaaaatagacggatacattttgtctttattgaaatgattttgaccagtttaagataattacagcacacacattatactttttcacactgaattatgccaagtttcccaaaaccactaatcaaagaagtcatttaaataatgactaaattatgataatgtattacagttgaaatgacaatagagaagaattaaaagtaaagaatgctaaataatgcttaattgccattatctaggtaaaacacaaatgaaatagggtcagcctgaagaatgatattggaaaagtgactgggttctggaattgaggcttaaagttactaaatttttttgttgtattgatttttccctgtcatgatcatacctttctttttgatgaattttgcaacttttataattctgatttgtgacatagttttaaaaaagtgtaaagtataattaaagtttccatgtgcttctcataccaagttttattcagctagctgttaagtaagtgattaccctataagtacaactttaataccctagtcacctgtatgggttctgccactggatgttttattgaagaatttttttgggggtgaatttatatttctcttgtacagggctcattgtttattgaataattggaggtgggttatatctagctataggagataccaatgtttatacaacatgagcacttagatcttttgcatgacatttggatataaatgaaatttccttttgaaaataatgagcaatgggaaatggcatgcattttaaaggatgaattaagttgacacaaagcgctaagatatgttaagattttatggtatgatttactcaagtagggctttggttgactaagatgaacagatcttgtcagcatccctggtaagtgtttgggatgttttgctgtggtatgttttctaaattgtatcactatactttcaagactctaaatgaagcagtgtgctgtttattactgtactacctcaacctgctcatagcagaaggaacattttaaaacacattacaagtgctctctcactcagtctttcatcttctgtccattattaaaaacgacctataagaaatcacatggcaacctagagtagttcagggaaatattgagctttgacttcaagtgtgtcttccttgtaatacaaatagccattttcagttgatatgttctatcctgaatgatttggcttgaaatgtctttctatattaccattaatattttttgtttgtttctgaaacaaatatgaaatggaaatgtcatggacagggaaattttaaatggctacttctgtgactcacagccattttagcttaggcttcctatttgcaataccttcctgacagcagtgtttctttctgcctttttgacaatattatttctgggaaatcaagctaatttctatttttcattccctgttgaaaggattactcatatcctctctcttactcctcatgtgtccttatctctaattaagatgatcaataataataatccatgagactcttttgaaattgtttttcctttaatgaatgctattaactttttcccccatttaactctgtatattgatttttggttccaattctaccacttttatgtaccttttcttttttccaattcttctttcaccttggaatattctttaactctaagaagataaattaattcaagattttatatgtttacagtgttacttataacacaatttatgttatattttaaaaagttttataaagtatttacagactcaatctcatttcatttttttttactatggtagaggtaattgtccttattttggagttgaaaaaatcagggcttagagaaattaagtaagtgacttgcccatggtaatatttttggaaaatgacaaagtcaggacataagctaagcaatattattactttaaaaatatacagcctaatatttagtaaatcagatatgtgaagcaatgcccttggcattggggatagggtagagctaattccacaactgggtattttgactcgatttgtttcaatataaatacaaaacccagatgacattgcttatgcaatcagtttatcaggagttacaggcatacctcattttattaggcttgacctcattgtgcttcacagatatggtgttttgaaggttcgtggcaaccctccttgagcaagtctattggtgtcatttttccaaagtatatacttactttgtgtctctgtgtcgcattttagtaatgcttagaatatttataactttttctcattatctgttagtgtgagctgtgatcagtgacctttgatgttattcttgcaattgttttagggtgccatgaaccatggccaaataaggtagtaaacttaatccgtaaatgttgtgtgtgttctgactgcttcactgaccagccattcccctatttcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgccattcccctatttctttccctctctttaggcctttctattctctaaggcacagcaatattgattttaggccaattaataaccctgcaatgatttctaagtgttcaagtgaaagaaagagtcatgcatctttcaatttaggtggaaagttagaaatgattaagcttagtgagaaaggcatgtccaaagctgaaataggctgatagctagtcatcttgtgtcaaatggtagccaagttgtggatgcaaaggaaaagtttctaaaggaaaagtgctattctagtgaagacccgaatgataagaaaacaaaacagattattgctgatatggaaaaagttttaattggagagaagatcaaaccagccacagcattaccttaaatcaaattctaatccagagcaaggccctaactctcttcaattctgtgaaggtggatagaggtgaaatggctgtagaagaaaaattggaagctagcaggaagttggaagaagaaaacctcacaaaaaaaagttggtttctgaggttttacggaaagaagccatttctgtaacataaaagtataagataaggctgcaaatgctgatggagaatttgcagtaagttatccagaagacttagctagctaagatcattgatgaagatggctacactaaacaacagattttcaatgtagttataaaagccttgaaagatgaaaaatcttgaaagaagatgccatctaggactttcctagatagatagaagtagaagttagtgtttggtttctaagtttcaaagattggccctcttattaggggctaatgcagctggtaactttaagtttaagctaatgctcatttagcattctgaaaatcctggggcccttaaaaattaagctaaatttactctgccagtggtctataaataacagaacaaagcctggatgacagcacatttatttacagaatggttcactgaatattttaagcccactgttgagacctactggtcccttgagatggagtctacacctgagggagatgctatgaaaattgttgaaataacaacaaaggatttagaatattacagaaactgagttgacaaagtagctgcctaggttaaggggacagaatccagttttgaaagaggtattatgtgggtaaaatgctatcaaatagcgtcacattctacagagaaaactcttgtgacaggaagagtcaatctatgcagcaaacttcattgttgtcttacttgaagaaattgctacagccaccctagccttcagcaacccctaccctgatcagtcagcagggatcagcactgaggcaataccctccacaggcagaacagttaagagtcactgaaggctaagatgattgttagcatttttagcaacaaaatatttttaaattaagatatttacatggtttctttagacataatgctattgaacatttaatagactaccatatagtgtaaacataacttttatgtgtgcagggaaacaaaaaaattatgtgactcgctttattgtgatatttcctttattgcagctttctggaacagaacccacaagatctctgaggcatgcctgtccttaatttaccctaatcatggaggtgctttttatttgttttaaaagaaaggaacatcatattaatataaccactgaactcacataaatacaatatgttcttcaaatttctctacatggaataagaatagagcttgcaattttttttttgtatttaactgatagtgtttatggatagcatttaactgatagcattttcagaacaatgggttgagttgaggggtgctgtggcaaccattatatggagccaggctactgatctgtacacagaatggcctcctagtcttggcaaagctttgaacctcatgagtgggccagctaatagaacacgccaagagaccatagtctagctgctgctggagagcttatattgactgctgacgttgataattattctgttaacttatatcgagaaatacttcctctctaaaacccctaacacagagcaagaattataatatctacatcattttagtacattccacaaaataacaagtcatgtactgtatgagttaactgttccatgtcctctaagcacttaggtggaaacttggtgacccccaaatatactggaaaatatttttttccctgaacttttctgtaagaattcttagaaggtagagtgtctgattaatattctagcatagcaatacaagtttagagcccttagttgtgtggaaaatatcttaggagaaaactgtcacagagatttaacccttgggatagtatttagagtggaaacaaaataattacctagagtgttagaacattttcctgatcttaagtttctttgaaaataatatattttgaggtcagtaagtcagagacttctaagaaataatcgagaggacccaagtttgatgctcactggctgttgcttacaattttaaacaagatagtgattaagctctgtacaaaaaaatataaagctatatcattagaagaagctttgtcttgggttcgtgaaatgttttgaaataatgtttgcaatgagtaaactagtttcatattggcattgtgatataaagccttctttaaaacaaataagcaaacaaacaaacacataccccttaggcttgatacgtgtaaatggtagtttagaagatgccttccttttaaatcctatttggccagagaaaaaggctgcagttctacacatttccagcaggggtcaatatgctttcatcattactgaatgctcagtgagcaagcagcagaagtgttgatcctaattggagcagacacaaggatcttctataatcctctgacatccttttcaaataataattcttaggtgggtggtgggctggtggctgcaatgccagtgcaggcttctctacaatgaagcctaaccattgtcaattatttttgatgtatgctagcttaacttaagtctcttcttcctggcttttccaacccacagaagggtattcttcctcctaattattgtcacagtacctaggatggtcagaacaagtgtgttattttggcttgatgtgctctccaaaacccattcctttcctttcctgcctctctgtgctcttcctacaaagtacgaagagcaagcatatactttcagtcaaatatctgaggagtattttacttataaccttaattgccatagtcattggactttaactcattaaatgccagcatttggaggcaactggagatatgataatgagtatatatgattatagttgcatatatatagcttccagtaggttaataattgggactaaatcctcctccacccacacactttctaataatttgttcaggggctctgccagccagtgatattcagggaacaaattgtcatcctttatgtgcattttaaagactggcgtttgctggagactcacactgtcgtgcagaagcttgagttctctgagtcaaaaaaaaaaaaaacaaaaaaaaaaacaatgtatgtcctgccccacattcgtaagctcatattttactctccttggccctgactacagccctttctgctgagcggggaagcgaatgtctctgtgtagagacattttcagaaatccgattctggagagctgaggagtgttgcggcaggaatgtattaccaggacacttagaaggtggttaactgcttgagtgctgctgcctgcactagagagagaagggagggaccgcagttgtaatatagctccagctccactcagcttagccaaagtggggttttaaagcggtgccctcatatatctctgtaggtagtcgggggtgggggtgtcatttgcaaggtaaaacataggtaaaaagtaaggacagagttagcacggcaaaagcagcagttatttatcttgaactaggttcacagggattgagataattttccacttatatagagcttgagaggctcctaaaaataaatattctatcacagatttcagtcagatagaaaggaatatattcattcctacatgtaggtacattttaaatgttctctttaaaattgtggagatttcttttgctttcagagattaccagtaccctttaatgaatcaataataaaaacaaattcatttatctctgttatttgcaaatcttgctttaaaattcatatttaagcaaagcaagtgatgaaattctttgatgggactactccttatctcctttactttaattctatgtttactttaaaaacaaaacttacataccttcctcaaatttagagtaaggtatgaggcataaatgtaagttgatggagaggacagcagctatttcagcttgggtctgacagccatctgacaggtgatactctatgtctctgacggatagtcaagagaagctgggaggaattttgagctcattcttggcagttgcagcagcagattaatttattttttttaaaggtcatcgttagcatgaatggaaaaatgggttggatgcctaataatgcatctcttaaaagaagcatatatttatttagtcaagacgtatttattgagtgcctactatatgccagacactgatagaactattgggctatattgatgaataagataggcaagggctgtattctcatggggcttacattctgcttgttaaaatacacatgctttgaaagtgtataagtatatgttctaaaaaaaacttcagtgcatttttatttcctcatttcacacatttgcttcttcatatttaaaatgtaggctgaaacactccttatattctttgaaggtgaaaaaaatatatcactgcagggtgaactacagaatttcagtgactacagaagtgcttcaaaacctaaattgggaacagagtggatgtaaaatggtttacaaataattagcagattaggatgctttttagttactgcgtccattcataaaactgagcaaagtgtgtctggagcagctgacaccagagttcaaggttgcccatctcctctgcaggaggtcgtgataactaaacatgaccatttcttgttctcacagcatggcttcaggaaaaccaaatggtctctacactcagagtcctgacctcatgaattagaagaagtgaaagaagatggcttccaaattatgtttgaaaacttgtgaggatttaaactctctccatagaacttaccattacacactgaagcaaccttgaatcagaataaattgatgtctgtttcatttatttattcaaatatacctctatactcaaaaaataatcccctaatagaataatttttaggaaaatgtttttgaaaacttagatgaaacccatcatttaagctatgctatctctatcttggcaaatttttcaaggtgtctgggaagcgggaccttgggcatctagcctctatgtaatgggcatgccaatttttacaagcttaactttgaatctttactatccactcacttggagaggaaaaagtccaggaccaaagatcagatccagttttttcttttccctatgaacctttgtcctaactttcatttccctctacttttctcctcaaaagatgtgatatccaacattttcttgttcacagttagcttgaactaataaatagtcacaaactttcagatctccctgctttgaggacttttttactataagaaatcagccaaaatttttaagagtaatgttgaaattttcttttggaaggtgttagaaaatcaggtactctcttatttttgagactcttttaagaaaagaggttatcattttcctaaagcacattttctgtttctagacttattacaactccttgatagataatgtactcttcacaataaatagagagtttaccaacagagaaaatattattgcttctcttaagagttctctctctctcccccacccccttatctttcccctgtccctctcctccctctctccccccacccccatctttctgtctctaaaagactgcgttaatgtttgggcatttattatgcgtgagtatttctctatttcttacatgattgttgattttcttgattattgcaaagttattaaaagttataaatagattttgaaataaaaggagttggttgtgatagagtttttcagaaactgtccaggctgtaattttctgtggatgctaagataaatgtctaaggaaataatcattgcagaaaattattctggtaggcaacttttaagataatttttggttttcagcttggagcagaatatttatttttcactataaggaaacttgcttttattatagtgaattctctccttctctacgaggtgtgagatacaagtgtcatgtaaaatctgtgtattctattgaggcccattaacctgaggcagtgggcagtagctcagaccttaggctatatcttgaaaatgtagtatctccaagttctaattcctcttttacattgttacttgaccttgaagaaaaacagttgaactatttcctttttttttcttatttactaggaaattcaaaccaaatttggaaactatctgtagcaattatatgccttaggaatgcattttgtggcttatgttttgtaactctattttactttttaaccttttcttttcttttgattttattttttcctgttgaattgtatatgtgttcacatataccatctcaaataatgttagaaggaaattagcttataagtaagtacgtaaaattatagttacatttattggtttcttgctagttgttagattttcagttaagcattttatacacactaccacacatgatatacataacaaccccattggtaccatatcagttagaaatgcattcgtttgccagtagctgaatatctagtgaatagtaagctaaataaagaagggagtatttatcttttaacctaacaagaagtctagagaagagtagcagttgacattgatttgaaagctcattggtgtcagatctagcatcactgagattcatttactctttgcttcatgtacttaagatggtttcagtagctcagaacataatgccagtatttaacaaaagaataaggtggaaaggttagaaaagtcatgtgtgttgcttttatcaggaagcaaactttctcctgaaatcttcctctagcttctgcttacatctcatggccagaaatgtgacacatggcccctcttagaacttagaaatagatgctagcaaaaggaaagtgatttgacagtggatatggaaaaggacaattttaaaaatatttaacaactgctacagcacagacactaagaaattagaatggacacactggctataaataattggtagaaacttactagtgagtgtatacagaatataaaccctgagtgcaggattaatctgcagctatttttatccaatgtgctacactgtgtatcccaaaatacatacttttaaaaataatatacctgtatgcatactgatattatattagcactaataaaactagacttcccaggacacattctggtcttgcttgatacctactaaaatgaacacacataatcacttccaaaatatattgaggtaattcagcttttgatcatggcagagcagcttgtactgaactagccgtggcatagataacaattataaattctgggtaaaccttaaatcactagtaacaagtatttgaagactgaagctagagggaagccagcctttgaagataagatggtgcattgggtgagaagcacttcatataaatcaactccaagatgtcacaaagggtatttaggaaacaaagactttaatgagattattaatttgtttaactccggtaatcatttcactagtacatgtatatcaaaacagtgtgtggtatgcctttaatatattcaataataaaacaattatagtcatatttaacagacaggtaggacatcacagccaagaatgaagactataaataagaaccaaatggaaattttggaactgaaaagttcagtaactgagattacaaattgtaatggaaggcttaggaggatattggaaacagcagaaaaaagattcagtgaacactgagatacatcgaaagaaattgtccaatctgagaaacaaaaattgaaaataatgaacagaaccttatcacctatggaacaataggaggtattctaatatgtgcaattagagtactagaagctgagcagagagagagaaaggaaaaaaaagataggagcaaaaataatatttgaatacataataactgaaacatctccaaatttggaggaaaatgtcttacagagtcttaaagttaagcaagcactaacctatatataaattaaaaccccacatggtccagctgccagaaacccatattgaaaacaaccagagaaaaatgacaaattttatatagaggctggtaatatgaatgatggctgacttctcaacagaaataatgacaccaaaagacaatggagaaatgtgtttaaaatgttaagagaaaaaataaaaaagaagagtcagcatacaattgtattcccagtgaaaatatccttaacaaaagaaggtggagtaaaaacattttcagacaaaggaaaacaggaaattcatcactagtagacctgtcttgcaataaatgccaaaaaaaacttcttgaggctgaaggaaaatcacactagatggaaattcatatctataggaaggaatgaagaacattaaatggtaaatataaaatacattctatcacttaatgtcagaatgacataaatgtgtatttcctaacaaagactcagaatacataaagcaaagctgacaaagggaaataaagacaaattcaccattattattagattttaacacactttggcattagtttgggtcttggagaaatagaatccaaggtgggattagatttattgagaaagagagcaaaacaaggagggtacaagaagagaggatgtaagcccaacacctgtggaaagagagaggcaggaaagaggactggagagaagagtaatacaatacagttcaagaaagatttgccagaccaatgaagagctcttgaaccaaagttgctctttggaacagttctctgtcttgccagaaagggcctgcctcagtcctctcaatgtgctcagtaatcagctgtgagcaacctgtagaagcaattttgatgacctgctggaggctgagtgtgcactaatgtgagagtgagaaacttttggaggctacacacttttctaggcttctctttaaacagtactgccaggtgctcatgggggaatatcagagaaagagcctctcatggctctggcagggagaaggaaagaaccagcattaaatatgcccaaaggattcttcatgaaaaggtcctcggaaaaagactttgccagagtccactaccgaaactttttcccagctgaacttctccatattcccattccctccagccttcttgtctcgccaggggaaaagaaaaaaggataatagtcaatagggtgttaggtttcttcttttttttttttttttttttttttttgagacggagtctcgctgtcgcccaggttggagtgcagtggcgcgatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatttcctgacctcgtgatccgcccacctcggcctcccaaagtgctgggattacaggcgtgagccaccgcgcccagccggtgttaggctttaaaaaatagattgataacactacaaccagggaagggagtgcagtgcaagcagaaaaaaactgtaccactggagagactcttctgaagattatagcctcaagatacaggcccactggatgactgaactttaactgggatattatagaatgtcttccctcctcaatgtcttattaccacattaaaatggctctagtaaccgtggattacagttgaaagagctgcaagacacagtctttttctgagcagcagtacataaggaagcccaaaattaaaggggagacaaaaacaaggactctagatccttgcccagatcagtgttgtggagcttttcccttatgttttcttctaatagttttagttataaatcttatgtttaagtctttaatacatttttagttgattttcatgcttcataaatgtaatacaattatgatttgtcaatgaaaaataatattaatgaaaaaggcatcaaaggaatatatgccaaaataattaatctatggcaaatccacagccaacatcgtattgagcaggcaaaagctagaaataaaaaacacgtgaacagaaatgaagaatgcctttcatggaaatattagcagacttgacgtggatgaggaaggaatcaatgatgataaagataagtcaatgaaaatttcccaaactgtgatgcaattagacaaaaataaaataacatccaaacactgagggacaatcttaaaatgtataccatatgtgtgattagaataccagaagaagaaagaaagaatgaactagacaaaagtagttgatataacaatggctgagaacttttcacaaataataacaagcaccaaactacagatccaagaagctcagagaacaccaaatagaacaattcccataatataaacagaatcaacaaaaccctcaaatatactcaggcatattgtagtcaaactgcagaaaatcaaatacaaagagataatattgaaggaaaccacagaagaaaaataaccttacctatagagaaacagggtattatagtggatttcttgtaacaatgtattaagtaaatatagcatgtggataaatgaaataaataacagcagtatcataagacatgagagagaaattaggaatactttgttataacatacttatactatatgtaaagtgctattgtgctatttgaatgtggatttatataagtttaatatatatattgcatatagcaaactctagggcaacaactaaatttaaaaaatgtataattgatatattctaagacactagataaagtgttcaattaaaaccagagaagatagaaatggtagggaatggtggtgggggaggggacaaagagcaaattaaatgcatcgaaaacagttacaaatacggtgcatactaatccagatacatttgtaatcacttatgtgaacagtctacatacatcagttacagagatggacactggattaaaaaacaaaacccaattatattttgtctaccagaaacccactttaaatataaagattcaactaaattaaaagtaaagggatagttaaaggtataccatgccaacactactaaaaagaaaaataaagctgaaatagctatatcaattttagacaaatgagactaaagaacaaggaggagtatcaagaatacaaagggaggttatgtaatcatgaaggagtccattttccaagatgatctaacaatcctaactatctgtggacctaacaaccaagctttgaaataaatgaggcaagaactgagaagagacatagacaaatcatatatccactattacagttggaaactctgtctatatttgatagattaaacaggcagaaaatcagtaaagatagaaataactgaaatagcactgtcaatcaacttaatctattcaacatatatagaatacttcatataacaagagcagagtacacattttctgaagtccacttggaccatatgtcaagatagatcacattctgaaccagaaaatacaccttaacaaatttaaaataataaaaattatataaaatacattttttccaaccagatgaaatgaaactaaaaattattatcagaaagatatagttcagttttgtttcttaatccactgtgacaatctctgtcttttttttttttttttgagacagagtctcactctgtcacccaggctggagtgcagtggtgctatctcggctcactgcggcccctgtctcctgggttcaagcaattctcctgcatcagcctcctgagtagctgggattacaggtgcctgccaccatgcccatctaattttcgtatttttagtagagacggggtttcaccatgttggccaggctggtctagaactcctgatctcaaatgatccacctgccttggcctcccaaagtgctggtatttcaggtatgagccaccacgcctggcccgatctcgtttaatcaatgtatgtagactattcatatataaagtgattacaaatgtagctggattagtatgtaccatatttgtaactgttttctactcatttaatttggtctttgctccttcccctactaccattccaaattctaaactattgggagactaagccataaacattgaagtaacatatgagttcaagaaaaattagatattaaaaatattttgaactcaatgtaaaaatacataatgttatagcatgaaatacatatattacaaaagaagaaaggtctagagtcaatattaaactaaatatcacctttggagtctaggaagagtaaattaaagccaaacaaaaataatgaaagaaataataaagcttagagaaaattttaaaaaatgaaatttggagccagctgaaagagctcccaatggccaaagctggaacaatttgaacaataaaatatagtagttatgcagccataaggaatgagatcatgtcccttgcagggacatggatgaagctggaagccatcatcctcagcaaactaacacaggaacagaaaaccaaacaccacgtgttctcactcgtaagtgggagctgaacaatgagaacacatggacacagggaggggaacaacatacactgaggtctgtgcgaggggtgaggggaaagagagcatcagaataaatagctaatgcatgaggggcttaatacctaggtgatgggttgataggtgccgcaaaccaccgtggcacatgtttacctatgtagcaaaccagcacgtccgtacatgtattctagaacttaaagtaaatctaagtcatatacgtagtagtattggattataactgaaaatacaaaataggttcatgctgatatacataaatgatgaaataaataaatggcacaaatagacaaatctgtgtggaacaatttcagataatttatgcacatacttcatcctcaaagaagtagcatattacttccctttccttaagtgtgggttggacacagagacttttcttcccaaatactttagtataaaaaaggagaaaaaaaacaacaagctctagcttggccaggtaatcaaagtaatcaataataagtcatattgatagtatatacccttgatgtgatatgataagaatgtcatttacctctgtcatctccctcctaaaacacccataaccccagacagattatgataaaaaatcccaattgatagatattctacaaaatatctgaccaatatttctcaaaattgtcaagatcatcaaaaacaagaaaagtctgagaaactgtcacagccaagaagacgtcatgactacatgtaatataatatcctggacaaaatcttggaataaaaaaatagtattaggtaaatgtttattaaaaaatcttaaactgtgggatttagtaaattgttctttaattttaacatatgtagcatattaatgtaagatattaataaaggaaaattacatatgggatacatgggtattctcactatcatcacaattttttataggtttaaactattttatttaaaattattattattttttgaggcaagtatttcattctgttgcccgggctggagtgcgttcgtgcaatctcagctcactgcagtgtcgaccttccagggctcaaacaatcctcccacttcagctcccaagtagctgagactacagacgcatgccacatgcctagctagttttttaattttttgtagagacaggaatttgctatgttgccagggctggtctcaaacacctgagctcaagaaatcctcccacttcgacctcacaaagtgttgggatcacagacgtgagccactgtgcctggcctacaactatgttaaataattatcgtttaaaaagtcataaggagcagcttggagggcttcccattggccaaacgtggaacaaattattattaaaatacaaataatataatggatatgatccattgaataaaataaaaatacacgagttcttactgatataaataaacaactaaacaattgagagagaaaggaatccctttacagtaaaatatcaactaatgatgtagaaagagttatggaattagaatattatcaatggattctaaaactagtgaatgaatgtttgatgaggaataggaaatttacatgttctcaaatattgccccacaaatgactaataactacagtggaaaaattattaacttgataattgagaaaccaccttaaccacgggaccaaagttaacattaccaatattggtctcattgctatcatgtgcttcctgctgtgatatactgggaagtatttatcatcatgtccatgatatacctgacaaaaaggaatcatatgaatttaactatgtagaagcatcagacaaacccaaattgatagaagttctacaaaaacaagtcagcacagtagtctccccttgtctgcagttttgctttccctggtttcagttacctgttgtcaactgcagtctgaaagtattatggtattttgagaaagaaagagaaagagaccatgatcacgtaacttatttacaaattatactttatcataggtatgtatctataggagaaaacataaggattgggtactatccatggtttcaggcattcactgggtgtctgggaaggcgtctcccatggatagagtgggacaactgtacttttaaaagtatcaaggtcaggccgggcgtggtggctcatgcctataatctcagcactttgggaggccgaagcaggcggatcatttgagggtaggtgttcgagaccagcctgggcaacatggtgaaaccctgtctctactaaaaataaataaataaaaaaaaattagctgggcgtggtggtgggtgcctataatcccagctactcgggagactggagaggctgaggcaggagaattgcttgaacctgggaggcggaggttgcagtgagctgagatggcgcccctgtagtccagccagggtgacagagcgagactcatctcaaacaaacaaacacaaagaaagactctcatgacacttaaaaacctttctaaaatgtaaatattctctatctcatgatcacaaacagtatttcacattctaattgatattgccagctacacgggaggccgaggcaggagaatcacttgaatcctgggagccggaggctgcagtgagccaggattgcaccagtgagccaggattgcaccactgcactccaggctgggcaacagagtgactgtctcaaaaaaaaaaaaaaaaaaagtattgaggccataaacaaagacaaactgtgttatgggttaaatgacactgaagagttataacaactaactttaagtcatgatactagattggatcctggcctggaaaaaatagctattaaatgtattattgtgatatatgatgaaattgtgtatggactatgaattagacaatagtatattaaacgtactactatgctaaacattctgattttgatcgttgtactatggttatgtaacagaatgccctttttgggggaaaatcactgaaatattttaagagaaaaaggtacaatatttcaatctattctcaaatggttccaaaatattattcatatttctgtctctcattccattcacctatctatcatcaatcatctattgagaaaattataaagtagattatgttaaataatagtaaatttggataaagaatgtatggcagttccttgtgccattcttgtaatgcttctgtaatttggaaattatataagaataaaaagtcacaaagtaagttctgtggggactctgacctttaggcacttggtactcaaaatgtggtccatacaccattggtattgccataatctgtgagcatttctaaatccctagtctcattccacacccatgatcgactctagcagaatttgcattataaccacatcaccagttaattttaattaacattaaagactaaacagcttgttctttgaaactttatttctgtaaaagtattcagcaccacctgcaggtgctgtagaaattcagaatagtttgtcattaacccttttgtatcaccagattggccccacggatgtgccacccccattgccatttctcttcttcactcatgttcctttctggtgtacatcctacaataatgcattcagatatgttccattcagtgaaatcagcttaatgtatctcctgcctttattttatctattctcatttaagactcggtttgaaccttacctcacccataaacactttttaaaactccttagacatctttaaacttctgtgacactgtaagtcttaagaaacaatttgatcttttactttttattgtgtgctattttattgttcttttcatgaattccaaatggattgtatgtgtcctgcagttatggatcagattttatgaactagaacctgtccttctggttctctattacaattatctccacaataaaacaatatggtgtttattttctaaagtgtgaggaaaagcattcattaggaagagaaaaaatattaaagtttctggttgtttatcaaaaatggaaaaaagaatatattttattagtaattgatagattgacagtatatatataattcatagttttataaaatatgtttagagatataagctcaatactttttgctgatatgggcatgtaattgaaaaagtttggagaccactgctttagagtgctatagaaaatattcattatatactttgtattacatttagtaatgaaaaaaacactgaaggaggaggcaatgacaatcagtgtttggcctgagtcctcattatggatactttgggttcagagactaacccattcattaccagctaggaatatggctatgggaataattattagatgacaatttactaaaattactataataaattagtattcaaatgtctatttaccagtggcttctcattttattaatatattgggcatcctagcacaacctggcatcaaatcaaataaactcagagattttatggttgtaggaaagatgaagcatttttttgtaaaatcttttatctagtttcatattcaccttttataaatattagcccttaaaaataatacactagagctaatctcattaaattttatttgatgaagtcctgatgtagctccttgttgactaagagatataaagcagaacttctgtcattcctgaaatctaaagaccctttgttagagtagatggaaatagctaatttgagtgattgtatctttgaaatatttgacatattattactttcaagacacaaattaacttagattatttctaattttgagtagaaattctgatttgggacatcaacaaattatgttatttgcacatgaataggtacttccagttttaaaactagttcttttaagtaaacattacaaatcaacaacatctatcttagactactatcacatttacactcaccgttgtttcttagtgcatttgcaaactttacacttaaagttaaaattaaatcagtaatttaaaaagtagtatctaaagatctcagtatctaagtaagttttgtttcaccagctgtaacttaaactgaaagtcctatcttttcagttagatccctacagccattttccacaatgtctctcaatgccctacattttcatcattaaaaataacacctttatgaacacacacacacacacacacacctgcatcccccctacccccaacaagacaggacttctgatatgccttttaaaaatacactaagtgatgctattcactgaagtttggccctgcttaatccaagtttcaaacattacttacatatttgattcaggtaactgaggagtttaaaactgggtttaagagcagttgaaaaagcagttatcttttaagaaattttctgaaatagctgctgtatctcaaaaaaaagagaaagtttaatagtattattagctttcttgtaaagttaatattttgattatagttgataattttttttccttatttgtgtttataatcttaaaatcaggactctaactcatctgttaatgtttatttttcatgtatgtgtatatatatatatgtttgtaattttatatatatatatacacacacacacacatatatccacatagccatatatgtatacacatgactgtccagtcatgtgtcacttaatgacagggatatgttctgagaaatgcatttggtgattttctcatcatgtgaacatcgttgagtgtacctttacgaacctagatggtacagcctactatacacctaggctatatggtatagcctattgatcctaggctacaaacctatatacatgtttctatactcaatactataggcaattataacacaatgataagtatttgtgtatctgaacatagaaaaagtacagtaaaaatatggtagaaacaatgatgcccctctatagggcacttaacatgaatggagcttgcaggactagaagtttctctgggtgagtcagtgagtcagtggtgagtgaatataaaggcccagggtattattatacactactgtagactttataaatactgtatacttagactacattaaatttattaaaaatttcttcaataataaattaatcttagcttactctaacttttctactttacaaactgtatttttttcactttttaacttttttgtaataatagcgtaaaacacaaacacatttgtacagctatacaaaaatattttctttgtatccttattctataagcttttttctattttaaaattatttttatttttaactttctacacttttttgttaaaaactaagacacaaacacacacattagcctaggcctacataggatcagaatcatcaatatcattgtcatccacctccacatcttgtcccattggaaggtcttcagtggggataacatgcacggagatgtcatttcctataagaataccttcttctggaatactttctgaagaactgcctgaggctgttttacagttaacttttgtttttaacaagtagaagtgtactctaaagtaatgataaaaagtatagcatagtaaatacataaaacagtaacatagtcatttgttgtctttattaagtagtaggtactgtatataattgtacctgatatactcttatatgactggcagcacaataggtttttttataccagctccaccataacatgtgagtagtgtgttgtgctacaatgttaccctgactaccactagataggaatttttcagctccattataatcttatgggatcgttgtatatgtatccatcattgatgaaaacattgctatggggtgcccgactatattcataaagtgtacatacacttttaaaatgagtaaatgaaagtattattcccataaaatgtcattgctccagcataggtgccaaattaaaatctcttttgttattgccaacttaaggaaaacactaagtttttggaaatttaggatttttttttttttttttgtagttttagaggtaggacttcatttttatgaaaactactgcactctattggtaattgccaaaaattctcgaggacttaaaattttggcttcgttgttgcacctacaggacaaattctgttatgtgctgggtcattctgtctttcaaaaataattagcagtggcaaatgcgaccccaatggtcacagatgccaaactagtgcacttctgatttcagttcatactgtggagttatctgcactctgaaaccaaaatgatttgattaacttgttattttgtcaggcagaaactctattaggagctgcataataattgctgtattttggatatatgttttattacctcatttttccagctttaaaatacgcttaatatttttcttttaaaaactttaaaaagtttttgcttattaaagtaaaatatgctaaaattaaccaaagctaaagtcctcattaactctcttcattttatttatgtactttgagaatcttgtacttccttgggaactctttctgcttcagtcaaccccacctattcccatttctgttgcagaataggtctctttttctgtttttgtgctattaaaatttttttctctacctgagaagaagcctagagaaaaaaaattcaactgtttattgatctgtatgctaagttgtatactcgctatgagtggcatgttgtatgtttgtattgggtagaatgtgggaatagaatgggaatatataaagataaataatatacggctgtgatcctgtagtactttatcttctgtaggcagagtcaaaaatagagaattacattaagaaactctgtgaaaggagtaataacatacaatgaatatagcaggagagagcataaggacaaatagttttgatgagtaaagaggaaaattaatttgtataaaaatatttaaatatttgagtggcaactatgttaaaaatattttatataggagctggggatagagtgaagaataagaatgttctctgaatttagggagcacacattctagtgaggggacactgacaataaacaagtaaaaaaaagcaaacaagttattttagacaatggtaagtcccactgatgacaacaaaacaggaaatattggagaatgtctgggagcttctccaggtaagatggcagggaatgtgatatggtttgtctgtgtcccccatccaaatctcaacttgaattttatctcccagacttcccacatttccacatgttgtgggagggacccaaggggaggtaactgaatcatgggggcctgtctttcccatgctattctcatgatactgaataagtttcatgagatctgatgggtttatcaggggtttctgcttttgtttcctcctatttttctcttgccaccaccatgtaagacgtgcctttcaccttcttccatgattctgaggcctccccagtcatgtggaactataagtaaaaagcaaaatccctgcctgtcttgcgtatgtctttatcagtggcatgaaaatgaactaatacagtaaattgctaccagtaaagtggggcattgctgaaaagataccagaaaatgtggaagtgactttggaaatcagtaacaggcagagactggaacagttcaaagtgctcagaagaagacagggaaatgtgggaaagtttggaacttcctagagacttgttgaatggctctgctcaaaatggggatagtgatatggacaataaaatccaggctggggtggtctcatgtggagatgaggaacttgttgagaactggagcaaagttgacccttgttacattttagcaaagagactggcggcattttgcccctaccctagagatttgtggaactttgaacttgagagagatgatttagagtatctgacggaaaacatttctaagcagcgaagcattcaagaggtgactttggtgctgttaaaggcattcagttttataagggaagcaggacataaaagtttgggaaatttgcagcctgagcatatgatagaaaagaaaaacccattttctggggagaaattcaagccagctgcagaaatttgcgtaagtagcaagaagcctaatgttaatccccaagacaatggggaaaatgtctctaggccatgtcagagacctttatggtagctcctcccatcataggcctggaggcctaggaggaaaacatggttttgtgggctgggtccaggatacccatgctgtgtgcagcctagggacttaccctatgtccccccaggcactctagctgtggttgaaaggggccaacgtacagcttgggctgtggcttcagagggtggaaaccccaagccttggcaacttccatgtgtcattgagcctgcgggtgcacagaagtcaagaattgaggtttgggaacctccacttagattgcagaaggtgtatggaaatgcctggatgcccaggcaaaagtttgctgcagggtggggtcctcatggagaacctctgctagggcagtgcggaatggaaatgtggggtcgtagcccccacacagagtcccgactggggcaccacctagtggagctgtgagaaaagggccaccatcctccagaccccagaatgccagatccactgatagcttgctccgtgtgcctggaaaagttgcagacaatcaacaccagcccattagagcagccaggagggaggctgtaccctgcaaacccacaggggtggagctgcccaagaccatgagaacccaccttttggatcagtgtgacctggatgggagacctggagtcaaaggagatcatttaggagctttaaaatttgactgccttactggatttcagacttgcatgggccctgtaaccccttggttttggccaatttctcccacatggaacagctgtatttacccaatttctgtacccccactgtaactaggaagtaactagcttgcttttgattttacaggctcataggcggaagtgacttgccttgtctcagatgagactttggactgtggacttttgggttaatgctgaaatgagttaagactttgtgggactgttggggaggcatgattggttttgaaatgtgagatgagatttatatgggccaggggcagaatgatatggtttggctctttgtccccacccaactctcaacttgaattttatctcccagaattcctatgtgttgtgggagggacccagggggaggtaattgaatcatgggggctggtctttcctatgctattctcatggcagtgaataagtctcctgagatctgatgggtttatcaggggtttctgcatttgcttcctcctcattttctcttgccaccaccatgtaagaaatgcctttcacctcctgccaggattctgaggaccccctagccatgtggaactgtaagtccagttaaatctctttttcttcccaatctttggtatgtctttattagtggcatgaaaacaaactaatacagaagccttcatttagggggtgacatgagagctatgagtgagttgatattcattttatcttcccttctccacttttcctcaaaactaagttgatatctggtctcccagaattgctgccctatctcctaacatgtcttcactgtcaagtttctggaaagtctagttgaatcaatttatcctccatattgatgatataaacatctaattactagcccaggtctgactcctgaatgacacagcaaagatccattggaattatccacttggctgtctcaaaggcaaattgaatgtcacactgcataatatactcttcatcttgtatagtccatcttggttttggttacctactacacaatgcttcaagtcatctttgactttcccccatctagtttgtgatgaatacctttcaattctgcctctatcatatgaccttcttttttctatgttctactaccattgacatggccttagttcagacacttgttatatctctccctgagtctactagagccttctgaccaatctctgtattttcaagtatgcttccatactctttttatttgcactgaggcaggtataaaaggagttataatccaaaactcttaagcatatttccattcttcttaaaatgtatcaatggctctctttgcctctaagatgaaatccaaactctttagcatcaccataaagcatttcatgtcctgagccctgtatatctcccagacacatgtctccattcttccccattctccattcctgaactctgtgcagtgatgagctgcaagagatggttctttttttagttcttgttctaaacacgcaagttctttcttcatttcttattttcaaataacatataataccataaattctattttaaacaatatttactttgacctctatgggaactaaaatatgatatttatgaaataaaattaatatactctagggtttactaaagactgtaatttagtgttttattacaaagtcttgttaccactactcatgtgcacattcagatagaaggtccacattttgagaagtaggttctattagtgggttgtctttgttgtgagttagtagtggttttccagctgctgtgattctgacttggattgtctttattgtaagttttagtattcctgtggattattttatttaacctacagggttgtcttaggccatttttgcatttctataaaggaataccagagacagggtaatttacaaagaaaagaggtttaattggctcattttctacaggctgtacaagcatggcactggcattggctcagcttctggggaggcttcagggagcttttactcatggtggaaggtgaagtggaaggaggcacttcacatggtgagaacaggagcaagagagtgagagggggaagatgccacatacttacgtagctagatctcacaagaactcactatcacaaggacagcacaaagggcatgtctgaagtattcatgagaaatctgcccctgtgatccagtcacctcccaccaggccccaccttcaacactgggaattacaatttaacatgagatttagacataacatccaaactatatcaaaggtgcagtagaacaaatctatatggccgatggttttttaaacaccaatttctaagagagtttaaactatagtttatgtgtgaaatatttatattttattactaaagctagtgtatatacatagtttatatgctctaaatttatttgtacaataattcttcatcagaatgcactgcctgtgaatatgcgctatttaaatgattttctaagtgatacaatgtctgcaagccgtattgcagacaaaagtctcatcttcctaatatataaataactcccataaattgatagaaataaaaaagaccaattactgcattaaaaaatggacaatagatgtgaacaaacatgtatgggtaagggagtacaagtgactcataaacatatggtaagacatataaattaaaaccatactgaaatattatgtatcaaccataaaattagtaaaagttctaatgctcagtaatactttctgcttttgagaccttggcatatacatttgtgtaacctgtatttaaggcaacttggttataaatattaacataacagtacttatatattttgatctagcaattcacttggaaaactattctagatatacttgcgtatgttggaaataatgtatatataatgccattaatatatatatagagagactttcactgtatagatttgaatttaaaaagtaactatattttcaaatttataaccttatgagttatttattaaaattaatttataatagcgtgttcttctctatgcatatcaagcagctcactttttattatgtgatgtttatcattatcaaatgattaagttagcgcatgtcaactttcttcactgtaaagttattttttcttttgtaattaatagttgctagtaggagatactttatgaataggtaaattctgtttctcaaacttttgtccacaaattttgtccacaattttttgccaaatttgtagatgttgtctgcaacagtttggtacagaaaattgtgtggtgttcgcctaatgttgattttttattttctccttttaattcattaagttgaattttcttgcaagagccattctttttcccatttatttacttactcaattatttatgtaaatatatacttatgattttattttatagattaaaattcaataccatcattatttgctgctcatatccattcagcattggtcattaagaccattaggtctttaggtcattaagtccgactggctcctgtgttctttcaaaatgctcccatcttcttctgagcattttcttactttcccacaccaccagatattccagtgttacctaggattttctctgtctcagccctgcaatgaactacttaaagtgtccctagaggcatcatattttgtgccaatcatgcaagaaatgtgaaatattctaagcgtgagaaaacattagacaaagccatattgagggaaattctacaaaataactgattagtattcttcaaatatgaaatgaataaaaaacaaggaaagactaaggagctgttacagactggaaggcagaaggggaagtaaccattcagtgcaaggtaggattctgaataagatcctggaatagagacatgagtggaaaatttgctgaaattgaaataatatctatggtttaattgataatgtaacaatctttatttcttgtttttcgtaattacagtatagttatgtaagatgttaacattgtggaaaatgtggtgagagatacaagaaaactcttgtagtttcacaacttttccatgtctaaaattaattcaagtaaaaagttaaaaatagtaaattaaaaaagcataacactcattaaagtagtctggaaagctctccaaaatatattttaattttgggaaagaaaagttcaccaactgtatatatgtgtggaaatatatctgtttgtgaatgcatataatacccttggaaggacacacaggaaactaaatatatgtaacctctgtggggatattgggagacagggagtaaaacttaatttttttttcttctttttttttcaatcatgtgcatgtactgcctgtacaaaaaagcaaaattaaaaaaactggcattatattgctaaaataagtataacgatttacagagttaattttaaatgtgtagattattatttaaacatataaatatatgcagtaatattatcatattaataaaaagaatacatgttaacattaaaagtttactgaaacttatttatttcatatcttttaaattttttaatcacttttttccctaaggagaggaaatagttgttttagaagggctgtaaatgacgagttaatgggtgcagcacaccaacatggcacacgtatacatatgtaactaacctgcacattgtgcacatgtaccctaaaacgtaaagtataataaaaagaaaaaagaaaaaaaaattgagtactatgcttagtacccaggtgacaaaataatctgtacaccaaactcccaagtcacaagtatacctgtataacaaacctgcacatctaaccctgaacctaaaataccagttaaaaaaaaaaaaagaataaaataccaaaacagttaaaaagaaaaagaaaaaagaaaaagaagggctgtaggtcttggactccacccaattggcctgtaaattgtaaaatgcttgatcaccactgatgtaaagctctgctttctctcaataattgattctttttcacagctattctcttgcctagaatgccttcctgacctttttattacctggctatctcctcttctttgaagctcaacttacatattatcttctccagaaagctttttctgatccctaaaccccaaatttggacttgaaaccaatcttatatgcttccattatactgtgtgtttatctctgtcataacctccactgtattataattatttatttttgtctctttgttagattatatgcaatttaaggtagtgattagattattatatttgtatctaccattcataattcagagaatgacagtcttgcaattaatgtaagtttaaaatacaaatctagaaatctcatgcttcctggaatgagcagatcaaaacaggattaagtcatgtatatgaaaacagagtgaaatcacaaggtctaaggcctgaatacattacacaaaatttaaataaaatagtagataatagcacttgcagtaatcttagtgatgaacaaccagatcccactttttattcttgtaacttgctatctatgttagtttctttggactttgtgaaacagattcaatcagcagaagaaaagcttattctgacatttcagttggggtgataagtgtgcaaattagaaggcacgtggaccaaattcatgaatcctgaaaggtgctcctttgtccacgccaccataacactaaatgtaggctgtgtatcactgctgtctcccagcctggtcctgacacttctgcaaaaggacagcccttacaaacattcaatgtggtcctagacaagagacattaaacgtcacaggaacctcagaacaattagatacccagaagataagttcggatccactgtagtactgggagcctagtagtaagagtactgggtatccttccgataactctccccatgctgtctttctcagtgtgtctgtttgcttctactcctattaccaataggctccttctaatctgcatatattaaaaacaaaaagcagggcaaaaacattatctcacagcttctaaataaattttgtgatttatcctaatcctgactttgaagatcctcatggcctctacttggggtttctctttatatatagatttttcagccttagttctcactacctcattctccttctattttgcagttttgtttctgtagacagtataaccgaacctgctcatttattgcatgtgtatgtgagtgtatgtgtctaggttatggattcttggcttatgaaatagctactttcgaataggttaggattccacatttgatagtctcagttatagctagaggagggggttgggaggtgagatggggcttctttttttcaaatatgacctcctaaatgtgacacagcctacttttagtgttatggtggccagcattctgaaaaaaaaatcaaaatcagaaaatataatggacaaaattaagattacagttctttaggcattgctggtctatagaacaaaattgagttggaaataaggcaaaaataaaatgttaggttttaaaagtcaaattacatagatgttgcacttgtttgtttatatacatagtaaaatgaaagtcctggggatcaataactgctgtggatgtgttaagtttaacaccttatacaccacggacattccatcaatattgaacaagtgttttaacagctggagctatttcacatgatgcattttttttctctcttttcctgttagtgttcttaagcttgcttatacttgttttaataaatatttcacataagtttctagaactccaaatttaatgtctatgaaaacatcctgaaatttaaacatctgaacctcatttaaggtatttttagatagttattcattaattttttctttgcaatgaagtaatatttttcaaagttattgttatttgaaaatgcacaagcaaaccaagatattggtgctatttttctctgaagatcttaagatttctttctacagttatttaaagaatatgctaaatcattccttttctttctttttccaacatctgggacagaattcttttatgatagacctcaatagttattcaataatctctctttctcactctcaatgtagcaccagaagtatagatattatttgggttgggttcacgtctataatatagtatatttaaggtgttatagaaaaaagtccacatatgcagattttatacttgcaacttcaagaaatgtaattccttgtataaatgaaagtgattcaaagttcacagctcctagcaaaaattttagatgttgtaaataatgaagataaatcttacagacttagtgtgaagaaagtgattctcaagtagtaacgctgtttgctaattgcataccaccaagtttaatccacttaaaaatggttatagcttcaggcaccatttctatgctgttggtttccaatatctattttcaattgaactcatttccctaagcttcaggcccatataatcaagtgcctactggacatttctatttgggtattctacaaagaactgaataaaaattgtaccaacatatccttgtcagtttgccatctcatttgcctgggttcctattttattgaatgacacgggcatctacttagctcttcaaagcagaaatttactatcttcctttctttcatcctcatattggatatgtctcccaaataaccaaatcttggtttttctacctgagaaatatttcttaaatacaagttttctatttatttttatgtgtagtcctcaagctaccaatttctttcattttaaatactgcaattattttaacttaaatactgcaagtaatgtctctaacctcattttgtaaagtttttttcctctctgaagccagagtgatttttctaagatgtgaacctgggcatttctctttactgcatgctctttaacaggatctctctcaccctcacagtatattttagctttcctgaaattattttgttttactgactacaccagtctcacactttgctctaggcctgttcgcttactgcctgtttatctgagaaacactttcttagtttctttgtctggctaatccttaccaatgctttggccatctgcttcaaagttatttgtgtagaattcttcagttttacaaggttaaatatttcacctaggaacatccagactactctcttatgattttgaactaaaattgtttattcaattgacgtttgccttgtaggttataaatgttatgaggatgtaaaccatgtctactttcttcatcctcttaactccaacatctacaagaatttctgtacctagtaggtttcaatagatgcttgttaaatgaatgaatgatggaaagtgttctgatttaacatcttaaatttcatgatagtatatgcttaattgattatcagataacacaagtcttcccataattgctatggagaggacacttttttcacaatcctaatgattcttgccatgtgaacaattcctttcacataacaatcatggcctatctccccatcataacatgctttttttctggagggactgagtgggttatgtgattgctgtattttggaggaataagttgaatatgctagctcagtcatttcttttttgtatttctctttgggtccaaacctatttacagagagcatgcagtctgctctgcttttttatgtgtaaggctgacaaaagcagaatctcatataagaaggtctatggtgacttagtgctgcctgtgtctaggttggtgtctgttaaaatctaggttcacaaacataaattctgcttgctacagataagtctcattttctcttatcagattgtttagcattaacagcaatatctgtattaagttttctatttccctttctctcttttgttttttagctggttcagaaaaaaaaagaatgttatatattgggcctcattgcatcccaacattgtcacgatagcattactgcattctaagcttatttcattcatgtattcatttaggcagcacatacttattgtgtcactactatttgccaggtaatctcaaggaagattaatttttccacttgagctttaaaaactagaaataggcattagagagttcatgattccatttccactggaatataaacttcatgttgaagttaggttggctagtattggagttcatattctaaatgaatttcaaagtatgtacagtttagtttgaaaatattctgtttgattgttcatcttagggaactagtttatgtatttttttcctttgccattactcctcttaattcttctaggtaagtagaataaactgttctttaggctcctaaatgtttccaacattgtatctctgccttcaattaatttaatttgtacttaaagaatatctaaaactacatttaagcaaaaacagtttccatggaaacatcatagactgtctaaattcagactatgatgtaatcaactaaaatgactatcatacctaaatccttgtttatttcatctgtagtatattttatttaaatctattgtatcaaacacagattttccacatctgaatttaatttggaggtataggacattttctcattgtttctattttagaaacttgtgtttgatttcacagtattttagaattcacatttctgctagagttaagatatcgacagaatgggctggattatgtagaatgtaactatatgatgttgacctagttttacaaaattatagaaattttctacccatgctgacagagtgtggaatgtcactgtagtcaaaaatattatggaagagtgaatcttacacactaaattcattgttaactgtttgacttattaacatcttacgaggtagttgagaatcttgcccttgactttctaaagtatacaatctaataagactatttttgacatatatatatagacatatatatatatatatatagacatatatatatatatatatatagacatatatatatatatatatataatatcaattattgatttaattgctttttctttaaggagtagttgtgaataaccattctatatatactggtatacaattgacactactctgtatagcactgtactgtaatggtgaaaaatgtcaagatctttgcatttgagttcagattttagatatttgtttgtgtaagtcttgccttttgagcctgtaaactctggagggataatttcaaaagtggcttttctttgcttatataaaattattcttcttttgcttttgtttctcacttatggcctcagttagaaacataaagatatgcaggatagactatccagagtatttgtttgtggaaatagtgtagttatttcctagaggataaaagaaatatagagaaagaagaaaaagtccttatatatgttactgctgtccaagatgcccatgtaaggccccagaagagttcgaaatggtcagggcatttatggagctatagttcagtgggaatgctttataataatttcccaagatacacctggttgcttttttctctctacatttacagaagattactcattttatagcatatcatatatataatattattatatctgtaaatatctcttctacaagtctcaaagttccaaaaggataagatgttgcaagaaagcagttatcaatgttggcaacagtttcagagagatcaaataaggatgaaaatgcattgggtttgagaaatttggagattacaggtgatatttgttagaatagattcaggaaggtgttgggtatatttcctcagccctcagggtaaatacaccattccatgggtatatttcttcagtactcagggtaaatacaccattccatgtactctatacgtagagagtttaatgtaaaattaggggtttacagaacttgttggaagactgatggaatgaagctcagggaatttgccactgaggataagggaagctgttgcccaacagtaggagaaattgaccctgaagatcacagtctaataaactaaagcaaatcattttaaaagctgctagaaactggtagatgtcctcaacaatctgtgggaagctcccagcaactgtctcagtttgtgaagaagatgggtctcaagagcttctctgaaagccatggtgactcacctctctatatctctctcatatgtcaattgcttctagggaatgtggcttctgcttcacttcaggcaagttctcatctgaatatctcacattgataaattttaacctagaaccaggttgtgaggaatgaatttcacaggctttgataagagtgatagtagtactgagttgataacaaacagtccaggtccagagtgtgagcaagagtggttaccatgacttaagagaagaagtagatgagaaaatagacttttttttttcttaaaagaaaattgatagaataagaatgagggataatagggcatattagaggtcagcaaatgatttagattttttttgttgttgcttttaaggagtggtaatacctggctagatttttatgcagaagggaagaagctagtagagaaggacagattgtagtatgataaaatgaggtgattgttaatgaggcaaggtttctgaaggaggtgggagaggttgagagcaatgcataattggggagtttagttttgaatatgaggcaggacaagcctttctataaaactgcaaatgagacagcgtggtgcaaaaatagattaatttattggatttggagtgatgaattgagggaatgtatgggtgatgacctctattttctctgtgaagtaggaagtaatgatgcctgctgagaggagatctggcaggggttaattttgagaagagtggacctgtttgaaataatgctgaggggaatggagataagagttatccatgaacaaagaaaagattgctgcatttactgaaagcccagagaaggccagagcccatacatgggcagtggcatcaatccgcatagctgctggattttccttacctgagcttaccatctttgatgaatttatagctcacttgggttcctcttttctgtgatgttaatgagtgtcctgtgcttgtcttcctcttggacattccccggacagcaaaaattgcctatttggtctatttgtgtgtgtgtgtgtgtgtgtgtgttttttttgtttttttgtttttttgtttttttttttggtcgagatgcgtcttgctacatttccaaggctggctagagaaacttggcccaggtttagcgagttgcggagtatataatgtaaaaacatagagaactagggagttggtggggagtatctgtgacaatgttcctgcaatgattgaataaagagtctaggctgtgtaggaaagaaaatgaggcctggaatgtgggctaataaagggtaaaaatgaaggggaaaagagaataaatgtcttgaaagatataaaaacagactttgtaggaataaaggggtgagaaaactagaaaaagacccaacaggaattatagtcaaagagtggtttattagagatattttcagagatgtagtacttctagataatagagaaaaaagattccagtaatatccatggaatcagtgaaggacaatgaaactcagaacatcaaacaaccaaacaatatggtgctgggcagagccacaacttgcagttgtgtgctataccactccaatctacattacaatcatggattgttcccacaaaggtatgcattgcacagctagtgtggccacccatggtggtcctggactgtgtgttattcatgtggaccttgtgttcacacactaccatggcagctatttccaatttctatatggtccttatagttacataagtgggaagataggtcactttatgatttgaggctctttggagagagcagaaggagaaataaaatccaattgagaggttttatagcatagtatggtaccttagatatgataaaccttttgacagacagaaaaaaataaataaatgcttcataaataagagaccaataagaacaaaggcctaaaaacaaaacattgctttggttgtataaacaatacattttatatttttcagagctgtttagaagatagactttaccatgataaatgtttcatgatagcggccttggtattatgatgagaataaaaatcctgagtatgggagtccattggcccttggaaaatatattccagtaaagggaaacaattttggacttagaagagcaggtcagggtaggaagttatctacttttagtggatgaacagaagatacaaatcagagccagaaattctctgctgcttttataaaaagtacagtttggattttaaaaaagtaaattggatttaaaaaattagttttctttattactagagaaaatcattagtattttctaagtgttttagctttataaatataaaaaagaaaaaatggatagattgtaccaagtgctttcttatttcacgataatattctgatatattcatatgtttccttcagggaaacaattgtttctacaaattattgtttcatatttatattacacagtattcattaaaattatagtatatagtaaaattagtatcattattttactttatatgaagacttggctccaagaacccctgaaagatttgtaaaaatgctgcaataattcctataatatccttatgtaagaggtaaattttattaagattttgttggtagtaactctcagaagcagtgaactagtcgcccatataaaagcaatattattggaggaaagaagatgcatggcagaaaataagaaagggttctttaaatttctgcaattgaattagctatgattagctgctacaagaagtaaactctgatagctcagtaactaaaaacagaaatttatttttagcttctcttcaatcctgttgatggtgaggagtgaggagttatgtgggagtgaagtaggcaatgatgtaggtacaggaatttcaggaacctttattattttcaatatatgtcttccaaggctgtcctagacatggtcttattgactactgatggcagagttgagggatagagaattatgcatgagatttttattggctattcactctccataggccagagcatagtcacatgagcacacctatctgcaaagaagaccaagaaatgtagctggatatcagaaagaaagagaaatgggtttgagggacaacttgtcagtttctgctaaaatcattattcagcagcacacaaaacatgcatgctttctgatgtgagattataaaatctggcctgagtttctttagcagttttttgacattttgacataggctaaggtacagtgaaattttccaggaaagagagttccaaaataacactttctgtagtaaaaatacctggcatgacataattgtttgggccatgtgtatatgattggatgctacaactttaaatgaatccacaatagtgaaaaaagagaagaaagcaagcattccctctcatccatcacacacacatccattacaacacataaatattctaaacatgataataatgctggctcagatatggtagaaggaggagaacaactaagatttgtttgactctctcagaagaaagttggcttggatctgaatcagaaaagtagagactaagaatattttgattacgaggaacagaaaacttctgaggaatgattcctatgtcatagaaatgatatctaaggatagaagcagcacctggaagaatatctatgatatgcaaaccggaatttccagttttggtcacatggggtactattgtcctggactccttttccactaccaacaaaaaagagagaatacaaaccatgattttaaaatacctagctgagaacaaagaaagaaaaggaaatcccagtgttaggggcaaagatgggcagaatagtaagctcatcactcatcactcatcagtcatcaggcatttccaggttggacttggaaaatagagagcacataaataatatctaaaatgtagattttacatatttagattttagatatttatattttgatattatttaaaaacccattaaaactggcattttaatgttcgtgtaggaacagaagttatggccttgggtctgcatgagaaaagaaggagatcctgtgtaaagcctggaagctgaagtggctctcccctatgaaaagggcactgtaaaaaaattcaattgccagtccaactaagtggcaaaaattttctgtttaggtctctgagtattaaaaaaaaaatctcccataagaagcctgggttatacatagtaaagatcccaagttgaaaaattaacaaaaataccagtcccagactggattctcacaggaaaacctagtgtgtggagaaataatcctcattgaaaatgagctcctaaaggaaaataacttatgaacacaaagaaggaaacaacagacaccagagtctacttgagggtgagggtgggaggagggagaggagcagaaaatatgaccattgggtactaggcttaacacctgggtagtgtaataatcatcacccaggtctgatgtacaacaaaccctcatgacatgagtttacatatgtaacaaaccttcacatgtacccctgaatctaaaataaaagttaaaaaaaatgaagagaaagaaaataaaatatcaatgttttattaaatgcaaataagcataccgacaaaagacaaacattaactgagtggattaaaaatatgccctactagacatgctgtctataagaaactcatttcaaatataataatacaggcaagttgaaagtgaaaggatagaaaaagatgtatcatgtaaacactaatcaaaggaaaacagagttctatttatatggggataagatagacttaagagcaactaaaattaccagggacagaaagagatgttatgcaatgtaaaagggtcaatccacccaagaagtcatagcaatcctaaatttgtatgcaccaatcaacagagctgtaaaaatatgtgaagaaaaaactaatagaactcaaagaagaaattaacaaatccacaattctaattggagacttcaacaactctctctctcaataactgatagaagaagtagacagaaaatcagcagcattataggaaaactcaacaacatctagtatctagtcatttatggaacactccaaacattccaccaaacagcagaatatactttcttttcaagtgcttttatgtacctcaagataaactgtatccagatccattaaacaaagctcaacaaatctgaaagaattgaaactggagagagcatgcactctgactacaatgaatcaaactggaaatgaatagcagaaagagaggaggaaaatgtaaattcttgaaaactaaacaacacaattctaaataacaggtcaaagaaaaacagaaaatgagctccaaaacataaattacaaactacacaaagaaatggtttactctaaggtgagttaccggatacaataaaaagcaggattagatctccagataatagaataatctgaaagaatctaaaaataagcatttataaagtgagtaaagagtaaagtgataaaatgaaggatagaaaatatcatgaaagaccagaatactgtctgaaaaggaaataagagatttaaacaaacagtaacatctaaagataagtttggattttatttgcattgacacaaatgtcagcaactgagttagatgaatatccatagggtaattgaactaaccatatttttagttactttttgtttttaactcgttttaattattatctaacttaagttcaggggtacatgtgcaggtttattacataggtaaacgtatgtcaagggggtttgttgtacagattatttcatcacccaggttttaagccttttacctattagttattttcctgatcctctccctcctccctccctaccctctggtaggccccagtgcgtgttgttcccctctgtgtatccatgtgttctcatagttaaagcatattcttaataagagtcccaaaaaggagagacaagaggaaagaagatagaagtcaaaagacaaagacttcaaaatacccagtaaaacataaatccttagatggagaggagcatgcctggtctttaagcaggctgaagcacacttgtccacacaaacacagcctagtgaaatcatgattactgcataaagacatctgaaacaaggaaatcttaaaagcaatcagagagaaaaggcaacataatcaacattctctcagcagtggttgcaaatggatctaccaagcaactggaagaacaatggaaagatatgggcaatgcaggacaggcctgaaacaaaagcagatggttcccaaaactgcagagactgaccctctcaacaagaaagtaggatacttttaaaaaacaccattaactcagctcattctccattttttgagggctttttttttcttttaacatatgcttggcttttttttctttttaagaaaattaagaaacctgacaactgcaggataactctggatttatttccattcaggtgttttatattcgcatacatgttttactgtgaattgtacaccatttttgagtgtgtaggatgaatctaccagagcagatgctttgttaaatttgtctatgtgactttgattaccggatgtagatgtatgttacttcatctcacagagtttctaaataggcatgtagcaagaaactacattttaaaatggggaatgtgttaattaaaacattaacccattctgtgtgtgtatgtgcatgtgtgtgcttagatttctatcttatgttattccagtaaggatctgagacgatgtgaaagaaaaataaaacactgaaacaataaggccaaaacccaacccaatgcaagtgaaaaccactattaataactctggaaggaaaccatagatattaagcagaaaactgtaatttcttactgctaagaatgctaattctatcttcgttgttatctagagatagaggggcattcaacttccagatcactcaaccacacatgtcatacatacattattgtatacagttttttctacaccacctcatttcagataaactgatattcaagtatgttaattttggttgaccaagatctataatgttttaatttttattttataatcctaaacactcatgatgttcctcagacttacattacattctaattgtagactttcaggctgtgctaatctaaccctccttatattcttttttgacaattgcctatattttctttcccacacattgactctaggcaatctctaaaaaaaaaaaaaaaaaaaaagccaggttaaaaacaaacaaaaacaaaacaaatgcaaagtaatctttcatataaacttccacatgatgctcttcaggtagcttgaatccttgaccctgaatgccaagttctatatttgtttcttatataaagccttcaagactatatctacttagcttcgcttaatgtgactatattaattttatagactttgtttttttcttttcttgaaaacatagaaataaaaaataggaaaaaatagaaattaacaaaaggtgggtatgtttacataaatatataataaagagaaaatgatcacacagaataatttatatagaacagggagtagccattaaaaaataattagtaaggttctctttttgttttcattagaaagtagaaacttttgttagattaagaaaacagttgcctcggtgacaattgtcttttcttaagtaaaatattgatgattggaacattgctactgagcaattcagtactatgggtagtaaaaatatcaaggaccctaactcattcacatgtggcagtgatgtcagtaaacaaagaaaacctcagcaaactaatgaattggtatagaagtattaaattaccttaataaatgcattttataatagttttcccccagtctattagctcatttagaggaatgttatttaagcactttggagatagacaactcatctttctttttttattattatactttaagttttagggtacatgtgcacaacgtgcaggtttgttacatatgtatacatgtaccatgttggtgtgctgcacccattaattcatcatttaacattaggtatatctcctaatggtatctctccccactacccccaccccacaacaggcccaggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccccacaaaggacaggaactcatcattttttatggctgcatagtattccatggtgtatatgtgccacattttcttaatccagtctatcattgttggacatttggcttggttccaagtctttgctattgtgaatagtgctgcaataaacatacgtgtgtatgtgtctttatagcagcatgatttataatcctttgggtatatacccagtaatgagattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtcttttggctgtataaatgtcttcttttgagaagtgtctgttcatatcctttgcccactttttgatggggttgtttgtttttttcttgtaaatttgtttgagttcattgtagattctggttattagccctttgtcagatgagtaggttgcaaaaattttctcccattttgtaggttgcctgttcactctgatggtagtttcttttgctgtgcagaagctctttagtttacttagatcccatttgtcaattttggcttttgttgccattgtttttggtgttttagacatgaagtccttgcccatgcctatgtcctgaatggtattgcctaggttttcttctagggtttttatgatttcaggtctagcatgtaagtctttaatccatcttgaattaatttttgtataaggtgtaaggaagggatccagtttcagctttctacatatggctagccagttttcccagcaccatttatgaaatagggaatcctttccccattgcttgtttttgtcaggtttgtcaaagatcagatagttgtagatatgtggcattatttctgagggctctgttctgttccattgatctatatctctgttttggtaccagaaccatgctgttttggttactgtagccttgtaatatagtttgaagtcaggtagcatgatgcctccagctttattcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtatcctcttttatttcattgaggagtggtttgtagttctccttgaagaggtccttcacatcccttgtaagttggattcctaggtattttattctctttgaagcaattgtgaatgggagttcactcaagatttatctctccgtttgtctgttattggtgtataagaatgcttgtgatttttgcacattgattttgtatcctgagactttgctgaagttgcttatcagcttaaggagattttgggctgagacaaatggggttttctaaatatacaatcatgtcatctgcaaacagggacagtctgacttccacttttcctaattgaataccctttatttctttctcctgtctgattgcccatatccaacactatgttgaataggagtggcaagagagggcgtacctgtcttgtgccagttttcaaagggaatgcttccagtttttgcccatagatgcagaaaaggccttttacaaaattcaacaacgcttcacgctaaaaactctcagtaaattaggtattgatgggatgtatctcaaaataataagagctatctatgacaaacccacagctaatatcatacctaatgagaagtcatcttaaagatagctgggagtactcatgccctactaccatcagtagataaatggtatagattggctgttcattctttcactcacttaatccacagaaaatactcctattggttttatctttctcaagttccttttcccaatttgatattaaataacaggtcttaaaatggacaaatattctaaaatgaaattagcataattaaaatattagcttttatttttaatatgttgatatattctattgtgatgttctgcaaatttttcaccttctagggaatattctttcccaattacgtttttcagatttcacaatgaaactgacattaaagaacaaaaactcttcagttatcttttaaaattctaggtgatagataatggagacttggaagattgaggggctgtgaggagtaaggataataagagattaaataacaggtacgatgtatgttatttgactgatggataccctaaatgccctgacttgaccaccacacaacctatgcatttaaaaaactgcacatatatcacataaatttatgcaaaaaaattctaggaacacaatatctcctttaggaaattccatggcaacttcttctatctgttaatagaaaaataatgaagccagtcattgtgacaaactaatactgtctattatttctccattaatttttgtcctgtacatgaacatttatagtccaatattattttcatcaacttttcaggtatttgacctaaatatgaagcattctttaatttaaaaattcccagattaagtcagcacaatttaattcaatcaatatttattagttttccaatttgtgcatgatatttaagagacatacaaataaataaaatgtttgctgatgtcaaaaaaattttacttgcttttatacatacatatttttgtagtcgataatggttttactatctttgaattctgcaatatgtctgctgcaaaaacttgtaaatgacttctctgtattgtagtgagagagtttttaaaagcccattgcttttggtgggaaacaacatgtctctaagacagatgctatcaggagtcttttcttgcatttctcagagatatttacatgatgtttacttcctgtgtgatattatccatttctgcactgctttcggtagttaaggttaaacactattcgttttctgtttccctgtggtttgactgtgtaactctttcatgttttcttatattcacgttaccattttactatataaggaatcctgaaaaagtttagagggcctaaagtggtgcttcaataaacacattttaattcattctgttattttcccggtaatttccccaatctcacttttggggctccctttcctcaggcaagcactcttgtaaaatagatatctgccctaaaatcccaacaatataagaggcaaaaaaatacaaagaaagtattagtatctcacaccaggcctcttgcaggatgggaggaaatgtagggagagcattaggacaaatacctaatgcacgcagggcttaaaacgtagatgacgggttgataggtgcagcaaaccaccgtggcacatatatacctgtgtaacaaacctgcacgttctgcacttgtatcccggaacttaaagtataattttttttttaaaaaaagcatatgtggtaagacagaatgcagagagatatctcttctaggtctttgaattatgaattctctgatgcaaaatatacagtaaaggaaaataatcagtacaaattcaaaaagttaccaagttaggatttttaaaaaatcttaggaaagtcacagaaattactatatttgcttctactgttatagatgccttggctttaacaaagcttatgaagacaggggactgtctgtctatgacttttaagttttactttgtgctaaacttgaatgaattatttcaaaattctgtagttgtcccatcaaattccaaagtttggcttaggtatggtggctaaataattgataacgccttgccttctcagttttttttaatttgtataaatttaagctagtgcaagtgcaatgttgttatatgcatatgttgtgtagtggtgaagtcttggctttattgtatctaccatctgaatagtgtacattgtacccattatgtaatttcttatcaatttctctcttaccgcctcccccacttccaagtctccaatgtctgtcattctcctctttgttcatgcgtacacattatttagctcccactaataaaggaaaacttggtatttgaaaaaaataacgagttaccacaatatttccattagaattgctaaaattaacaagactgacaatgtcaagtctatctgaggatgtgatgtaactgatactctacacattgattgtgggtaacccaaatgttacaattactttgacaaacagtagaaatttgctcaggagaaatgaaaacataggttcacacaaagacttgtacactaatgtacacagaagctttatttatagtagctccaaatttgttcaactccaaatatatatcagcaggttaatggacaaattgtgttatatccatacagtggaatactattttatactattagtatcaatattatgcaatattgtttatactatttggcaataagaagtgaactgctgatatactcaataacatggatgaagcaaagtcattgtgctgattcacagagccagtctaaaatagaagatagtttatgattcaattttatgcgatagaaagataaatatagcccattgttactaaaaggaaatcagtaccatagttgtctgtagccagagtgtaaatgggaacctgatttcaaagagtactagagaaatttggggggcaataataatgttttattacttgtctggattgctatttcagtgcatgtatttgtcaaaattcatcccctgtacatttaaaataagtttattttatttttacttaaatgaagttgtttcttagtaaaactcttaccaacctaaaataagaagttcaagtaacagtgttagatgaaagtggtcagagctgccttctgtttttcattctagtagtgcgtaatggtgtttgcctattatgattggatatggaccctgacaaggatacatatgacttattcctatgggatattcaaaaatttgtctttatgtgtatgtatacattgtgtgtgtgtgtgtgtgtgtatcaaagtatatacatatgcactttaaaaatgtgtgaccaggcaaagtttgtcaatgttcatcttaatagaagtttaatttcaataaataatgaacaggtgtgaagacaatgtgtgatatcaggagcaatgaagaggaaagcagggtactttgcataggaggctgtgggtacagctggtgttattatataggagttaatgtaagggcaatagacaagtttctgagggtgtccgctggcaatgtagcacctttgaatgttggttttagagcctgtatctctgtcatagggctccaagtccaaccagtaagctgatttagatggttagcctactttgatgctacctgggaacttcaccatctccggaatcactctccctctcatctctgttcttcctgtctttattttctttatgccagaatgcatggccatcctatctaggtgtcttatcagtcaaggaagcagcacctcttcctacttatactaacaactttctctcactttttattatatagtttcttaatgtctgaaaggtaactcacgtgaaagaagatctcccatgatcatgcaaggtattttcagagacccatctctgggtgttttctttaagccccatttttttttctagtaccaattcttatttgcccagtatgcatgactcttctccctatattaagcaaatgaaaaatgcagaatgaaaaagtctaagaaccacttcagacctctgtactctgtagccactgcttccccttttcatgtgccctgcccccagccactttttcataccttctgttcaagttccaaagtagacctcatcagtcttgtttctgtagtactccttgtccttaacttcacctcattgctcttgcaaatcctctgacatgcacccatgtaatctggtttcctgggaaacaaacttgcttattccttgaaagcttcagttactcatatttatacagtgactatcattctcactttttatagactatatctttgttggctctacataagcaaataattgagagtcgaagcagtttctccttacaacactcaacatactagctgtagctaaaggcatttggaataagctgtaactttgtcttaatacctttctctttctacttaatactataaggatatgagaaaaacagttagttgtcacttctatttttcatttcttctcaaagatagctgacttttcttgttcatgtcattactgtctgaggaactttcattttcttgtgttcctattgtcttagtaaatttgtgcttctataacaaaatatctgactctgggtgatttataaagaatagaaatttatttcttactctctagaggctgagaagtccaagatcactgtgctgacaggctttgtgtctggtgagggcttccctctcttcttcaacatggcactgtttctgtgtactcacatgacagaaggtggaagggcaaaggagtggcatcagatgatgcctcttttataaggcattaatcccattcataatgacagagccctcatgatctaatcatctcctgaagtccccaacttctaatatatcaccttggtgattaagtttcttcctcttcttttttttttttttcattatacttcaagttctgggatacatgtgcagaatgtgcaggtttgttacataggtatacatatgccatggtggtttgctgcacccatcaacctgtcatttgggttttaagccccccatgcattaggtatttgtcctaatgctatccctcccattgctctccacccccaacaggccccatgtgtgaagttcttctccctgtgtccatgtattctcattgttcaactcccactaattattgagaatatgtggtgtttgtttttctgttcctgtgttagtttgctgagaatgatggtttccagcttcattcatgtccctgcaaaggacatgaactcattctttttatggctgcatggtattctatggtatatatgtgccacattttctttatccagtccatcattgatcggcatttgggttggttccaagtctttgctattgtaaatagtgctgcaataaacatatgtgtgcatgcatctttatagtaaaataatttataatcctttgggtatatatctagtaatggaattactaggtcaaatggtatttctggttctagatccttgaggaattaccacactgtcttccactgttacacaatgattgaactaatttacactcccaccaacagtgtaaaagcattcctatttctctacatcttctccagcatctgtgtttcctgactttttttctttttctttaagacacagtctcgctctgtcacccaggctggagtgcagtggtgcgatcttggctcactgcaacctttgcttcccaggttcaagcaattctccctgcctcagcctccggagtagctgggattacaggtgcatgctactgtgcccggctaatttttgtatttttagtagagatggggtttcaccaagttggtcaggctggtcttgaactcctgacctcaggtgatccgcctgcctctgactcccaaagtgctgctgttacaggcataagccaccgcacctggcctgtttcctgaccttttaatgatcaccattctaactggcatgagatggtacctcattgcggtttcgatttgcatttctctaattaccagtgatgataagctttctttagtatgtttgttggccacataaatgtcttcttttgagaagtgtctgctcataatatttgcccactttttgatagggttgcttttttcttgtaaaattgtttaagttccttgtagattctggatattagccctttctcagatggacagattgtaaaaattttctcccattctgtaggttgcctgtttactctgatgttaggttcttttgctgtgcagaaactctttagtttaactggatcccatttgtcaattttggcttttgttgcaattgctttggtgttttagtcacgaagtctttacctatgcctgtgtcctggatggtattgcctaggttttcttctagggtttttatggttttaggtcttacattaagtctttaatccatcttgagttaatttttgtataaggtgtaaggagggtccagtttcacctttctacatatggccagccagttttcccagcaccatttattaaatagggaatcctttccccatttcttgctttttgtcaggtttgtcaatgactagatgtttgtagatgtgtggtgttatttctgaggcctctgttctgttccattggtttatatatctgctttgataccagtaccttgctgttttggttactgtatccttgtagtatagtttgaagtcaggtagcatggtatctccagttttgttctttttgcttaggattgtcttggctatacaggctcttttttggttccatatgaaatttaaagtagatttttctaattctgtgagaaaagtcagtagtagcttgatggatataattgaatctataaattactttgggcaataaagccattttcacaataagtttcaacatgtaaattttggaacagacataaacattcaaattatagcacctatttttaaagcatttgttttcagtagaatcttggtttgcagtcattctagttttattgtcttatggggtctctgaagactctccaagggaattacctctttaacaagatttttggggtttagagttgatattcaattacattttattcctcttagttctattacctcagattagtaaagttcattccacctagatatatcattgtttcagaagttgagagggaaattcttaagattagttagctaacattttgtattatataaattttttaatcctcattttgtggacagaaatccagactatagcagattatttgagatattctaggagcgaagtaatatttgtcgaattatcattagatattttcaccatgttcaatatgttatctttactggtcagaataggagatacaggtctctgtaatttgggaagtttgtatcaaaaagtcataatacgggagaaattacaataaatgcttgggcttttctgttatgtatccctggtcaaaagttctaagagaactttttagcctgattttcccagaaagaagagcccaaacagtctaatgtgctcttattttataggaaagacaattccagggactagaagtgaagaacaacagtaaaaaaaattcaagaaaagaggtagagcccaaatggggctgtggtattgagctgactgtagtgttacaccatggaaatgactgtaactatatctccggacaatcctggagagggaaggtaataaggtttggctttgtgtccccacccatatctcaccttgaattgtaataatccccacatgtcaagggtggggccaggtggagaaaattgagttttggtggtggatcccccatactgttctcgtggtagtgaataagtctcatgagatctgttagtttcataaatgggagttcccttgcacaagctctcttgtctgttgccatgtaagacatgtcttgcttctgcttcaccctctgccataattgtgaggcctccccagccatgtggaattgtgagtccattaaaccttttattctttataaattacccagtcttgtgtatgtctttattggcagcatgagaacagactaataccgaaggcaaaaaacaaaaataattgatctactaggccttcttagcaattagtaagctttaccccatgatgtaataactcccccataccaccaggttgtgcatgctgggcataggagctgaatggagccctgtggtatcaccagcaaggccgcccttgggtgggaagccagaggggaagggaaggggctgaagacgaggcagcatccagttacatctgtgtgaatttggtctgaacacatggaaacctggaacagggatgtcaaaagggtctgaagaaaaggataattggtgttgcatacaaaggtctttatttctttttgcaagcatgttttatctaaatgtatcttatatctcatggtcttagtctctggactgccgatgtcctctttcttactgagattatttccctattgtatattgctgatggtatttctgctgctaaatgatacgcatggagaatgttctaagatagatggagagccttaggggccatatctgtagagggaaaaatctaagaacatgcttggaagcacagttcttctctcctttgactacttccttaggagtactctttaaggacaatttctggcttgttacaaggagatctcacatatgtgagggctgtgtattacacacttgagagtggctaagaacagctggccatatagctgccaacattataactgacagaggatgctctgaatcaaagcccaagtgaggatgtgcagaatcctctgagggggataaaaacacattgaaaataatgctaagaaagaagtctctgttcacaagacaatactgatttcaaatttcttgaaaaattctcaggctgcaatcataaatattactctacttaaaatacactgatatatgagttatgtcatttgcaaaaaaatattgtgtaacagaaaaggtaaacagatacattagtgtctacccactttaattttatcctaggactagaatccagtcagattttttttcttcctagggtaggcagtgctccaccaagaaagctataaatatattttctcggaaaaatacactttgcacatgaactgtaccgagatgagtgcacatacacaagtttgcaagaaatgtcagacccttgaagtttccttctttaataaatgcagaaaaaatgataatttgacatagtttttttatgaaactggtaataagaattaacttttagcaaacccaatttccccaatagaactgcatgcttactttctaacaaattaggtaaataatacatggaacttttttttttcattttcaggcaattataaaattttaaatgtaatttttctctttatgaacaaacctatctaagttcaaatataagcctcaaaatatgagaaattcaggaaggataggatatatgatgaaaggatagtagagctgagaatttcccagtatggagacaaaaaggctaaggggaggtatgatagcttctgaaaatatgttaagggatgttatcaggaggacagggaccaattcttattagccaatgagagcagaacaggaagtaatgaacttcaactacagcagggaaatttaagtgaaatataagaaaacttttaaactgtcagaacaattaagcaaaggtacaaataataaattcacctttactgatcatattcaatgatgctctgatgagcatcattttactctctctccatgagttcattttttttacgtcctatatataagtgagtacatgcagtatgtatctttctgtgcctggcttatttcacttaacacagtgtcctccagttccatccatattgttgcaaatgccaggattttattctttgttatggctgaataatattttattgtgtatatgtaccacattttctttatccatttatctcttgatgaacacttgatgactccatatcttggctattgtgaatactgctgcaataaacatgagagtgcagacatctcttccatatactgatttccattcttttggatatatcccaagtgatgggattgctggatcatatggttgctctatttttagctttgtgagaaacctccatactgttctccattgtggttatactaatttacattcccaccaacagcatatgagagttcccttttctccatatccttgccagtatctgttattgcctgtccttttgataaaaaccattttaactggggtgaaatgatatctcattgttttgattcacattcctctgatgattaatgtgttgagcacttttcatatgcccattggccacttgtatgtcttcttttgagaaatgcctattcagatttttttctttaaaattttttaactttcaagttcatatcatttgcccatttttttgtttttatttctttttattagagaacacatacaaaagaagggagaacagtgtatagtaaagcttcatgcacccatcacccagtttccacaatgatcaatgtttagcccctcatttttttggtgggggaagtaataatataattattataaattaatagcataattatatagaatttagttattaaagtaataattatatagttatgaattgtattgttatagactatataatatgcaataatgtaatatataatttataatataataattatgtatactatataatataataatcttattggcaaggagttattttttctttattttaataggtttttggagaacaggtggtttttggttatatggataagctctttagcggtgatttctgagattttggtgcacccatcacccgagcagtgtacactgtacccaatgtgtagtctttcatccctcagccccctcccaccttcccccgaattctcaaagttcattgtgtcattcttatacctttgtgtcctcatagctaacttccacttataagtgagaacatatgatgtttggtttttcattcctgagttacttcacatagaataatgatctccaactccatccaggttgctgagaatgacattattttgttcctttttatggctgagtagtattctatggtacatacataccgtattttctttatccactcattgattgatgggcatttgggctggttccatatttttgcaattgcaaattgtgctgctataaacatgcgtatacaagtgtcttttttatataatgacttcttttcctttgggtagatacccagtagtgggattggtggatcaaatggtagatccacttttagttctttaaggaatatccacactgttttccatagtggttatactactttacattcccaccagtagtgtaaaagtgttcccttttcctcacatccacatcaacatctattattgattttttaattatggccatttttgcaggaataagatgatattgcattgttgttttgatttgaatttccctgataattggtgatattgagtattttttcatatgtttgttggttacttgtatatcttctttttagaattgtgtatgcatgtccttagcccactttttgatgggattgttcattttgttcttgctgatttgagtttcttgtagattatagatattagtcctttgttggatgcatagtttgcaaagattttctcccacgctgggttgtttgtttactctgttgattatttattttgctatgcagaagcttttttagcttaataaattctcatttatttatctttgtttttgttgcatttgctcttggattcttggtcatgaagtcgttgtctaagccaatatctagaagggttttgttcagtgttatcttccacagtttttatggtttcaggtcttagatttaagactttgattcatctagagttgatttttgtgtaaggtgagaaatgaggatccagttttattcttctacatgtggcttgccaattatctctgccttctgcctgttttaaaaattaaattatggctgggcgtggtggctcacacatgtaatcctagcactttgggaggccaaggcgggtggataacctgaggtcaggagttcgagaccaactgggccaacatggcaaaacgctgtctctacccaaaatgcaaaaattagctgggcgtggtgatggacacctgtgatcccagctactccggaggctgaggcaggagaaccgcttgaacccggggagcggaggttgcagtgagccaagatcatgctactgtactccagcctgggcgtaagaatgagactcggcggggcgcggtggctctcgcctgtaatcccagcactttgggaggccgaggcaggtggatcatgaggtcaggatatcaagaccatcctggctaacacagtgaaaccctgtgtctactaaaaatacaaaaaattagccgggcgttgtggcaggtgcctgtagtcccagctactcaggaggctgaggcaggagaatggcatcaacctgggaggcggagcttgcagtgaaccgcagtgagccgagattgtgtcactgcactccagcctgggcaacagtgcgagactccgtctcaaaaaaaaaaaaaaaaaaaaaaaaaagagaaaaagaaaattatatgttttttttttgtttttgtttttcctaattagtttgaactcctttcatattctggttattaatccttgtcacacgagtagtttgcaaatattttcttccattctatcagttgtttctttactgtgttgattttttttttttctgtgtagaagtttttgttgttatcctatttatatacttttgctttggttgcctgtgcatttgaggtcttaggaaatttttgcctaggccaatgtcctggggcttttccccaatgttttgttctagtagtttcatagtttcaggccttagatttaaatctttaatccgtttttatttgattttttatatagtgagaggtaagagtctagttttcttcttctacatatgaatatccagtttgcccagcaccatttattgaagagactctttccccaatgtgtgtccttcatgcctttgttgaaaatgagttgattgtaaatctgtggatttatttctgggttctctattttgttcttttggtttatgtgtctgcttttatgccagtaccatgctattttgcttacttttagtattagagttttagtataatttaaagtcaggtaatatgatgcctccagcttttcttttccccctctcaggattgctttccctattcaggctcttttttggctccacatgaattttcagattattttttctatttctgtgatgaatgtcattgctattttgatggggattgcattgaatatgtaattcactttgggaagtatgaacatttaaaaaatattgattcttttgatcaatgaacatagaatattttttaatttttgtgtgctttaatttctttttcttttttttactctaagttttagggtacatgtgcacaacgtgcaggtttcttacatatatatatatgtgccatgttggtgtgctgcacccattaactcctcatttaacattaggtatatctcctaatgctatccctcccctctaaccccaccccacaacaggcccaggtgtgtgatgttccccttcctgtgtccacgtgttctcattgttcaattcccacctatgagtgagaacatggggtgtttggttctttgtccttgcgatagtttgctgagattgatggtttccagcttaatccatgttcccacaaaggacaggaactcatccttttttatggctgcatagtattccatggtgtatatgtgccatattttcttaatccagtctatcattgttggacatttggcttggttccaagtctttgctattgtgaatagtgcctcaataaacatatgtgtgtatgtgtctttatagcagcatgatttataatcctttgggtatatacccagtaatgggatcgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgttggtttttctcttgtaaatttgtttgagttcattgcagattctggatattagccctttgtcagatgagtagattgcaacaattttctcccattctgtaggttgcctgttcactctgatggtagtttcttttgctgtgcagaagctctttagtttaattagatcccatttgtcaattttggcttttgttgccattgcttttggtgttttatacatgaagtcctcgcccatgcctatgtcctgaatggtattgcctaggttttcttctagggtttttatggtttcaggtccagcatgtaagtctttaatccatcttgaattaatttttgtataaggtgtaaggaagggatccagtttcagctttctacatatggctagccagttttcccagcaacattgattaaatagggaatcattttcccatttcttgtttttgtcaggtttgtcaaagatcagtttgttgtagatatgtggcattatttctgagggctctgctctgttccattggtctatatctctgttttggtaccagtaccatgctgttttggttactgtagccttgtagtatagtttgaagtcaggtagcgtgatgcctccagctttgttcttttggcttaggattgacttggcaatgcgggctctattttggttccacatgaactttaaagtagttttttccaattccatgaagaaagtcattggtagcttgatggggatggcattgaatctataaattaccttgggcagtgtggccattttcatgatattgattcttcctacccatgagcatgaaatgttcttccatttgtttgtatcctcttttatttcattgagcagtggtttgtagttctccttgaagaggtccttcacatcccttgtaagttggattcctaggtattttattctctttgaagcaattgtgaatgcgagttgactcatgatttgtctctctgtttctctgtagttggtgtataagaatgcttgtgatttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttacgtttaacgtttaaatctttaatccatcttgaattgatttttgtataaggtgtaaggaagggatccagtttcagctttctacatatggctagccagttttcccagcaccatttatgaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgccgccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaagggggagggatagcattgggagatatacctaatgctagatgacacattagtgggtgcagcgcaccagcatggcacatgtatacatatgtaactaacctgcacaatgtgcacatgtaccctaaaacttagagtataataataataaaaaaaaaaaaaaaaaaaaaaagaatgcttgtgatttttgtacattgattttgtatcctgagactttgctgaagttgcttatcagcttaaggagattttgggctgagacgatggggttttctagatatacaatcatgttgtctgcaaacagggacaatttgacttcctcttttcctaattgaataccctttatttccttcttctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatatgtcccatcaataactaatttattgagagtttttagcatgaagggctgttgaattttgtcaaaggccttttctgcatctattgagataatcatatggtttttgtcattggttctgtttatatgctggattacgtttattgatttgcatatgttgaaccagccttgcatcccaggaatgaagcccacttgatcatggtgggtaagctttttgatgtgctgctggatttggtttgccagtattttattgaggatttttgcatcgacgttcatcagggatattggtctaaaattctcttttttggttgtgtctctgccaggctttggtatcaggatgatgctggcctcataaaaatgagttagggaggattccctctttttctattgattggaatagtttcagaaagaatggtaccagctcctccttgtacctctggtagaatttggctttgaatccgtctggtcctggacttgttttcattgttaagcgctttttttactttggtaactttattttcaggtattttatttgtagctatcattaatgggattattttcttggtttcattttcagattgtctgctattggcataaagaaacagtattgatttttgtatgtttattttgtatcctgtagctttaataaatttgttttctaatagtttttcagtggggtcttcaggtttttctaaatataagaccatatttcctgcaaagaagagtaatttgaatttttcttttccaatttggatgacttttatttctttatcttgtttaatttttctagctaggacttccagtgccatgttgaataaaagtggtaagtgggcatccttgccttgttccacatcttagaggaaaggctttcagtttttccgtattcactatgatactgactttactggatgtggcctttactgtgttgaggtatgtctgttctgtactaaacaattgttgaaagtttttatcatgaagagatgttgaattttatcaaatactttttaagcatttattgaaatgattatgtggtttgtccttcattctgtcgacgtgatgtatcacatctattgttttccatgtgttgagccatccttgcatcccagggataaatcccacttggtcataatgaatgatctttttaatgtgttgttggattcagtttgctagtactttgttgaggatttttgcatctatgttagtcagagatattggcctgtagttttctgtttttgtcatgcctttttctggttttggttatcagggtaatactgatctcattgaatgagtttggaagtaccgccttcttatttttttttgaaataatttgagtaggattgatattagctctttaaatgtttgacagagtttagcagtgaagccatcaggtcctgggttttgctttgataggagactttttattattccttttatgtcattacttgttactgatctatttgggttttctatttctttatggtttaatcttggtagattttatgtgtctaggattttatccatttcttctaggtatttggcatgtagttattaataataatctgtaattatcttttgaatttacgtggcatcagttgtaaagtctcctgtttcatctctgattttatgtatttgggtcttctctctttttttcttagtttgtctagctaagggtttgttacttttgtttatcttttcaaaaagtcatatctttattttgttgatgctttgtatttgtttagtctcaatttcatttatttctactctgatctctattatttcttttgttctattaattttgtgtttgatttgctcttgcttttctaattctgtaagatgcgttgttaggtattttatttgaaatttttctacttttttgatgtaggcatttatttctataaactttcctctcagcactacttctgcaatatcctataagttttgatatattgtgtttctattttcacgtgtttaaagatttttaaaattttcttcttaatttcttcattgacctaatggtcattcataagtatattacttaatctccatgtgtttgtatactttccaaagttcctcttgttattgatttctaatcatatcaagcatttatgaccataatggtggtcagaaatcgtggtcagaaatacttgatattgtttgtgtatttttttatttgttgaaacttgttttatgattgaacatatggtctattctggagcatgctccatgtgttgatgagaataatgtgtattctgcagccgttggataaacagttctataaatgtctgttaggtcaatttggtctatagtacaggttaagtctgatgtttgtttgtttattttctgtctagataatctgtccaatactgaaagtggggtgttaaaataattctcaactgctattgtattgggctctatctctttagtgatatttgctttatatatctgggtactccatcattgggtacatatatatttgtaattattatagcatgtcactgaattgacttctttatcattatataatgactttctttgtctctttttataacttttgtcttgaaatctattttataagtacagctactcctgatcttttttggttttcatttacatggaatatcttttcccaccccttgaaataagttttattttaaaaataatttgctaattgtggtgtgtttatctaatattagcttattatttaaagctgcaataatcaattaggccagttttatatttaacaataattgttactctttatggaaaatcatcttcttgataattttaaagttcttggctgacttcttgtcagatctgattaaactgtcattatttttatcttgtacagtggccaaaaaagccctcatgctaggaatagaactgccagctctcctacttttaattgttttctatgcttgtattgttagtttaattgtcaatctgtgatttttctacagtaatcttttccaggctctgagtccctttttaagttttgtttcattgaactagataatataaatcacagagtggcttaattgacatatgttgactgtatatcaatatgttacacacaaaaatgcacacatagaggtatctctcccaactctgaggtggcagattcctctttttcctcaggaactcatattatgtagatgacttgtgactttagaactcatgaaatatgagatgatatatccatcaatctatatcaaacattgataagcttgattatgtttataggtaaaaatagtagaaataactactgtttctagaattatagcagactaaagtattctaaaagcctttcactgcaaatcagtttcaactctaaatgatcatacttttaaatgcattgatcaactcactggaaaatacaagaaatctctaagaatctcaccccaccaataagtttaaatctaggagaaatatttagagaatgtggacaataacagtatatttttttcagtaataccagagagagtttattataaacttactcttattaaaagaacttcttctaaagtatgtatataataaaaaggacaatgatcctaaaaaatctgaagtaaaaaataataacatgcaaagattttggtgtgtaataaatatagacaaatattatattcaaagtaataatttccaatatgtgacattaaaattaccaagaaagcaagagagaaccaagatattagacaataatgtaaagtcagttggaatagcaattaaagttaaaatattctaaggttttgaatttatttaacaggagagataatcaaggggctctttttacattaggaatataagttaaattttcaaaaataccccccaaaacatgttactactaattttaatgtaatataaaaatcaatgcaatcaatatcaaagaatgaagaaatgagaaaaaggtaaaataaaaagatggaatagacagaaaacacaaaataagaaagaaaagtacaaatgttttaataatcacaataaatgtaaataaactaaatactgaactcactgcttaaaatactgatatttccagattgcatgaaatgccaacattcagcaatagctgttttcaaaagactcatcaaaacctgtatatacttgatgaaatagtttcaaatatataaggcaaaacaatataagtataaagataaatttacaattcactattataaggggatatttaaatacctcttgcattatgtgatatttcatctgagcaacacaacatgcatttttagtgaacttagaactcaacactcaacaattatagaatatccattcttcagcaagcaccataaaaactatatagagagatttcaaaggacacattctatgggtacaagacaaattaagttagaagttaaaagacctttcaaatgactgggaaaaagaaacataaatagcacatgagtcagagaaacaattcttactagaaatttgagacacttataactggataataacaaaaatacttgtgtccatttgtctgttcaagtcctctaaggagataccaatgaagaattaaatgtacaaggatacatcggggaaatgtctttgaaggataaagagggagagaacaggaataggctgagggaaacttcagactatgatgtggaactgacgtctgtgaaaagaaaaactagaaggaggattggggtggaaggtattcagacagtagtgcaattctgagaaagcctcctccatgctgatgggagtccccgtctctactaaaagtacaaaaattagccaggcgtggtggcaggcgtctgtaatcccagctgcttaggaggctgaggcaggagaatcacttgaacatgggaagcagaggttgtagtgagccgagatcgcaccactgcactccagcctgggcggcaagagcgagactccgtctcaaacaaacaaacaaaaaggaagataatggagagtagaaggatggttaccaggttgtcctaacagcgttctacatctagccaaaatggacctggtactcttgctatgctcagtcactatcaacagcagcctaggaaaatgtggccttggtgaatgccacagtgggtcagagagtggagtggttagaggttgtcagtcaaccttgtacccacagcacatccttttgatggtattctgagtagcatgcctccatggctactatgatacaaaatatcaacatttttggaatagagttaaacgatattttgaagtatggcagtaagtacttaaaataaaagcttatattaatgagttttgtgttcttcaagattgtagaacaaaagtcaatagaataaacctaaagaaaatagaaacaaggaaacaagatgaaagcacaacgtataaactaaaatagtatatatatatatatatacacacacacacacacacacacacaacatgaaaactaatttgttagaaactttagtaaaatatgcaaaccattgtaaaaatggatcaagaaaaagaagccacaaaaagtaagcataaaaaaggaatataatgggccaggcgtggtggctcacgcctgtaattccagcgctttgggaggctgaggcaggtggatcaccagaggtcaggagttcaagaccagcctggccaacatggcaaaaccccatctctactaaaagtacaaaaattagccaggtgtggtggtgagcgcctgttatcctagctactcaggaggctgaggcaggagaatcgcttgagcctgggaggcggaggttgcagtgagctgagatcgcaccactgcactccagcctgggcgacaagagcaagactccgtcccaaacaaacagacaaacaaacaaacaaaaagaacataatggagagtagaaggatgattaccagaggctaggaaggatagttaccagaggctaggaaggacagttgggggatgggtacaaaaagtagttagaatgcacaagaccttggttttgatagcacaacagggtgataaaaatgataacttaattgtacattttaaaatagctaaaagaatataattggattagtttgtaacaaaaaggataaatgcttaaggatatggataccacagtgttctatgatgtgattattatgcattgcatgcctgtatcaaaacagctcatggaccccataaatatatacgcctactaatgacccacaaaattagaaagtaaaatttaaaaaggaacataattgtagttaaagatttaaaatgacaaaaaaaaaaaaaaaaaaaaacccaaactgagcttatgtcttttaaaagtgttgaatttggctatttttaaaaagtctgtgtcttgcagcatgaagttgcagttttaagaaatacaatgagcctgggcaacacagggagacccccatctctacacaaaattaaaaattagccagacatggtggcacatacctgtggtctcaactactcgggagggtgaggtaggaggatcacttgagcccaggaggttgaggctatagtgagctgtgattgtgccactgtactgcatcctaggtgacagattaagaccttgtctataaaacaatagaagaaaagaaaagaaatacaatgaatttattaggttggtgcaaaagtaatcgcagtttttgccattaaaagtagttgcacaaaccacaattatgtttgcaccaacgtaataaaatatagatttttcaggaaatgatctgaagttttctaacagtttttattttatctactgatatttctaacttcatgcttatcaagtgaaaggaaagcacaaagatttgttctctagcagttttgctgttggatggctggtggtaggtaaatggaatttcctctgacttcatctgcttcagaatactgatggggtctcatcaattcgggtgggagttttcatttgttcatataggatttcatactaaatgccatgtcaagtaatctggaaatcctgacagggtgaatcaaatgtactgaggaatgagtccaaccattttgggcactatgccattactgctggcactcatttattcctggccactgcaattaattcctggaacacagtttctaagggctccagtgggtggtaatgcctttcaaccagaattcactgggctcctttccagtcttttgggcactactgcctctctgctggtacactgctatcttctgatgggtgttttccatgtttccctgattattttcactgccttaaaggatcttcataatgctaaaactaccctatgattgacagcaaggtgcaatgtgaatgatataccacctgaaggctcctaagatagctgtttttactcctaatgttgcatagtgttgttagttgagaaattacttcaagttttatttatagtctctttgcttttcatagaactcaaccacaatctttgaagtctgggctaggaaacaaaactggataacagaaatcatgctttgttcctctctacattgaggaacaatgtgtattacttctacattgatgcgttcttaccagatcaaagtcatcatgtcttggtggttcattttcatctccagatggtttctctctcaggatgcgcatttgttcttataaaaacacatttttgttgaactgatcacatcagttccctagatataattaagtatatttgaatcccccttagatttcttcttcctttttttcttccttacatacttcctatcttcctctttttatcatctctctatcatcaaatgtacttcatacatgtataagaaatcatcacatactaaaataaaagaggaactcaacactgaagataattgagaagaaaataaaaactttaattttcaagaatttttaaaaatatacaattttaaggcagcatataaaaaagataattaggtagaatgcaaataaggaaaacataaattcattcagctgacatttaattcctccagccttttctgaggaatctactttaggtcatgtgctcaatgaaaaataaaaattcaatttgaatggaagtaaatccaacataaatcagtcaaaaagaggccatttggcaggtaggaagaaagcacatttccaaatttgaaaggtcagagatgtggttgaaagattgaaaggcctagtttgcaattgtcacccaccaccttcccagacctaactcaaattcacactgtcacccagtcagaagagagaaatgcaagtggcaacaaagtacacctgagtttcctgccctgtctcctgggagagaagataacccaccttaaggttataccagtgttcttacgaaatgggagattcctctaagcatgcaggaatgatcctcagagtgccatcagaaatgttcccataaccttagtttttgtttgtatttttcctggaaaggtcctgagtactattttcatttaaaaatggaagtagaggcaaaatgagaaattactaatatcattataacatcagtgacttcctcactgtctcatgtttcttctttattcaccaattctagttttcaatctaatttattggacatcatgtttaatatttactatttaaatcatactgttttattctttttgaggaattataggtgaatatgtcataatttctacctcagggatctcagatatgtattatatatgttatttcatgtatttttacatattttgtatttacatacattgtatatttacatatttcttatgtaaatatatgttatttcagatatttcattggaagaaaatttgtatttatttcttcagcaaatattaattagaagtagtgatataagggagaaaaactaatcacaaagaggatgattcatgtgaaatattattaattcttatagggatgatggacattcatgtcaaaagtagaattaggcccagtctttgaaagcagtgaacattttcagtaagtgggttttgggggatagaaaagagcaaggacagtctgaaagcaaatagctttagaaaaacacagatatgggaagcattaggatactgtatatatagcttgggaaagtagaaccttcaggtttgggagggttggctgagggataagacagaggaggcaaattgggaatagcttgtggaagacaaattgcatcctgaggagttggaactttagctgtatggtagagaaactgagtgttttatgtcaaagctatagaaataactttcttctagaaggaacaaatgtgtgctttgatgaatgaaaggctaggaactagtaatattgttcagttactagccccttctaataattgaggcaatcattggctgcccaatctaatttttactattattccttaattgactaaggcctaagtctgagaacagaagatccaccttttccaaaagaagcatcaatcagcctatagttgggaaaagccacctcctagctgtccttagtgaatactggacaggctcccatcaatattccaccaccttcctgccagacacaatgagaagagtgagagctatgtacatagaagtcatcaggcttgtgaattgaatagtaatttactggttttccatttccttaaagggtataggtgcttgttatacaatgaagccacataaggaaaatgcccaagaaaataaagtgagtggtatctgaacaaagacattggcatctcattctgtagttggaagcattataaaaaaataagatgaacaatttgaataacaaatacaaaaacttaattaaataaacaaaattactagaaaaaataacacaccaaaaaatgactcaagtaaaatgagaatatccaataactctaattagtgtagaagttaaatcagtatttaaaaattttctttttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagcttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttctggctgcatgaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtctttcgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttatgaaatagggaatcctttccccattgcttgtttttgtcaggtttgtcaaagatcagatagttgtagatatgtggcgttatctctgagggctctgttctgttccattgatctatatctctgttttggtaccagtaccatgctgttttggttactgtagccttgtagtatagtttgaagtcaggtagtgtgatgcctccagctttgttcttctggcttaggattgacttggcgatgcgggctcttttttggttccatatgaactttaaagtagttttttccagttctgtgaagaaaatcattggtagctttatggggatggcattgaatctgtaaattaccttgggcagtatgggcattttcacaatattgattcttcgtacccatgagcatggaatgttcttccatttatttgtatcctgtttgatttccttgagcagtggtttgtagttctccttgaagaggtccttcacatcccttgtaagttggattcctaggtattttattctctttgtagcaattgtgaatgggagttcactcatgatttagctctctgtttgtctgttattggtatataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagggcatccctgtcttgtgccagttttcaaaggggatgtttccagtttttgcccattcagtatgatattggctgtgggtttgtcatagatagctgttattattttgaaatatgtcccatcaatacctaatttattgagagtttttagcatgaagggctgttgaactttgtcaaaggctttttctgcatctattgagataatcatgtggtttttgtctttggctctgtttataggctgtattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtggaatccatctggtcctggactctttttggttggtaaactattgattattgccacaatttcagctcctattattggtctattcagagattcaacttctcctggtttagtcttgggagagtgtatgtgtcgaggaatgtatccatttcttctagattttctagtttatttgcatagaggtgtttatagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcgtaagtttcaaagaacatctttatttctgccttcatttttttatgtatccagtagtcattcaggagcaggttgttcagtttccatgtagttgagcggttttgagtgagattcttaatcctgagttctagtttgattgcactgtggtctgagagacagtttgttagaatttctgttcttttacatttgctgaggagagctttacttccaagtatgtggtcaattttggaataggtgtggtgtggcgctgaaaaaaaatgtatattctgttgatttggggtggagagttctgtagatgtctattaggtccgcttggtgcagagctgagttcaattcctgggtatccttgttgactttctgtctcgttgatctgtgtaatgttgacagtggggtgttaaagtctcccattattaatgtgtgggcatctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgtacgtgagatggatttcctgaatacagcacactgatgggtcttgactctttatccaatttgccagtctgtgtcttttaattggagcatttagtccatttacatttaaagttaatattgttatgtttgaatttgatcctgtcattatgatgttagctggtgattttgctcattagttgatgcagtttcttcctagtctcgatggtctttacattttggcacgattttgcagcggctggtaccggttgttcctttccatgtttcgcgcttccttcaggagctcttttagggcaggcctggtggtgacaaaatcggtcagcatttgcttgtctgtaaagtattttatttctcctttgcttatgaagcttagtttggctggatatgaaattctgggttgaaaattcttttttttaagaatgttgaatattggcccccactctcttctggcttgtagggtttctgccgagagatccgctgttaatctgatgggcttccctttgagggtaacccaacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctgcataatatcctgcagagtgttttccaacttggttccattctccccatcactttcaggtacaccaatcagacgtagatttggtcttttcacatagtcccatatttcttggaggctttgcccatttctttttattcttttttctctaaacttcccttctcgcttcattgcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagcttgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttgtccttctaacagacaggaccctcagctgcagatctgttggaataccctgccgtgtgaggtgtcagtgtgcccctgctggggggtgcctcccagttaggctgctcgggggtcaggggtcagggacccacttgaggaggcagtctgcgggttctcagatctccagctgcgtgctgggagaaccactgctctcttcaaagctgtcagacagggatatttaagtctgcagaggttactgctgtctttttgtttgtctgtgccctgcccccagaggtggagcctacagaggcaggcaggcctccttgagctgtggtgggctccacccagttcgagcttccaggctgctttgtttacctcagcaagcctgggcaatggcgggcgcccctcccccagcctcgctgccgccttgcagtttgatctcagactgctgtgctagcaatcagcgagattccatgggcgtaggaccctctgagccaggtgtgggatataatctcgtggtgcgccgttttttaagccggtctgaaaagcgcaatatttgggtgggagtgacccgattttgcaggtgcgtccgtcacccctttctttgactcggaaagggaactccctgaccccttgcacttcccaagtgaggcaatgcctcgccctgcttcggctcgcacacggtgggcgcacccactggcctgcgcccactgtctggcactccctagtgagatgaacccggtacctcagatggaaatgcagaaatcacccgtcttctgcctcgctcacgctgggagctgtagactggagctgttcctattcggccatcttggctcctccaaaaattttcctaccaagagaacaccacacctgactgatttttaggtgagttctaccaaacacttagggatatgatcaaatacataaaaattattttagaaaatataaaatgacaaaacattttctacctcattttatataagcatatctgtatgtaaattataaatgttatatacaacatatattcaaatatatcacacacacatacacacacacacacacacacacacacatatatatatatacacacacacacatagtagtacctcattattcatagggtttggttccgggacctcctgcgggcaccaaaatccacaggtgcttaagtccatgatataaaatggtataatatttgcatattacatatgcacatccttttgtatactttaaatctatctctagattacttataatcctgaatacagtataaatgctatgcaaacaattgttatactgtattattcagggaataatgaggagaaaaatagcctgtatatgttcagtagagatgtaagtcttattttttcaaatattttaaattttcagttggttgaatccactcatgtgtaaccaacagccaggagggccgactaaacacagtataaactttagtaccaaaaccaggcaaggttttggtactaaattataacttcattctatagcaagcacctatacccagaaaaatacagagttacctcattcatgaatacagatgttcaaatcccatcattagtacacatccaaatgtatgaatctcataagcataagtaaaaaattaactcagaaattttacacagcatgatgtaatttttgaaggttcgagcacaaaagtgaacaacattttacttggaagtgcatgcattcattcaataaaacatttagaattgtggacatctctgtgaagaagggagggaaatgcaatctttgagggcacgtggcagagattcagcattctgagcaacgttctctgtcttgagctgaatggtgactatttgaaattatttttgcagcatcaaataattttagggctgaaaggacctttgcaataaacaagcctgggtttttgttttattcatgaacaaactaggctcagaatgcgtaaattctttacatacggtcacacaaaatcatccgagtctcttgctaatgttttttctattacaaaacactgatagaaactgaatgagtcttctgtttggatttttcttctgtccatttaagctgtcattaggtatgatccttatgataaacattaaataacaatacccgttacttcgcattcatattttaatatttgttttaatcatttatttttaatatggtatcagaaattatttttcaatgaactctgaatagctattatttattaagtgttccctatgtgtttatcactgtgataagttctttattaactaatttgatgtgtggttttactaaatttacagtcaaagtttattcttggggagaacatttccctaattgtattatgatttgcaataatatagggatttaatttgcagagaaacttaggggggttcaggaaagtttcctagaggaatatgatgggaagtcagctgggtgagaaatgcaattgaagttggcagaggaacaggtgaggcagcggggtgggggtgggagtaggatggtggttataagggaaatttgtaccctgcaagtaggaagacgatagattactggaatcctaggtgtaatactgaaacaacaggtaaatctatgcaccctgaacacacaatgcaggctaagctgggggaaatagtttcaatctttgaggttcttggtatgggatgttctacttagttccccatccccaagctcaatgtcagtccacagaataaatttctgagatagaaattaaaatgagttaaaattcttatctgtgtctgtgagttttatatacacagaggagtgattagcataaaatatgaaattgaagccatagaaaacaatgaacatgtaacatcagaggtagctaattccagtgacagaagcctgagggacaccagcatgtaaaagaacagaggaagcacaacctgcaactgaagcagaaagaacaaccacagagttaaggaaaaaaaaaactgaagaatatggatttataaacgccaaagggagatgaaagacttcaagacgattgggtaaagttagcagggtcaaatattgctgagagtttagtgaagttaaatgttgagaagtacatgctaaactttgtgacaatgaggtcacgccactgatttctttgttgttgggaataaatgaataataaaatgtaaaaaaaaaaggactgataagtgaggtagaggagataactagggtgcacagtagtttcaagatatttggttctgaacaggtaacaaagataggatggtaattagaaacagatgtcgcaggaagggtttcccttagaatgagtgagagtagatcatgttaaatacccacggaagtgaagcagatacagggaaaggatgggagtaattaatggaaagcacagagaaagcacagagactgtgggaagagacagaaccagagaagaagtgggcagagtaatgataggaagaggactgtttctaactttggtggcagaaagggaggataagaaaatcctttttttgatagattttatcttctctatgaggaagaaagcaatgttgtctgctgtgaattggaaggcaaaaggtgggaggcctgaggaacagtggctctaaccagtgggtcttactttgtctgcattttggaatcacctagagcactgtcaaacatatcaggttgtacttcagacaaaataatcataatctctgagggtgggactcagacataagtacttttagtaattcccaggtcataattatgtgccacaaagcctgcaaacatcaccttaaaccctggctgctcattggaatcatctgggagaccttttaaagttagtgatgcctggatcctatcatgagaggatctgattttattgtttttgtatgaggcctcagttattaggattattaaaaagcatcctgggattctaacacgtaaaccacatgtttacatgtggttgagaacccctgattataaatggtagtcagtcagtgatgaagactcaacagaggttgaaatgtcaggtgtgtaataacagatgcttgcacaaatgtgtgatgcacccatggcactcagcagtcctggtatagaactggaaaagatgaatagttggattcatatgagcccagggttttgttagctgctgctgtctgtcttggaaggaaaatgtgtaaaacatacttgcagatattgataaatagaggggtgttaatgatgaattataaagttcaagctgaatagaaaatagaggtaaagagatgagggggtcagtaaggaagaagtaaagagacagttaggcagaagattcctatgaggttgatgaacaaatatagagcaagcaactgcatgaaaaaactggcaataattgtggttgaaagtctaaaactgatttaatttaaaaatttttctttgttgttattggcatccttgacagaggctaatactaatgccagtagtcaaacacaaatgagtgaacaggtgagtattagaaatgatctttatacaaagtaatgcactgttttggaataatatagtattgccacagagcctcgcatttcccggtatagattggaagtgttgactcatatttggtcttggcagttagaaatggaggtcaagaaagatgtctgattatggtgctgcttcaagatgttggtcttcttaatataaactctcacagaaacatccagggatttagatctctctgggagagatctctgtgtgaacttataaaagacatttagctgaaccatacatcttcactgtctacgctgaaatcaacctttctttttgggggttctttaccttgataagctgcctccaccatgcctggctcttggggatacattactttcttgtttacatttcagctcacatgatggcactattttcttcaaagtttaacaaaacagacaaaacttttaactaataaatgcaagaaaaaatttcacaaattacaaaagtaaaaaatatagatgtttctgaagtccaattttccgattacacaataaattaattctaaaacttcaaagatatttattgggcttgattaccttcctactccttccaggacttacatggtatatttaactttattttccactatatggagaagtttctagggaatgtgtattctattgaagcaagtcttaaagcatttgatgtaccactgttctcttgtttctacatcttgtagagtcaatggaaggactatagtgagaggtttttaatttcggggtagatccagaaaccaggaagtgtttttatcccttatacatcaactgaatatatttgttatataatgattttaacttaaatatattaaaaataacagctattatttattatgtatgactgtatcacatacagctctagttacttaacatgcatcatgtaatccttctatcaaccctttattttaaagatgaggacactgaagtgaataagttacccatgatcctacagagtacattgttgaattttatttttgacttgaaaactgaagtatcttttggataagaaggctaagtaatccagctgatggctttctctttaagcctaccatacgagatactacaataataagagaagattggaattcttaataccaacagaaaaaccatcaagaaatcctgaagagatggaatgtggtttcatacaactgagggatttaaaagtagtctagaatggaagaaggtcaggcatcacagattaagacagattggatgagtgctttctagataggtgctttattctttcccccatatttctctgaggaatttccccttcccatcatcactgcaaagcagagaaaacatcatcagtgcagtgtcagcccaatgagatgaattgtattaggctagcattggagttcagctgaagttggaagaaaaacaaaattgcaggtggataccattattccctggttatccttttctcccaaggagccccaccacactcagtagattagtggactgcaaaatacatgttgaaaagtagcactcagtagattagtggactgcaaaatacatgttgaaaagtagcacttggggaagaggtacaaagatgtatatggagaggcagggtcacctggatgtgatggtgcagaaatgggaacattagaatccagattagaacactagaggttctctaccctgaggtacatttcttttgatgtaaatttatccactcttaaactcactaacaggagcaaaacctatggcttgggccttcaaagaatccctaaaataatttaaaaaaatagtcaaagttgctggcacttccaaagaaattttaattcatgagagagaaatgttaagatattttaagaatgcaataatataaccaaataaaacaatcagtgggccagagagtatatgaatttcaactaagctcaatatatattcttaaatgtataaaagagattactacaaatactaagcaagaacaagtagttagagaaggaattaagtgtagatgctataatttaaaaatataattgttgaaataaagaactcagtaaaatgaggttaatgatggaataagtgggtataactgagaaaggaattgtaaactggaagtcaagcggctattagagaagaaaataggaaaagtggaaagaaaagtataaaatagttaagagataattaaaatgtagaagttaaaataagggtaaagggaagaaataccaaaacatgtagaaatacaagaaggaggaataagaaataatggaaaaaagtttgaagaaatataactgaggattggaagaagttacagataacctataattagcttaataaattgaaagaaaaataaatgtaaaataaacataaaaatgtgttaaacaatttaggaataaccagtagaagaataaaacttgatcatataattttataatcaataaaaaatgtctttccaatataagaagaaaaataaataaggtatgacaaatagaaattattaaataatatggtataattttaatgtaacagtaattgcaataaattttaaatgtattttatttataaatcaaaagacaaatactctgagatgaaaatttttaaaaattacaatacaagtaaatactattgagatagaaaattatgaagacattgtgaaaaaaaacagagaaaatcaaccaaagcaataatggagtaacagttttaatattaggccaaaggtaattcaagtcaaacataacagaaaaaatgttacattctgataaaaaaataaatctaggaaaagagcaatataagtccataggatttataaaaaataataaatatatggataaattataataaaaggaaagaaaaataaaaaaagatgaaactaaagtttgtttttttgaaaaacataagaagtacctgcatgcactgcctagaggcctgagggttggcctgccactgctactgccactactgatgtcctgcatgctacccagggactagaggactcacttgcctgctgggcccaccactaccattgctggcacctaagcaagttgctggggggcccagggacccatccacccaaacccccaccccattggcatttttgtatatcacccaagatcctgataacaagcatgcctagcttgctgccaccatcacttgtgcctgaggactggcctgcctggtgtcccattcctcagcaaagcttcaccacagtctccattaacaaccacagtctaagccactgaggaactcacagatagcactgatgcttattataaccaaagaaatcatatggagacgactgtgcccaccaagcatcaaaacaaaggtactctacccaaccaacactacagatatatctatagggaaagccttttcctacaaaagccaaattgtaaaactggaagaagtatctgttacacagatgcacagatgtcaacgtaatgacacaagaaacatgaaaaagcaaggaaacatggcgcctccaaagaaacacaataattattcagtaacacatcccaaagaaaataaaacctgttaaaagtgagaaaaatattcaaaggaacaatattaaagaaactcagtgagatacaaaggaatacagattaaaaatagaaataaatcaggaaaaaagttcaggatctgaatgagaaatttaacaaagaaatagatatagtaaaatataactaaacaaattctagaactgaacaactcaaataaaaaaataaaaatacaacattgacctttaacaataggctagatcaagcagaagaaataatatttgtacttgaagataggtctgctgaaataacccagtcagctaataaaaaagcctatatgacatatgggatattataaagcaaacaaatatttgaatttgtggtgtctcataagacaaacagaaaattaaagggatatgaaagctatttaatgaaaaaatagcttaaaattacccaattcttgcaaaagatatggacatccaaatacagaaagcttaatctccctagtagattcaacccaaaatggtctcctcaaagcgtattatagtcaaactgtcaaaagtcaaagacagaatcctaaaaacagccagagaaaagcatcaagtcgtatataaaggcatcaccatcagactaacagctaatttctcaacagaaaccttataggaaggaagagaatggggtgagataattaaagtgctgaaaagaaaaacgaacaaaatacaaataacaataacaaaatacaaactgtatggcaagaatgctatacacaacaaacacattcttcaaaaaatgagacagaaatcaagtctttcccaaacaagcaaaaactgaggaagtttatttccagtagacctgtggtggtctagtggtgatatagaatttcctaccagaaatgcttatgcgagtcatatatctgcaagtgaaaggatgatctccacaatcatgaaaacacatgaaagtataatactcactgggagagcagacaagtgagaaagagaaaagagtcaaacattaacactactgaaaaatgacaccccccaataataaaaaataaaagaagaaaaaggggataaagcatatgaaaatcaaccagaaaaaaaaaagtgtagcaagttgacaggaataagtcctcacctgtaatgataaccctaaatggaaacagtttaaattcacgacttaaaaatataaactggctgcataaataaaaacaaatatggctcaattatctgctgcctataagaaactcacttcacctatagagacacatatagactaaaaataaaggaataaaaaagatattccatgcaaacaggatccaaaagtcagcaggagtatctagctatagttacataagataaaacagacttaaagtcaaaaacagtaaaaatgcacgaagaatgtcattatataataataagtcagtttgaaagaggatgtaacaattttaaatatacacgtacctgccatggaagcacccagatatataaagctaatagtagatctaaagggaaagataggctctcagcattatacagatcatgtagaaggcacatcaatacagaaatattggatttaaactgcattttaggccaaatggacctaacagacatttaaacaacatttcatccaacagctacagaatacatgttcttctcaccagcatatggaccattcacaaggatagaccatatgctgggccacaaaacaaggctcaacaaatttaaaaatttgaaatcttatcaagtatattctgagaccacaatggaacaaaactagaaattgataacaacaggaactttagacagtgtacaaatacatgcaaattagacaacatgattctgaacaactattggttcaaagaagaaataaagaaggaaacaaaaacatttactgaaatgagtgaaaatggaaacacaccataccaacacttatgagacacggcgaaagcagggttaagagagaatgtaataccaaaaaatgcctacatcaaaaaagtaaaaagattaaaagtaaacaacctaattgatgcacctcaaggaactagaaatgcaagaagaaaccaaaccatcattaataaaaaaataataaagatcagagcagaactaaatgaaatcatgacttaaaaattacaaagaatcaatataatgaaacagatttcttttttaaaaagataaaattaatccagtggtagctagtctaagaagaaaaaaaaagaagacccatataaaatcagaaccgaaaaaaagatacactagaggagaaaccacaaaaaatgcaaagtataattagagactatttgtgaacaactaactatactctagcaaattggaaaacctagaggaaatggatactttcccggacacgtacaatctaccaagattgaaccaggaagaaacagaaaacgtgaacagaccaataacaagtagtaagattgaatcagtaatcaaaagtcttctaaccaagaaaattccaggactgaacagctttactgctgaattctaaccaatcttataaaaacaaagtaactaacaccaattcttctcacaccattccaaaaaattaaaaaggagggaactcttcctaattcattttacgagaacagcattaccctaatactaaaaccagacaaggacacaacaaaaaaagaaaactacaggccaatatttctgatgaaaatagatgaaaaaatccttaaaaaatgccagcaaatcaaatctaacaacacatcaaaaagataatacattatgataaagtgggatttatctcaggatacaaggatgttttcaacatgcacaaatcattaaatgtgatacatcacatcaatggaatgaaggacaaaaaccatacaatcatctcaataaatgcaggaaaaagcaaattatgcacaataatgttcataagtgacaaatccactgataatatcatactgaatgtggaaaagcggaaagttttttctctaagaattgcaatatgacaaggagtaggagtcctagctagaacaatcaggaagagaaataaataaaaggcaaccaaattagcaaacaaagtcaaattattcctctttgcagacaacataatcttacacacatacatatatatgtgtgtgtgtgtgtgtgtgtgtataaacctacacattccaccgaaaaactcttatacctagaacacaaacaagagaaaaaaagaacaaatgaacaaacaacccctccaccggcaagctcacaaataacctcaaaatataagcaaatgatctgaataggcatttttcaaaagaagacgaatgactaacagatatacgaaaaaatgcctaacatcactaattatcactgaaatgcaaatgaaaactacaatgagatatcatctcactccagttaaaatggttattatcaaaaagacaaaaataacaaatgttagtaagatgcagaaaaggagaactcttacacactgttggtgggaatgtaaattactgtagccatcatggaaaacattatggaggtttctcaaaaaactaaaaataacaccaccatatgattcagcaatctcattactgggtagtgatacctgagctcccttgtctactgcagcactattcacaatagccaagatatggaatcaatgtaagtatccatcaacagagggatagataaaacatatgtggtgtgaatacaaaattgaatgctattcagccacacaaaagacaaaatgttgtcatttgcagcaacagagagggaactgaagaccattatgttaagtgaaataacccaggcacagaaaggcaaatatatattctcactcatgggtgagagctaaaaaagttgatctcatggaggcagagagttaaatgatggttacgagagggtaggaagcgtggatgacggggaggaagagaggttgttcaattagtacaaacatacagttagatggaagggaaaagctctagttttcaatagcacagttgggtggctataattagcaataatttattgtatatttaaaagtaactagaaaagaagtcttgaaatgttcttaacatgaagaaatgataaatatttgaggtgatgggtatcctaaataccctgattttacacattgtatgcacgtaccaaaatattacatttattctagaaatatgtgtgattattacatattaataaaatgttaatttaaaaacctttttttttgaggatctagacaaattcattctaaaatgtctaggaaagaataaaggtccactaatagctaaattaattttgaggagcattttaaagagaaattcttaccctagcagatatgaatacatatttacaaaaccacggtaattgtttaaaaaatcacaatagggtattgttgcatgaacaaacaacatttcattgggagaagatattttagcatcagaaactgacaggggattaatttatagaactctccataccatgagtggggtgcatgctccagactggatcccaaagcctaaagccttgtctaggtgaggattgcaaagtgtcaaaagaggtgagctgagtctagagcttgcctagtctggtcaatctttgacttgagaactgaggtctgaaatttatcaagaaagaaagaagcatacatttgaatgaaaactaaagttagttaatagactaataatttggacagaatagaagtattgttatatagtgaaattgaagctcagagagataaaattaataagaaaaaccaacttcaagaaaaactgattttgggaaaaatagatacaaataaaaaagtacaaggaaaataacataaaattaagaattgtagaccatgaactttagtataggaaagaacttggaatttacaaaatactaatataacatagtgggcagaaatatataaattagacattttaactagagattttatattagattcagagaaatggatgggtcatacaaaccaaaaatattcaatatttagaagattcaaaaacacaactattaagctaaaatgcaaatatagagagagaaagagggagagaaggaggctgtaatgaagtgtctgactccatttttgatgtttgattgctgacagcttttaatgcccacatttttcctttccttttctgctccacatttggtcaggcagatgagaaatccaggtgtccccttctttagtgccagccagtggtaagttaaagccacataagtcttgggcagtatgtatgggaactctcaattcagcctcagcccctcaacataataaaagtcacgccggtctcctttctctgctctctgaagccagttttggacctggttaggagtctgtcctccccacaaaacctcattatgtgatacacattttatatccgttggtgcatgtgtggtgtcattagtttggcatctgaaccaaatttgcgatatgtgtatggggaggaaggttcacacagtgatgaagaaaattttacaatcaaccaaaataaaaaaatacagtcttttcaaacaaacatataatatatacagaaatttccacaaacatggcctcaaagatagtctcagcttatttttaaaaatccacattattcagattatattgacttgctatgattcaataaaattagaaatcaagagtaaataaataacttaaaactttctctctctctctggaacttaataaacctactaccaaataacctttaggttgaacattattataaagggaaaacactttgacctaaataaccttgaaaatacaacctatccaatgtattgaactaaagtaggtatgtttagaggaactataataacattaagtatatttataataaagactgaaaataaatttggttcagatgtcaaacagataacatcgcacatgcagcaatagggtaaaaaggctgatttcataatgaggctttgtggaaaggaaatacccccgaacagttccaaaacaggcttgagagagcagagaccaacaaataacttaggaaaggagcagcataatatgcttatgggatatatggaaaaaataataaatataagaataaatcatcatgaaagaaagaaaaagagaagactcataatagtaaaatttgttctttgaaaaaattaataagaatgaccatcctctgggaaaactgatcttgaaaaaaagagaaaagatgcaaataacaacaaaaaagtagaaacatcataattttaacatgaaataacaaaaagaatatgaaaatctatatccaattatgtttgaatacctagatgacttgaataaatttctggaggaattaaagcctgccctgcaggcttttgcaggtgcaaaaaggaagaaaatatgaataccattaaaactactaatgaactgaaattcagccaagcccctcctcccatcaacaaaagattctgcaggtgaactgtaccaaactttcaaggaaaatattattcattgtttttgaagtttttatataaaacagaaaaaagacaaatattattaactcatgttatgaggttagtataaatttgattaacaagttggataaataagagaaaaagaaagttctagaggaatttgatcaatcctttatattgttgcaaaagtacaaataaaccattcattaactggattcaaatgtgtattttaaaaaatgatcaagatgggtccatctcaaaaaagtaaggagagatgaacatcagaaaatctagtagtacaatctactacattaattgaccaaaggagaaataagttttgattatcagaataaataaggaaaaactttaataaacatcaactcagatttattacaaaaactcctaaacatagaaaacaaagttgctggacataagatcagtttacagaaatgaagttcattcatcagtattacgactaactagaatatgaaacagaaagtaagagaccaatcacagtaaaaatgaaactatagaattgtaggagttaatctaataaagaatgtgcaacatctttatgcagaaaaaaatcctattaaatgatgttaaggaatacctaggtaaatggtcaaaatactgagccatgtttatggatggaatgattaataatataagtatgtcaattttactaaagtagcatataaattcaatgcaattgcaatcaaaattacaaacatatctttaaacaagacattgaaaaactgattttttatgtgtttgaaaaaataggatcttaaaaattccggattttttttttaaataaagtaaagcctccccagttctaatatatactaccaagtcagtgttctggtataaaagcccaatggaaccaaatcaaaggtcagaacagatctggtgtatattggaatttggtttataactggagcaatgcctcagatgaataaagataagacaggcctaaatgtgaagagtgaactcgaaagccaaaagaaaaaataatctgagacatgactatagctctgaagatagcaaggccttcaaaaacaagggcagaacattaatgagtaaattgagagatttaactacatcacaactaaatatttctgctcaagaaaggataaatagacaaagttaacttgacggtgagaaatggaaaaagatatttacaatgtttaaaaaacccacaaaagattaatatctaaaatatgcaatgaatgtcaacagaaagaagacaggaaaaccaattgaaaagtgaaaaactcgcagatggaaattcgggatgaattataagaacaagacatgatgctgtgaaacagagtctctgaaccatttaactcaatcacttcatgagatcatctccccctatttccacaaaatgtagagtgtacttaaaaatcaaatgcttatgtaaaaataaaataaaatacaggagaagtctaaatttttgcttggaagtaactgctcctgaaagattaaccttttcagcaaatatgcacttagcacctactataggcctggcaaattttgtgtgctggggataaaattccactcttgtggcatttacattttagttagagaaagtgctgtaagattcattttgatagatattgcttttatctgcaatatctaaagaagtactttacacacagttgaatattaaataaatattattgactgaatgaatacatgattaatgatatgctggcctcctactaaaatgtaatttttggtggtcccagttgagttagatcttttagtaaaaacctgagcaggttagtacctttcttccattcttgcctctgtgcttcgtatgctttagttcaatgtctaatttcacagaaatgtctcacaaggcagctatatggtatacagatttatttagtttcacatcctatctctgtcacctactatgtgtgttttgtcagtttaaatattctgatgctcacttttctcatcagtagaaaaggggtaatgatacttgcctcggagggtggccatacagtttaagagtgattaaacacacacacacacacacacacacacacacacacacacacacacacacagcttggcatggttcccggcatggaaggcacactctataaatggtagctattatcaacaattatatcttgttaaatgacattactaatgagtgaatcacaatggagaaaacagcaaagtacagccctacatggaaacttcatttttaagcacagtctgtcctttaaatctgtgggcacatttcttctcctatgcaaaatctcttggttaaggtgcaagatatcagcaagtggggatgatcttttgggtttaatgccttttctcatgttgaatctatacattcatgaattgctgaataccagagccacgtctccaattaaggaactatgcttcctatttttacctctctggcctattctagctttcccttcagtaaaagaacttgagacaagggattacatgcaggtagttcgttttcgaaagtgatttcatggggcattaactttcttgcacttccaagctgtgcttgcattaacacctagaaggtccctttctttaaacactaccttggaggccttctgacctgcacagcatggcttcaattgataattggctaatataaggttgccttttcttttttcaaagttcttaagaacttaacaaaaggattactaataggacattatctcttttgactttcaggttgctcttgtgtgagagcctggtggttcctaaaagtgtttcacattgtggagttgaaaagccccagagcataaagcaagtaatatttggagtacctgagacaaggttctatcagggttcctccttgtgttgctgttaactgcagtgacaattagaataaaacataggccaagggaggaggtccaagagaagtccaatacatcttcctttctaactatttgtaaatatcccctctattttggatgctgccacacgtgctccagtatacctgttccgatacagaaccatagaacattagagcagagaagaactttggaggctttcactttgccactgtctcagtggtctgtatttgacgagtaccaacatattaagacattcaattggtgaatcaagtccacgtttgtaaattttctgccatttgggttaggcaacactccatgaggccttatgtagtaactgaggaacatttttggtgcaacagaggtaggagaagtgggattctgggccacatgttcataaagttgccttgcaccctctggacctgcttgcacacaacccattatacaatggatcactgccttattcacccaaacttataactcagtggttgggacaaaattcagctcagaaaaggctgcattggtggcctattctcctatgtcacatagttaaggtattttcctcactaaggattagcagcaaaccaggaactgattttcaaaatgaaaacagttgtttgaatcatgactctgttattggaacttgtcaggcactctgttcagtgtcagaatccaacacagataccattggatctgctgtgtcctatggcccatgtgccaaagcagcttgtactagagggaggaacttctataatgccttctcttggtctgaaacctgcccaaaactggcaactttctgtgtcatcagaaagtattttagaagtattcccaagtgcagtattcccactgtccctaaaattcagaggcttactacatgctgtgccactatttagtagtaaaaatacaaggtgcaacaacttctcttttatcctagagggttagcttaaggcttgaggatgtcctggcttgatctagaccttttgatttctagaatttcattgagatagcagactaataagtggtagattatctggtctcacattttttttttaaatccatcctattatttcttctttctgaggcttctgacttcttcctcaatcctctgctgaggcacctctgataatctctatgccatttttgcagaccaagcttcaaggtgtcatcctggaagcatattgagactggttctagcttctttgctaaaacattaaatcctaaaacatgaatgctttaatgtcaatacattctctctcatgcagcctaaaagcttaaaaataatgatacaaaaatgctcccgtgtcagtcttgaaatgccatttttttttttttttttgagacagagtctggctctgtcgctcaggctggagtgcagtggcacgatcttggctcactgcaagctctgcctcccgggttcacaccattctcctgcctcagcctcctgagtagctgggactacaggcgcctgccactgcgcccggctaaatttttgtatttttagtagaaacggggtttcaccatgttagccaggatggcctcgatctcctgaccttgtgatctgcctgcctcagcctctcaaagtgctgggattacaggcgtgagccaccgcgcccggctgccactgattttttttttatcaggactttgtcattggcttataaaagttatttaacccatacattctgtctcttttgaaactccactcttagagttgaacacagggcctaattttctgcacactttgctctatggttgcaggtgacaaagtcctctctaaatatttcccttagattcttatggctgttataatgttccagctaaaccttagtgacaaccttaataatgacagtatagcatgtgatgggatagcatgccaggagttatcagcatctcacttactactgcaataatggtgtttgtatccttgtgtgtttggtgaatgatccaggtccaaaatctcatcctgatggtctgctttctagggccacttgtttcttagcatgagattaaccaatgaaatatagctcaaggcaagggcttatgttcagatagtttattttgagaatggaccccaaagaaccaaagtggtggattaggaagcatgaaatagggaagaagaaaaggcactaaaggatgcattattaagttggtcaccactgtaggaaactggggcttgattccaccaggaccctctgaggaaccctacagaattgcctcagaattgtccacctgtgggaaagaagaggggagttttgtccgttggatcttatcctccattgatgaattttccccattggcctttaatttccttgtacttctgggttgcacatgtgtgtctcataggttcctcaaggagtcccacattgtggagcaagattgcaacacagggatactgctgcagcatgattggagtataagatggggtaaaaggctgtaaattgggcacaagaagtgaccaattatactcccttctttttattaaaactttccccaagttgagttattcatctttacattctgctccaggtgcctcattaattttttttttttttgtagtagaatcataaaacattggagcaaaaggaacctctgagaaattatgagaacccttttatacagatgatgatactgaggtacaaaaaagcttgtgaattctgacaaatatcatagcatatcagtgctaagattagacttggagctcaggattcttggttacctgcatttgttccttgagactcccaacatcttggagttcaagaggtcatgtaattgttaatatgcaaatgatctacctatttacttatggtcttttttctttgagaataactacagtaatgctacttatgtttattcagtactttacattttgttgagcaatttctatacttcagtccatttaatcctcacaggaaccttataagggttgtgttattatcacttcatagagtaagaaatagaagttggagagtcggttatctgtccatgatcttggttagcaaatataattctgtcttttgaaataattggaattctgtcttgtgaattcctttattacaagctatgggaagatgctttataaatgctaaaggagtacacacatataaaattatgtcgttgagaaatctttaatctttcatgaaaatgggtggtgtccaaatataatcatatacaaacacatgcatatacacacaaagcagaataattattaatttaaaatatgtaaagctcctggcaccatttgtagcataattgttgtttattatatcaatttttttcaggtatttaaaaaattgttgagtacttattgaatacctggcattgttcacaacactgtggatcaaagtcagaacaaagtcttgctttcatacagcttattattaatattaaaaattcatgtaatttattatttgcatccatgactagaattcaaactgaacatcctgtgggctgtgatattttttattgagacaagctatgaaagaagaaatgactttggcgcctagaacaggtaggcgaactggagtacacattctgtacattgtaggttattttcaaaattgctcctcatgatggagggagaccaataagaggaaagcaggtgaaacaaagaacttctgcttcaagcaccgagtttccttaccattttcacataagtaaaatcacaccctcatctccattcctcttacaccaagttcccaactctgctcagccaccaataaaagcatcgtcctcatttctaacttccaacacttgcctactacttttgccagcttgtggttacctatggaagacattttatggcctgaaaatgtctggcttaagaagctccccccccaaatatgcatagcaaaactgatggtaacatatggccctatattttttcccttcttgccagttcactaaaataaatttactttcaatttacatattcttgtctacatttcagagatttaaatatatttgtaaggtctgtcctgtctatctttttctgagattatgcaacagctttgcatgctgtttaggaaataacagaaacttttatgatttttagaatctttcatttcctaagaaatttagaaaagcttatgagatcagaaagagaaaggccgaaatgttaaattatgtaaaatgtgtaataattatttctataagctaagtggtaatatacttttccaatttgaaaacaaatctactgtctataaaactctaaataaaaattctattagataggtacatactatatacaattccatctagatcctttagacaaagggcatatttttaagatttattggaatgcaaaggagatcatggtggggatttttcaatgaaagaaaaccttattatggacctttgaatttgctaatatggaaatactattatttttatccagagatgagactcttgttcagtgagaaaaactggcaggctctgtgagaatgtttcaaaaaactggcttccctcttccggggtccagccttaaccattcttgagattttcgtcaacagcgtactgaatgtggaaaggagtggtcctgtagacaaagagtaccctgtgcctgtagcaagagtgatccaaacgtgaaaggaggggacacttagctatgttttgcttgcttatggtctagattctcttgtggagaacagagctgtgactgggtctttatacattgatgataggactgggtcatcaacctcccttactgatcatgtggctacactctagggaaccattattagggacccttgcctttaccctgaaaaatcatatggcaggtagtattaaggatgtttatgaggtcaagagtaaagtgagatattttaagataattttcagaacagtggttcttaactggaagcagttttattttttcaggggacatttgacagtgccttaagttattacaactcctgaagggggcaactggcatctgatgggtagaagctacaagtgttgctcaacactagaacaaagaaatcttggtttagagttttgttttcttttcttctgtttttgctatttttgtttgatgccccaaacagccatgttaaaatataaatataacctattgttactgagtaatgtgtgcagaggcactccttattttataccatttcagattttactccattctctccttctttgctaagcctcttcttgcatctctctccatttcagaccctaatggtagcccattcctgaccccattcctaagcatcatctcatacctaaatttcaactatagaattggattcaaatatattgtagtttaaaaaaaagttgaaagttgagtggcctagttctttagaccacaaaatgttttcattgagtatgatatacccaagctatgatatgtccatgcaccaggatgaattaatgcattttacctataatactcaagtgacttgtactcttttcttttcatagtgtttggcattatagggtagccaatcttcagacagaggaagtgcctattgcagcaccaaatttgctgcacatatttatgtatatgtagggcattaaaagaaggagatactaatgtaattgataaaaatgagtgattattttaattaaaatgcaaaagaatatggcagagcatcaaataacattcctttttgcaaaacagaatagataataaaatgttctcttctcaaagaagagaagtagggtagaatttttctccaaattttcagaaaggcatctatttcttaaattggtaaaactgttaagtctctgctgtttaggaaataacagaaacttttatgatttttagaagctttcattgacttgcggtcaaaaggtagaattaatacagagtagaagaaaaatgataagactcgatggtgatttgaaattgtaaagaaagaattttacatttaaattatacttagagacatagaaagacgagattaaagccacagtgagggagcggtgttgctgcatacgtgctcaatcacgaaggtttaaaaacagtataattaagcttgcgatctcaaagacagtagtgtgtctgattatggggaagagtcttattgtgaaagatggagcagatgttcatgcttgtgagacatggagacagagatgtctgattttgagcgatcaatactttatgattgtgaagtttgacatttccaatctgataaagaaaaatatctcccatgtgatacaacattctcggctccttttaaaagacagcacttaagtattatttctcttttgggtagggagacaacaatgactatcatattatgaaacaatccttttctaggcattttcactagcatataacatcctaaaaatgcagagagaaagaaaagaataatgagcgctgagggtccaatttgctctaaaaattcttttggagggatggtctcatcttctgatctcaggggcaaatcacacacatattttttcattccaaattagaatgcattacctatagtaacctgttctgattactcctgtcttcaccccaaacacattccctcaaaagggaaagggaatacatgcagagtagccagtggagtatttttgttttaattatactttaaaatttatctaagccactttttgtaattgcttgcttcaaacaaatgagcccagccaatttgccctaggagacaagaaacgcttcatgtcctgaggactttctgtcttccatagagagttgaaatttggcatcatacagctgcttcatagccaagaaattaagggattttctatttcaatagctagctgcattcagagatgttagcctgttaggaatgtgtgtctacagtcagtaacacctaggactgatagcaaatcagacgtgttagagaattttctcaaaaattgccacagctgctgtgtttctgctagaaaataaataacaaatatattgacatgccttttccttagaacagcagctgtactgatcaatgctgttaaaagggctgtctggccaagccgggggttgcatgtgacagtctgagttggtgtcaccgaccctgatgtcctgttattctaatttgcaaacgagagcctaatctcccaagttgaattctttagatattcttctaccttgacactaaaaccatctgccatttggggattgataatgtgtaccttttatgtgttttctcatcattgacatttcctgagccaaaccattagggagttgaccaagggagggaaaggactcccctgccctcaccacccccctctcttttacttcaaacaggcaatgaaaacattttgcataaacaaattcccagtcataactaatcatatgaaagctgacaaaagtatgttatcctacactatgaaaatactaatcaaagcagcttgtcaattgttaaagttaatgatttagatatgcaacactctgactaaattttagtaggtaattacataattatgcacaggttagcacaatcaaaaatagcagttgcctcctcagtctttaaactatgttacggtactgaatctcattctggaaatgacagtttcttatgatgtttcagagcatgaacatggcaccactggctattatgtttcggaaggatttccatgcatctaggctgatctctccaaaggttcaagatcaggagggggtttgtctgttagtgcacaatcaaatttgtagctgaaacactgtatttacaagtttttttcccatctttagcgcaagtaaggcttattattagttacagaatgatccattctaatttataatgccccatagtgttctcaaacttcaggatacaaatacaaaatatctgttagtttatatatttaaaacatttcagcacaacttttctctaaccaaatttctggaaagcaaatctttttttttttttttaactgatttgtactctactgttgaaatcatgtctcaaataggaaaaaaaaatccctagaggattgacaggatattttatcatgcagggcattgaagtctgggatattttctaggactttcaaaaatatgtggcattatttagctctggattctctgcctcaagcccagaatttggagagaaaggaagaataggaggaaactttatcaggtacattctcattttctcctctttcttcttctttgcttctttccatttgttcctttttattgagttcatatcatgtctcaggagacataaaacttcagggggatagaaaaataaaaagcaacacaatctgaaatttcagagaggccccatatagttagaaaagacatgtagacaggtactgtctatgaggtaggtcctagaatagaagtataaataggagtttatgaaagtggaggtaggaacacttaagtttgtgacagggagaagtggtggttgaggaagctccagaaaagaaaatcctttatctgaatcatgagtattcaaggcagaaagtgttttttggggagcaggggaagggaggacattcaggtagagtgaatagcctgtgccaagatatggaagtctgagaacattaaagtgtttggtctggagaactttgatatatccagaacttatatgtaagaacataaaggagacattcaggaaaatctcttctggggcctaatagttctgggactgtaacacagtacttttttttccgttttacgtgaacatatgggattaataaacaatggcttttgttttgtttttttttttttttttggtgagacggagtctcgctctgtcacccaggctggagtgcagtggcgcaatctgggctcactgcagtctctgcctcctgggttcacgctattctcctgcctcagcctcctgagtagctgggactacaggcacccgccaccatgcccggctaattttttgtatttttagtagagacgggatttcactgtgttagccaggatggcctcgatctcctgacctcatgatctgcctgcctcggcctcccaaagtgctgggattacaggcctgagccactgcgctcggccacaatcgctatttttctaaatcaagatgtgtcagtctttgtgttcctttcaaaagataaagtcagtgtaacatctgtaaattccccacgtaaaaccttttgttcatgcttctttttctttgtgttcctgtgaaataatagggataaactggctccatcgtgtcctaaattggttaacgacttttgattagatattattagttgataatttctgcttatgatggcattagatcaaattaatgatcaaattaattaaactcattggcatcctttttcagccataagaaacaggatatgagatgaaatttatacactagtgctttattgtaggatgcagttccggagcagcaggaatgaagggaaatgggaagtaaggaaggactaaagggaaagcaaatgtaatgcaatatgttattgaggtggccacagcttcaaaaaaacagacatttactttggggattgctatggagaatcatatggcctcatggtgccttgtacatcctgcaaagggaagaaaggaagaggaatttatcttctggattcttctgtttactgttcaaggtgtgccccatggggtgttaactcccccaaccttccaggttgtgttggcagcacatgcattatgcagtcatgctatagcctgattccagaaagagaatatggaacatggtatagcccaatgcatatggaatagagactcttctgagaaaaaggaagtagcttgaggagttttagaaatgatttttttagccaaaattttatcatgctgaaagctattatggacaggaaggagcacgtacattgaatggtatattaatttactaaccatatgtgtttcaaatgtttctaggtcagatttagtccctgcagtgcagttgtagattaagacagactggagggaatgcagtcccctgaacagatttaattagcataggaccctgggatgatgtgcactgtgtatggctcgaatgtctctgacttcatattgcatggctgaaggtcacttccaaactgacaactgacgttaaaaacattgatcagaatggctttttcccttgttaacagaggtgctccccaccaactcatcataatatgtcctctctttttaaatctctgtgtacaaatgttaaaattttcaaaaccaagtttcaaaaatgacagtaattttgtaaatgccgtcacaaaaatagagtgaattttcaatgcaggctgatcatttcctttcaggcataattcttgcaatgtaggtagccaatcctaagtagataggattagccacagattgtgcaactcagactgaatgaattatttttttctagtagggttacttgagataaatgaaaaaaaaaattacacttccatactggaatatgaattctttaaaattaatatatatatacacacatatatatgtatttgaaatgtgtattttgatgtctctctcactaatatgttaattttgatttagaagacaagaatataatttcaactttgcaaatgacatttaagagattatttctttgatttgggaggcaagactgaagaaaatactaatagctacatatagtgtgtttgtaatctattttgaatttctgtttcagtcaaatttgaaatgttgatgtattgttcttctttgcattgtattgaacctatttgctgctctgctcacaaatgctaatatttctgtgaagcacagagcctggctcctgcagcttttgcttcaggcatcaccttgttattcttttcagcttcttcttagaaaaaaaagaccctgacctcttacctaggtctcactatctacttagtacttgtgaaagggcaacccatcttaaggcttctgtatacctgctgtgtttctaaatcaccttatattattatctttttcttttctatctcagaatagaaatgtacacacaaagtaccatctttctgttatctgtcccttagttagcaaagagcccatgataacttacttccatttaaaagatggctaccttcacagtattattgctgatgaggagaaattttcctagtattaatctccttttttctaccactcctctcacttattttttccttgctaatgcctactaatttgtatttctcagaaaatacaattccaatattacattttctatgtgtttttagtgagccttgtttgattcacccaactcctagttttaaatctgagttctttggaagaataaactttttcttcttacatttagacatattttgaacataacatgtcaaaactgtttttaaatgaagtgtttggtcatagcaatgaatactgaagtctttctattaatgtaaatctttcctagggcccacaccttcagatgccttaaaactgatagaagcaaaacatcattctagaacctgaatttaaatcatttccatatgaattcaaaccaagcagacaattttcacagatgacaccaaattttacagtttcttttctttctttctttttctttttttttttacttgagtgtgattgatttatataaggcttctattttgattcatgactgtgaatgagaatccttctagcacttgacatccatgcttctgaccaggtttgaggatagagtcaagggtctgtgcactgtgtgaaataaaaacatcagtatatgcagatgacaattctatcagaaaccaaactgcccactacaaaggaataacactatgagatgagataggagctgtttcaggagaaaaacaaaggctttgaacaataaatgggtaaaagatttattataagtgactccaagataattcttttgggatgctgtactatttctcatgtcaacataatttccaattttatcgaataacagaataaaggcaagcacgaaacctgaacaggtaaagtctaatgttttacatggaagtaaaggtgatacatcaggaacttctgcttttcctgtcacattaaaaaaaaaccactcttttgtggttacactcaagaactgtgaagaatctaagatgtcactattacataattgcaaggtaacaagttagcctaccataatttctgggtgctgcaaagctacaagtctccttggtaagagacaaatgaccttattactcatggcacaacaggcagcatgagcttcctgttgttggttcttctgatcccaccaaaacactaatactggccatgcagagaggctcaggtggatgttgaggctcaggtagataaagagaggctcaggtggatgtagctcttaccagtagagctacaaagtttgtatcatagctgagaagctctgagtttaggaagcctcaatcctttaaaagggactgatacaaacttgcccacaccttgaggctataaagaaggaggaactacctttaggttcaaagtccccaaacaaataggggcccgaggagacaatcattcaggggccactgggtgacatttttttctcctttggctcttttacacaagcttgataccacctcctgaattatggacctcccagcatctagagtgttgagggtcagcagcttcttcctttgggtcacatgtatgctcggttgcatagatcttgatggtttgagacaaccctgtacctaacattgctctttccctgggacaactcatggcaatcattgggggcatctctaaccaatagatctacaaggtttgagttgctcttctcctctgggatactcagcttttccttaaggcacccgttcatgtgccgttttttggaatacacattctttttttcatagaattttttcttactcttcagaatgctgggattgatagaaagaggaatccacaaagtatatgcataaacaaaatgcaaaaagatatatttaaaatgttaaaaactttaaattgtattaatgtctattttatgaaaaaagataattaaaaatgggttaaacattagggaggaccagattttaatagtggcgttgatagaatccttatgtttgtgcttttagcaggattggccactaaatgatttctccagcaaaaaaaatcatgaaagaagaccaaagacagtaatgtctagtaatagtaatgtctttgttaaacataagtgaaatcagaaacttaaaaatatgtatatacatagaagaaatagactttaattgcatatctagcccctgaagcctggcatatcaataatttaacagggttttctggcattatctaaggaaaatctgtgggacacctattttctaaggttaagagatttacttttctttctttctttctttctttctttctttttttttgagacagagtctcactctgtcgcccaggctggagtgcagtggcatgatctcggctcgctgcaacctccacctcctggggttaagtgattctcctgcctcagcctcccaagtagctgggattacagattcccgccaccacgcctggctagtttttgtatttttagtagagaaggggtttactttttactcaagtcatgatcagttgtaaaaaagtcagtgaaatggagaaatcagcccagatctcttgatctccttcatcatctaaacaattcaaatccagtcattatatatcccctatactggcatcaaacaggtctttttcatgttacttgcctacttaagacccttcaatgggtggccattatctataatataaaatataatttcttgagtagtatatatggtctttcattattcaacccttgaggaagtgttcagtttcgtccagacacttccccagttgcaccacacattacaactatctgtctgtgttatatataatgcccctgaccatgacttttgcatatgttgttaccttagcttgggtaccttaccattttactctttgtattcctatgacacccttagtttttgaaaatcagctcaatattaccttcagaaaaagctatatttatctaacactgtatatgtaatttttgttctctgtataggcttttattgttttgcccttttctgtcttgtcattttgcttgcctttttctcacactgtatgcctagggcaaactttaggcctcatcttgcagacgtcttgtttagcttgaggtctgatgcacaagagttacaagatgaaaatttttgcagaaagagtgcatgaacgaatccagaaaatgtaattaactcaaaaataatttctagaaactattaagtatatcacattgagtctagaaaatggatcccaatccaaaagccagttttggttttagggacatctccagagaaggcttggaagtccttccgtcagcgtagagagaaactttcacacaaattcagaactgccttagatgttactgatggggacagtaaagttggtgttgctgagtaaaacaaaaatccttttacccaaaccattggtgttgtctggtgtgtcttttgagaaaataaataaataaataaatcatttaactgatgacttaattttgagttgtttaagtcttttaaagatacattcattatagtataaaagattgacacttcaaggtagtacttttgcaaagcactgaaccaacatagaaaactgctgacctaaataagatagttagtagaagtagaaaagatgggtaagtgtgcctgtaaaatgaagacagagttcataatgaaaggaagagaggagcattaggagatgacttattcatcttgcattttcagcacctagcacagggcttgatacttggtagatgctcaatatagttttgttgaataattgaatgactgagtgaatgaacaagccaggcagacagaaggagggagatataaagagctgctatatttgggtaagttttcagtagaagaagatcacagaatgaaaaatgttctactctgatcatgaataaaaagcagagaaatatatgaaatattaacaaaagaagaatagaataagcctagatttttttcaaaggtttatgtatgtgtaacttgccataaattcaccaattttaagtgtacattttgatagagttttattaagtttacagttgttcaatcaaaaccacaatctagttggagagcatttttatcactttgaaaagttacctcatgcccatttcagccaatcctcactcctatcacaagtcccaggcaaacatcgatctatttgttctctgcctctattgtggtgccttttatagtaatttcatataaacgtaaccataccatgtgtagccttttgtgtgtagcttctttcacttagtgtaatatttctgaggtttcatattgttgcatgttatcagtgactcctttcatttttattgttgactagtattctaacacatagatataccacattatgttttacaattcaccttttaataggcatttgaattgtttccagtgttttttatttgtgaataatgcttctgtgaatattcacatgtacgcctttgcatagacatacacttccattttatttggggttggagggaaacagatactttttaggaaactcaaaactactttccaaattgcaaaactacatctaaagtgaggtttatggaaatgttttatccccaaactaaaatagtaacaggaagttgaggataattgatcattattattattaaaagagccatattaaacctgtcttatcttaatatgtattggctaaataattaaacttaactagagtcaatacagtctcttttttctaaacttgtaaatagagatttgagagtcagagatttggttctttttccccagtcaaatgaaagcacactaaaaagaaaatacagtgcaaaagtgtaaaaaggtttatatagctataaatgtgcaaattataaaaccagaatctgttttcattgaataaatctggtaactgtcttatgagatgaaaatgtactttgtactttgcatatcctttctttaaattgcatgtaaaatatttttctattattcatgttctgtatttaaattaattttagataaaggagccacactatgatataacctagtttatattaaatttttatcatctattatgaagaaaattattactagtccatataaccaaatgctaaatgatagcagcttcacaaattacaagtagtaatttacaggaggtgcaaaaaaatgttacagcattttattgataaaaaagtttcagtttctgaaactagaggattttgtcattccatttaaagaagctttcttctcaatttaaataattataacataaagccactttttaacattcaatatacaacttgggccagaatttgcaacaagtaaagatgaaaacaatcaatgctaacctacaaaggatgcaaccattatggagaacactttggaagttcctcaaaaactaaaaatagagctaccatacaatcagcaatcccactgctaggtgtatacccaaatgaaaggaaatgagaatattaagatatctgcactctcatgtttgttgcagcactgttcacaatagccaggacttggaagcaatctaagtgtccatcaacagatgaatggttaaagaaaatgtggtacttatacaaaatggagtaccattcacccatgaaaaaaatgagattcggtcatttgcaacaacatggatagaactgaagattattatgttcagtgaaataagccaggtatagaaagaaaaacttttcatgttctcacttatttgtgggatttaaaaatcaaaacaattgaacccagggagatagacagtagaaggtcggttaccagaggctgggaagggtaatggagtagagtggaggttagttggggatggttaatgggtacagaaaataaaatgaatgaataaggcctagtattttgatagcataacaggatgactatagtcaataataatttaattgtacattttaaaataattaagagtataattggattatttgtaacacaaaggataaatgattgaggggatggataccccatttttcatgatgtgattatttcacattgcatgcctgtatcaaaatatctcatgtatatcatcaatatacacacctactatgtacccacaaaaattgaaaataaaaaattataataaaaacctgaacactgcaaaggaatactgtttggttagtagaacaaaataatttggccgggcacagtggctcacgtctgtaatcccagcactttgggaggccaaagcgggcagataatctgaggtcaggagttcgagaccagcctgggcaacacagtgagactccatctctactaaaaatgcaaaaatgagccaggcgtggtggcgggtgcctgcagtcccagctacttgggaggctgaggcagaagaatagcttgaacgtgggaggcggagattgcagtgagctgggatcatgccactgcactccagcctgggcaacagagtgagactctgtctcaaaaaaaaaaaaaaattcatgattcattatgaacactgcatatatatgggtatatatgggcatatatatgagcagaaaccattaatgtttcccaggttttgaaatctcttaatgaaatgaaagtaaaagtattgccaggccaagatatgttaaaaattttctgaataaagtggctgcttttggtttgagaatttattctcttgagtcactgccattacagagggtttatttcatttcttgtaggcagagtacacaaggtaggagacaaaagggacggaatataaaaatcagacataagaaaattttcaaaaggaagaaagaaaggaaagagaaaagaaaaaaaacttctttgtttctgctgctggaacttaaagcacacccacaatagacagaggagaggtgggtaagattggaggtgtgagctgctaggtcacacacctgggtgaacaacgaggctaggatgagcatctctctcctcagtggcagcttccatcctaatgtggataaaacctcagtaagtcagttggagtcctgctctggtgttcctcagaatgtcttgtatttgttcttttgttccgctcactttccttttcctccttgagaaatacgactaacccaaaagatatggtttttgaagcctgtatttgcactagacctcatgtttctctaacaactcaagaacaaacccctccatcctcaaaacactttgaggcaagtcaaccagtcaaaggaatgaaatcacctttgtccaaagtgaaactcacttatgtaaaaaattaataatagtggactagactatgcattatgtaaagcaaggcctttgctatttttaaagtcagcaatctagagtcaagaccaaaataaacatgactcaatgactttggcaagtaactttacagaagcaaaattgaggcttagagaggttgactgaggtaatggtttttcacagctataaacatttctgaggcttctttgacacctcacattatgttagttgtctttgctaagtgctctcacgacattcttggttactcctataccttatttataacacttacaactagggttttgaacagtccaaactccacagggactgcaaaggagatagagttttattatttcttgagggaccacctttaaacatggttttcccattcgttaacatctcaggtgaatcccttggctgcctgatcacattcaggtattgaaaaaaaaaaaaaaaaggatcagtcaaatttaaaattacagctttataagcagtgtaacattctcttctctctagcttaggtttgccgaggataatttgaatgggagtggggggtggggagcttccctgctacttaactcctgttttctcgccatttggttttgtgttgacacaggcatgaaggatcacacagagattattagttctgtttctttaattgatacctctgtagactattgataatcattgtctttccctggaaatcttcaactgggcatggacactgtgtggcaaatggttcaagtgattgagtttttggggggtatgtgtgtggatccatcaagagtctcctcatcacacagtttcctgctatggggatctgctctggatcaactttttctggccttttctcagctccttcttgatgaacccccacccacagcctctagctgcttggtttctatgctcagttgctagccttcttatagggctaacatgtatgagcatgctgatttaagccctgctactgttcaggacataggaaaggcactaatccttgttaatccaatcctgaggaaaccagtatagcaccacgcaccattctaattacacatcccatttcaattgcctgatggctgatttccacctcactattttgaacctcttatgctccgagaggtttggaacattaagtgcctaaaccaaacacacacacacctttggtaaaatgtctataatccagagcttcttacctgttgatgaagtggcttagttcttggctctaattaatgaacctctttggtaagttatatacaccttactaccttgaaccacttgaagagatctaaaggacaaaagagaaaagagttgtggtcatatccgaatttccagaacttagcttagtgcctggtacagagtagcagttcattaaatagctgtcaaattagtgagtagataaattaataaatgcccttttataatgaagaaaaatgccaggatataaatgatgttgtaaagaaaatatatgaaatacaaccgtttagttgcagtatattaatcaactattttctgttatttaatatttttaaaatatcaaatatgaaatcctatgacaactcagatgaattaggcattatttgtcccatatttatgctccttaaaaacacttatcaaaatttggggcaagttttgagtactgaagtcagtgtgacggacagactttgggacgcctcagtcaagcaatcagttcatttaaatgtctcaagtcagatatgagtagttctgtagcttgggagaaatacaaattgtctctggtgatgggctaaggaccatttctatgggtagctgcttccttagtccacgctgcattttacctgcttaattttttgagcatagattttctacaggtgggccttcaggacagccagggtttttgttgttgttgttgttgttttgttgttgtttgttcatttgtgtaagcaagataagaaggaaaatatatagtagtagcaatttaatgtttaactaatcacaaaaaattcttgttatggtaatttctaaccttactggtttattctgattttcagacataaaaataagaagtggtaaaactctatctcctgcattttaacttcacctttataagttttccttaaacatctctaaattacaatctccaccctcaaatggtctcttcattaattaaaaaacaaggtacaatgtttctttgttaacaaaacattttacaatctattcccaaatatcaatggaaacaaagacaaaagcctcctgggacttggtggctaaggtcacatgaaaaaagtcccttctccatcacttcctaactggaggcccctgggataatctttgcattgtggttttctcatcaaagcctcatcacaaagtgaggaaaataatataacttagcacacaggttaattaaatagagcaaagggctaaaccacttcatcaacaggtaaaaagctctggattattgatattttgccaaggtgctcgtgtgtttgtttggtttagtcaatcaatgttcaaaacctcttataacacaagaaacaccggtttcaattttgttatcctggttgtttttagattagaaatctgaagcataaagaatggtttgcttacagatgtatgtgctcactctgctaagtccaaacattgggatcctgaaagtacttgagggttgccccttggctctggcttcagaagcatactcctaggggtcttctgcatactgaatttccttctgaggaaagcctggaaaggtgtgccgtacttttcagttgacagcatgttacatgagctttattaaaactgaaaagttgtcatgtaagggattattgtccccattttacagataaggaaaatgaagctgaaagaggttaactgaggtgcacaaggtcacatgagtatttcatagcgaaattaggattagaactccattccgctgattttcagcggtatgttctatctgctgggtgttgttggagagcctgaaagcttatcggaacagaaagaaagttaattcagctgcagattgattaacctaaagggaaatccaatcaatgttggtagagagctgggagaagcacttttctgtctacagtgatgtttttaccgggacagcacaagatctcccatctggatcagaatcgaattccaaatatcagaacaagctaaattcttctttcctttctgtagttgcatctgtttatttacatttaagtaatactgtatatgctcctaaaatttctggctggcagcatggagtaactctcttcattatactgatttgtgtggtcatccttagcacctttctggatttgtgatcgtgcgtgatgaatcttataaatggttcaatatttccatgattcaaaatgaaagtgctaaggcaaacgcaaaagcagctttgaatttctgtaggccagttaccattcaagagcctccatctgcagcaaaacttcctccttctagtggaatacttgttcacactcaggaaatgacatttgaggtgtggccttactgacttgaactgagagcttgttttgcttaatcatcctgagggaatcaagatataggtaaaaccaggaggatgaaattttatgattattataggaatatgaaatatgtgtgttccttttattttcctgctgaataaatagtaataattgaaaaccattgatgtactgcaattttgctttgttttgctgtgatgcctttttaacattttttcttattcaatttttctttgagaagagaaagggctgaatgttcattttatattaattggaatatgtatgctagttttagcagaaatatctatatcttcctttattataatcaattttttctcattaaatctgaaaactgctccaaattactattgtatatttttaaagcactttacagtctgcatttgcacattcattatcccattttattctcacaacatcctgtgaagtagaacttaggaaagacatcgtttgccattgcaaacctatatatgagaatataactttttgctttggggaatattttgtttcgatgtgattattacatagtttgctaatgtgaaaattggaatattctctttatttctaacttcccaacttcagttggcttcccagaaatttttataatatcaaagtgtagataaatttaagagcaattagaaaatgagtaataatgggcattttatttaagagaaaaattggggcaacttccaatttttattagatgtttggaatattactattgttttcatctgaaaaaattttccgttatgttttcaggttatgcgtagtaggttcaagttctatttcactcggaaattacctatttaacagctgttgccttgctgtttttcatagtgattttagggaaatatcatcagagaaatgaaataattctgcaatctctaacctgtttctttaagatgtgcaacaagggctagaagcaaagaatctgcaatattctttataatttcatggggtcttctgaggaaatgtgccaattttatggggactcgtagggaaaaattttgatttcatgtggattcgagtgaaaaggtaaatttcatgggatttctaaaaatggctggatttctcaggatccatgaaatctatgacagccatggagaaaatgcactgctcttgtcatggagtaaatttcagtgcagtttggcaaactttatttcttatacacctgctatgacatacattatatattttgagtcatttttgaccatttactcttttataaatgtctatgaatgctaagggtggcactttgtgtacctaacaacaaatagaaaaatgtagttgttttgtgagttgcttagagcatacttgtgtgatcactaacacatacgtgactcatctggtgacttatctggagtcaaggtcaggatggtggtgctcagagttctggtgggcctaatcaggggacagagggaagcctctcactcccatgccatagtcttcaaggaatcatagaatgttaggttcaaggagaccttagacagtgttgtggttctctcaaggtattccaagatttaaacatctgcaacagagttccctgtggaacttgttaaaaatttaaactctctggcctcacctcagactagctgacacagattctcagagagtagaacttgagaacctgcctttgtaattcaactacctgagtaattctgatcctgatccacacttcagcttgagagccactgttcaaatacacttttattcccaattcaaattgtctatgatgttgtctgtcatgaattctagatctctatttaatacccctcctcacagagagcaggattgaggcctgctgagattccattagctggtcttgtggctggaactggggctgggtcataggaaaggctgttggggaagaaaagatgtctaaaccaattctggaagcttgtgcctacggaagcactgtgaatacaacagctataagagctgactgatacaggtgtgctgtattggtaataaacagtgtttccttgatgcatttctttttttctgaatggggtacaattcttgacaaagttcaaaggaaaacaaaataaaaattttatcttaaattatagggtacctgcatttatgtacaattcagtatatattaaaacagtggaaagtgctttgttttaataagtaaaacagtgttagattctaatccagatcattaaagagggttttctatacttgaatgtgcaatggaacattagaaagcaatgttaggcacaggaataatctcttctttactctggactgcagtaactgcaagatctccagcattcctggacccctgtatcctgaatgctcataatgctttcttattgtgacagcaaaaatttttcaacatgcttcctggtgtagtatttattgccccttagagaaccatttcactgattttcttagtcacatcatattcagacctttctaaaatggaagtatgcacatatgattcctctgcataaagtctttccatgtttccccatttctttcagggtgaagttcaacaacatagtactcaaggatcacatttttggtaaggcctcttgggcagtttgattatgttgtgtctctcctgtactcttgtagcagtaacctatgcatatactatactgtaatgattggtttattcaatctctgaaagtaagaactttgatatttttctataaagtgtttatagttctcagcctggtctacaaaatcttcaagatatactcgcacatatgtttctagccttattgctcagggttttccactgacactcatcatttcagctacatctaaaacctggcttacaatttcaaaaactcaccttctctaccgtttctactcctgggcgtacctgaaaaaccattccctcctctcatcacctatataaatcctgctcattctgtaagactcagttcagttgttatcaacttcattgagattctatcagggaacaggtatagtgcctggtgctgaggttggcctttgtttatatggagcaagtaatccagttataaatcttccctctcccctgaggttggattaagagctcttcctcttgccaatctctagcacagcacttatctcacaatattgcattatggactgtaagcttcttgaagaaagacaatgaaccatctttatgtttgtgtgatcagcacctggcatagtgcttgactcatagtaggcacatgaacggtgggttggaaacctggggagctcaccaattatcaagacagccaatacaatatttattacaaagttctggagtggcagtcttggtggtacttctttcatattttgaattctgattattatgtacaatattttgaaataagtcctcatgcagttttctggagatttttccgtatcttaatttctcagagttttcctatagttaacagccccagagctctgacttggcagtcctgatcccaactgattcctgggaaggagacgccaggggaggggaggttaaggtttgtccaaatcaccttgtgttaatcttgggtgcaagtgatgggggccagctgtgggtacccctccaccgcttgccaaattaaacagcagaaagagaatgtcatttcttcgaactctatttcctagttgactaaaattctaaaaggaaaacagaatggcaggcctggatcctttgctatgtatattttcttaatctgtcatggaatactggttttccagctgtacaatatctgattttgtttttctgtacataaataggcttttgataaatataaaataaatgtataaattctgaaaaaatcatcttcagatatacaatttttatttctaaatcacaagactacttttacaagcagaggctcttttctaaatgagacaaactgaacaatggaatgtcttatattttattgttctgcttagttgaatgaaataaaaaaatctcgatttttttttagcatagtaaatgtcattgggaaaaattatatagagctttccattctaaatatagaggtaactttccagaaaacaaaaaccaccttttgtgaagaaatgtacctaatgtacattttaaaatactatctaagttcaggcacagtggctcacacctataatcccagcactttgtgaggccaaggcaggtggatcagctgaggtcgggagttcaagaccagcctgaccaacatggagaaaccccatctctactaaaaatacaaaattagccaggcgtggtggtgcatgcctgtaatcccagctacccgggaggctgaggcaggagaattgcttgaacctgggaggcggaggttgcagtgagccgagatcgccccattgcactccagcctagacaacaagagtgaaactccatctcaaaaaacaaacaaaaaacaataaaatactatctaaaacagttgttatttaaaatataaaagcataataaagctaaacaaactgcaagctgtaagatgtttggaaaatgatttgaaaataatcttatcaacttcccttccagtaaacctttttacttttgttcctgaattataaaatcagaaatttgaaaagtatgttactcttatagtataaagcaaaaaaggaaaatactgacataggagtatcataggtatggggcaaaaatagcttcaaaaaaaaaaaatcatttagcctaggtatgttgctcatcctcattgcccgctggcctagaccataactcaaaggccagaggaattgccagctggccctggctttactgtcttctagctgtgtttttacttggtaaagaacctttagctctctgggccccaatttcatcatctgctaaaagagggaattttttttaacaggcatgttgttatgtaaaaatgagaaactatattgtctgtaaaaaatatctgaatgagctataagatagtatacaacagtaaaatattgtaagtattgttcatatctcattctttcccaatgtaacttctaatcctttgttttttaggaagataaaaattgcacagatacatttgttatatagaaatacactaagctttttagaaatctttcagaatgcattactattcatcctgctagattcagtcttaggacacctccacgatgtcattaacacttttgggtgcttatagagtaagtgattgtcacaaatcaaacctttacatttcaagagataagcaatgtgagtaaataaaatttcaaaatagagaatttaaaatgaatttccttaaaattagagcctaaagttattttggtgcctttagacatattttaaatgaaataaattcaataaaagccatatggtttattaatatttagctctatttccctttacaaaggaccatagtatgattttaagaaaatatttatttcatgcagcttcagagttgttgttgttctccttccttgtataattgcatccatcttattttttcctcttagaatcagagtttctatttttgctagcttgtggtgcagattttactactaaacactgggaatatcaaactgggcaatcaaataagctttcaaggctcccactcccttgagacatgagcaggacgcagggctaaatttggggttccaattcctacccctcaaacagtggcaggctgaagccacacttagccttcatacaagattcatgataatcctgggactggcttggctctgacactgtattagatatgtgaagatccaagctgctctctacataactcagggcagaatagggattgctttgtaggcaccctggctgttttaaagttttcttttaaccaagtgactttgaaatttctcagtattttttttgtgtgtgagtgaaaagagagtcagacagaggagagctgacgttccccaggggcaaatcgtgttttcggttcctctttataccaaagtttttcttgcattttatcttatgtctcctcctacaagctaaagatttgagcagttcttttcttaccaaatttaagggatgaacgctgcaaggacatgtaccgaccattggatcttaaatgctttactcaaagtacagaaggtaaatgcagaagttttcattaatccctaaccacattatttgacacctaggtcttttttattagacacttatggagaagcatttgtaatctttacttcaaaaacaaatgataagatgtcactttaacagttgcagcctttatcaagagttagctgattgtattttatgtttttgtttttgtttttattatgggagaagaaggcaataaagaaggaaacagactttcatagctcaagaccatttggtctttaccgcataacttaattggatcctcacaaaagtcctagggagcagatattataaatgcaattttagatgggcagaaacaggatcaggaaggttaggtgatatattcaaatcacacagctaacacatagtagatccaaaactcaaaatcaattttgtctgattctaaagttcatgctttttccactggctactaatgcctcatagaaaggaaagagattgaggtacctgacctagccagagaacagtgagatttatgttccagttccctggtttctgaacaattcttccatgaaatgatgataacaccaccatattatattccagggttgccaaatacatgggaccaatacaaaacagcatctcctcctcctgcctgctcaggtccttctgaaacctctgcgaacacttcctctcgggagagttctaccacgctttgctctgttttagcattttcttattgagacacctgcctcctcacctcatttgtcccatagtgttataaaacagaggcaaacaaatgtttttagagaaaaagcaagggaataataataagttagttaggacctaccttcttttggattaaaaatgatgcacgaggtatttttgtgatacgagtccattgcaacttctagtgaaacaaaccttcccgtgaagtagatcagagataacaagaatcacattctacacatgcctaaactctaattcttttttctatgcctggcttgaatcaggtaaattttaatcctttatttgtgactgaaaacaaacttggctactgtctgggtggaagcaaaggtaaggacccctgtaggtgagagatgtagttggatattgatttggtcagatatactttaccttatttcacaatagaggactgtatttggggctcctgaaagggtctaaaaaaatggagtaaaaacatactaacccccaatttttcactgtaaactgtttatcagaatctttagtaagtttcccttgcctttttatctgatttttaaaatctgagtgcacagaatcaatttttcataaaacttgcaagttttgaggcttttgctgcatgtcaggcaccgttctaggtattgagagcaacagcagaaaacagatagattttggtttaagtagctcatattcgtgtgtgtgtgtgtgcgtgcatgcacacacacgtggtgagggagtgtttatgtatgtgtggcaggagggacacagataacaaacagatacatataaaatatataaggtggcaaaaataaatccccatgataatgagtgccataaaaaaataaacccagaaggagctagaaattggctggggttggggtgggtagtttctcttttatattgaatagtaaaagaaggaacctctgataggttattctttgagaagaaacatgtttctgacatttttcagaaacagcaaggaggtcagtgtgacttgaaaagagaaattaggtgactggtagggcaagcaacaaaaggttagactgtacaggaccttttaggccatagcaaagacattgtattctactttgaatgaaatgagaagcattagtgggttttgagcgaaggctcactccagctgctgtgttcagaaagaatagaggagcaagctggaacttagttatctttattaactgcctctggacacacttagagggttgtagaggggattgagtggtataatacatacaaagagttattgcatgagttaatacatcctaaattcctagaacatgaaaatgctcagtgtcttcgtttgggagccagcataattaagtgttttagagatggtcctgggcatgtccctgtctagattcaatccttgctccatttcctacttgtttgattttctaaaagttacctaactccttcattccttgaatttctcatttgtaaatgtgaataatatagtgtctccctcacaggatcattgtgaggattaaaattagtctatgcctatgaaatatctatggcatcactgtgcacatagtaaatattcaataaatgttatcaatgtcactatatagcttttacattttacaaggtggtttcaggttttccatctcaaaagctccttatgaagtaaatcacataaatacttctatttttgttttgtagaaaaagggattgaggttcagagaagtgaaatgacttgctcaagatcacttagccagaaagcagtggagtggaatcgagcccagatcttccaagtattcttttcattatattcggctgcatttgaatgtttacgtatgtgttagaagaactccaggtcaagcctctgagctccaaattgatgattctttttcttttatcataggtctaactaaaatatttgtataatgaatgaatgtatgcattaataaaagaaagaaatgaaacgagaaaggggaatcctttataaagaggacaagtttaggttgctagaacgtgcagcgtggatttaggagactggataccaatcagttgttgacacattgtataattctgagaaaattgcctaacatcttgagtctttggtttcttcatctgctaaatgaaatctcagtatattctcatatctgctggctagatttgtgaaaatatatgccaagataaagatggaaacacttaggaaaaaatgctccatataccacatgtgttgctactattaaacttctctaagaaaattcagatctagacacctctaaaataccttctggggttggttagtaagcatttgctcaaaaacttgaatttttgcactttttttggtgggggagggagagtatggattaaaaacttttttctagtggcttaaattcatggtaattttcctaactaccttagaaaaagttgtccagtctcaccttctccttgattttcatggtaaaagtgatcacctggtgacttagtcctttcaggatgctataacaagataccatagactgggtagcttataaacaacagagatacatttttcacagttctggaggtggggaagtccaagctggagctgctagcagatttggtgtctggtgaggactctcttctggcttcatagacagcaccttcctatgtcctcaggtggtagaaagggaaagagtttccctgggatctcctatagagtcagtaatcccattcatgaggactctgctctcatgacctgaacatcttccaaaggccccacatccaagtatcttcacattggaactgtttccacatatgaatgtaggggcatacaaatattgagaccttagcaccagcaggctctctttcccaaccatccgcagccacccttattgggaacagttaacacaactttattgattttgataaacatttattgaatatctattatgtaccaatcattctactagggaaggccaaaatgataagacatcatttctgaccttatggagttcagaattgaataggaaatgcagtctcacaaaccatacagagataacatgtgatataaactctaatggagacctacaaaatgctttgggcatgtagtctaaaatatgcttagccatgactggtgttggatggagaggattggatggagaaggtgcaccaaaaatgatgttcaaactaaatattaaagtagagactggggcctaaatgagtgctggggacttcgaagaagcagagtctgtgagtttgttccttttatttttaaaaaaatttaattaatttatttattttgccacagagagaagttttttagcaggttgggatatagttgttactacaggaggaggttctttgggaggtattttaaaacatttacaggttcaaggaaaaatgaggttaacattttagaagaaaattagcaaagcaatgtcttgtggatgcaggagggctgaattttagtttgaggggagaaagactttttgttgtgatactaccaacctatggatgcaccagtgtgacacaagcacccagtgtggtaaggctattttctgaatttctatacctttaatttttggggacagcataatgtaggggaatacatcttcatagagaataataagtgttggtttgaccctgaaggatgagacatttgaatgtcaaaatattttataacattagtaggcaaaattatggtaaaactgtggcttgtgtgggttgcttttaaaatttctgctctaccctgagcgaacaagacctagtcaggtgattgaagaaaggtcacaggctttatgggactgagcagtttagataagcagtcagtattatctgatatttatcaagactgaacctgaactccaaacctggagctttgcccaccggcacatcctatctggcttatgctttttcctataggcaactaagtcaggatcagatgggtggcagataccaggccatatgcatatttataatattgcaaacttgccatcaagctgactaagccaaattaagcatataagaaatgaaaagtttagatggaagctgatgtttttaggattccaggatgtggctctgccagatcagtgtgttaacttaatgaacgagagcagctcgcatttcaggaaggaaaggagccatgtcgtcctgatgaatcaatccctgtaagtaggttctgtgccttatagagtatcccctctcccacctccgacccactaccctccccaccgagtccccctcattcccacctctcacagccataaacaaaacaaaaagcaaatgaaaacaaacaaacaaaaccctcatctgactcattgtaaaaatacactcaggatttggatattgcccatctgatatcagtagccttttctcagaccatagtaattacactctgcaaatacattgcttctgaattccctttaatgcagtcttttgtttctttctgctcatgttctcttttgcttttgagccatttcctgtctctcctttctcaatagtcatcagagttttagatacctcaataattctctcttctaatctcttcctttctaatgaaaaaaacctctttttctatgtttttttcagttataaacattgataacatttatcattttgttgtcatttctgtacctttcaactctttgatatttttcccataataagatgcttgaaactttacagtatttcaatggcctatcatactgtgattagtgtcctttgctaatttttgtcattcccctagttttatgtaaccttgtgttttgaatgttgtagatgacacgaaagcaatggttttgaatttgtgcttcctttgggctcttgatctctctgttggtccatatatgcttaacagtttgtgagcattttaggtttactctctgttgctattaaatatatttacttctctatctatattaccatgttggtaggttggaatcatacctaaagcaccccatattctcatttttagaacgtttgatcagtcacttgtcccaggttaagtgaaaagcgtatgccatatatattccatttgttgctttcttgcatagccatctctctaagagctcaggcagaaaataaaagaattcccttgtcaaagtatgaggggaaaggggaaatgtcaaagctcttccaaaaaatatatggttggagcccattatatcaagagttttcaaagggaaatgctgtctcttttaatctgtccccctttacccagtaagcttagagctcctgtctattcttgtttcttccaccctcaatttattaacactgaagtcaacaccaagctggataactagatgggggaaaatctctaactatgccagattaccatctaccgtctattacctctggcataggtaggggtctctgatttattttattcccatgtcccactaaacttactgcatactgagagactttggcttggcaaaagactaagaaatcgtcctggcctgttctagaccccccatattttcattgctggtatacagcagttaagtctccaaacagatttacttcctgttaaaagtattaataatgttgtacttccctttctgtctgggaaaggaagctttatgtgggcctttccacttgcacatttggtaaaaccaagctccttgggagacagtaacattttgcctttgtctcatttgagtgagacagggaaggaaagaggcccaacaaaggaatattctgggaagaaagtctattccctaatagttccagtttatatatagaaccccaagaacctcatgaattttaaaaggaatttaatttggaagtatgtacatattttatcttccaaagatatggcggtgtctttatgcaaaaacccaaataaaaggatacttttagggcagtaactgtagtgatttactcaaattgtatcttttccattgcagaggaagccttccaacagaaagggtctaactggctaaaggaagactctgggggaggcagcaatctgtccatttagcttgggggacaggggagggttggtagtgtgaacttgcaaggtagagaaagattgaagtagttgagcgacattttccactactgcacagagaaattttgagaagcccattgtagtgggaagaggagatacttcctaacttatttagacccataggagaagtggagacagaagaggaggcgacatgtactgcactgcagtttgtcaagaataccaagatactgcatctggagaagggttccctaatagcagggtcctcactgtggtccactctgtgcccacgtgtgctgagagggaggaagaggtggtggctaaggtagcagcaggtgcatctgtgaaagtgaacctcgaaggagcttcattcttgtttttacccattagttttccctttactggtgctcggataagcattattacttatatagttaggaagagaaacttaatcttatacatgtcaatttaataaacacttatttggccactctttttgtcgaaactttgttagatgctggaaatacagaggagcagcacacagttcctgcctttaagttgtgttttggaatgttttgctgatgtgaggagataattttttttttcatgaggtgatgtgtaagccctcacacaaatggtctctcactaattaaaatgacaggtttatacaagatgctggtgaggtactatgtgttctatcttctgtccaaacatcacagatggtgactgtgtgtaatagaatatattcaacctggtcaaaccctaagaaaaacttgacaccacaaggcatgtatactctgtttcctgaactggttgtctccttaaggaatgtatagctgcataccactgtcataacaagaataaaggataaggctgtttaacttaggtctttcaaatgacttatttgtacccggaaagcattcaagttcaaaggatatagagacaaaacaattagaattacggcagcatgaacagagacagtgtcaaatttgtgacagcaattgatagaaatataacagtggtacagctaaggtgaaaatcttgctttaaatcatactgaaatgtctgtgattcttccaactgctgttccccatttctaccacaatgaagcacttttttttcagttcttcttttccatgaagagaaaagaacagacccaaggacatagaaccctgtatcggagccaaggttagagctgagatatttttggctcctaattctctgctgagtccattagactatgtctcctcttctttctattatttgattttctgttctctgagtgtttacatacccagagtgataaaatacatttttgttcttatgttactaatgcagtagaggtattttttcaattttgccgaactgcaacacactaaacatggcaaataactgctttcaacaaaatgttttcaaggcatgccttgaaatgggagttaaaaataggaatgcaaatgctaataacggtattgataaaagaaactctggcttcaaaaatgagaaattcaattagaaaaaatgaaggtgacagtatttgaggaaaatactccacaatgtctgagagtactaatggaaaccttaattccatggcattatcacaaattagatagagtttttctcaatgtagttacttgcaggtcagctaagataatagtgggagtgtttctgggctggccatcctccttactgttgaccctgaaggtgatatgccaaaatttagattactttgatatctgtaaataatgaaaagagaactactaagtcaatgacccactggacccagcctaagtagcttcttaatgttcagacacacatgccaatcataaacttcatttatctgcctctcaaagaagttaatgcttcactgaccatgtattttaagatcatataatttacaaatgcttacagacttagacaaaaacatcattatgtgaaaatactttacattttatatgatcttacccaaaggagctcaagaaacttatcagactgcccgtcattaattttcacagcatctctgtgagggagggagcaaaaagcattctgttcattgttactgtcaatattcttagctgatgttctcttaagatactttataaaactaagaaagccgttgtgtctgtccacaggatgcttacaacccaagaaatcctgataaggtccacctcacagatgtcaaaaccatttttagccatgaaaaatcagatgctcttcagagcgaaagattctatctctcatctgcctccttaacacattccagttaataactagaatcgtaatatttcatgttttgatataaagctattcactctggatcttttatcaatggacatggagatcagtccatcactatattttgtaaaagagacctgaatttttatctctaaagactgagtgagcaggaaatgtgcgtatcagatagttttgtagagtctgaacaatttcccagagttggaatggggatgtcaaagtaaaaagtagccttttgaatacatacgaaaatttggtattatatactacatatgaataatacatatgtagatagttgattgaggactagcttttaagccaggcttttcaaaagtatctattatgtaacactagctgtgtaagatattcttgaaaaaaaggtcaataaatatggtcaactcttcactattatttgtttttagatattaatcatatttaatagtatattaaaggctctgataagcattgaagtaaagaaacatgcttaactttgtaaaaactgcccaaacttattttaacgctaaatcctttttcagggaacacccgtaagaaacaaacattgggaaaataactttaactcacttcatctgggtatttaacatggttcggtacattccctcttcactaagagagatcagtaagccatggtactttaactcaacaagatcacaatctagaagagcttttgtatatggtgtttataacattaagaagtttacaaggctgaataaaattgggaatgctaatttccaaatgaccaagatagacaaaaatgtgccttaggagttaggagaaaaatgtagtatagggagtagagtaggagtttatagaaggttgagtactcagtgtttgcagaaagattcaaagcagtcagggtatgtgaggtgcaggtggggtgaagtgggaaaggggaggcagagcatggtattccattttaaaagcacgagcgaagaatgtttgatgaactgtatgaagggttagtaatgatgggttaatgaatatagactttattcctcaatcttctaacttaaatgtattagtagatcttcaaactttacctcatacactcccttgtggctgttgccaccacaattgctgaagtttctgcctctgctcatgtcttatcagattcctcaggtttctttctaggctcatccactagattttcaagggtggggcaggagtacaattgcatattatacctacatacatgaaataacaaactaggaaaacaaattgttaaatataatatgttgcattctccaacattgacaaatatgtcctcatagtaacctgcaagtccaggttcaaatttagaattctaatggtaagtaggattctaaaaataacccctgttgttggctgaatagtgttgttacagtctctagttaagcacttttgtaacctcaaacacagcaagagttctcagctgattttaagttaagaaattttattgtaacaaaaaaattaagattttttcctttcaatcagagggataatatgctaaaaatggaatttaattcttttaaatttgaagatattaataagttggatttgaggtgcaggagattgaaggaagaattacctgataggaatgcattgcagtaatctgaacacaaggtgaggagtactcaaatattggtattatcagtggaaatgtgtttttaagataccaataaaaatactttcatacagttgagtttgaaattgcaatatcatttctaaatagagatattttgtatgcagttaatggtatgaaacaaggattcaagaaaagatccacatagaaacaaagaggtgcttagccataattagtattatgggatacctgaaattgtaagaaaataagatttttttcagggggggatgcagaggaatgagaataaaacctcagaggattatgacagatcaggcacagaacaaagaaaatctagagacaaagaaagccagagaaagaaaagtgcacagaatgaaaagcttttccagaaggtccctgctgagatagaaaggaagggtgaggctctaactacaatcaggtgtatatgaacatggaacatcctctcttttattccacaatctgcttctctcttgcatttttcatcttggaaccaacttcttgttatctctctggtgttctgatgtgggttaataaccttgtttggttttcttggtctctgagctggttcctgtttgctgaattttctcccatataggcagattagactcgctgtttctgatcttctctttactgtcagcttgactccattagagcagattgaattagacggtttgagaccctggccatgctgggcgaccttcaaggttaaatgaaacaacaaggagaataaagattaggaaaaggagtagagattaggtggctatcagtggccttgaagagaccatctcttgtcagaaaagttaaaagaatattaattgatgaatcaataatctaaccttagtctcatcactttgtattattgatttttctagggagtttgaagagtgcctaatatgagaatttatttggtactcattatttggaggaagaaggtagcaccagagttcagagagttttgttatcacattttctatttgtcagaatgtcagaaataaacccgatttcattcatcaggacaggaaataaacagcacattaacacttggctgaagatgctgcataaactatgaggattcctctagtcaggatctcaagcatatgcaatgcacagtcatccatcccacacatatttactgagttcttagtctatgctggggactattctatgtgcagagatttgagtggtaacaagaatataaaattcttgctgtcaagaaatgtatgctttagggatgtgaagtagacaaaattaaatataaacacaaataaaatgcttgtaaatgcaaaaatcacctatattgtaattttttttttttagatggagtctctgtcacccaggctggagggcaggtgcaatcttggctcactgcaacctctgcctccaaggttcaagcaatcctccctctcagcctcctaagtaactgggattacaggcacccaacaccatgcctggcaagtttttgtatttttaatagagatggggttataccatgttggccaggctggtcttgaactcctgacctcaggtgatctgccctccttggccttccaaagtgctgggattacaggcgtgagccactgtgccccgctctatattgtaatttcaatgcaatttgctttctcatgtgttctccaaatttattctaataataacattttctaatcttcactacaccaaaattttttcatgaattttgaacctaggctgataactggatctttcttagatattgtttatttacttcctaatgactactgtatatctttaatctccattatagtctttgatttttccagtaaccaaatcagagacctggaatcactataaagttctttcttggcaagaaaatctgctagtctctataccttgtcattttacctctttgatacatttagaacccttcttgtctacgccaattccatggctacttaactaaatagtatttattgctttgggtgatttaaatagtctactaacaggtctctgcctcataatttgagtaagcctctccaatttatccgttacccagaatgaccttaaaacacaaatatgatcatgtcatgtcttcatttaatatctttcaaagacttctcattagtcaagaataagtcataaacaccctagctttgttatcacagctttttgtgacctgccctctgttctactcaacagcctcaattctaccattttttctcccatcacctctgatccagctatgctagtgaccctaagaatttagaaagggcacagactttggggatccttcagactcagcttcaagtcaggctctgacatgtcataactataatggattactgaaaccttacctggtcttcattttgtcttcttactttgttagattgttaggaggttcaatgtgtgtttatttaatagttatgtaccttgtgcattaggtgtctacacaaagtaaatgctataaactatagctataattgtaattactcaccctctgcctagaatactctttctctaatgtttacctaggtgttcataaatcaggctttaattctttcttcaaactttaacatagacataatcttctctgagatactttccttaagtttacaaggattaagttctgcagattgttagaactgggttccatcttagttctgctgtattctattggtataactattgacaagtaacacttttgcagatcctcagttttctcatttgttcaacgaggataaaaaaattcctatcttgtgagtttcttattcaactattcttttaaaggacaaataagtctaccccttctttctcaacacataaatattctcttatttctactttttctctccatgttattggtgttcttaatatttccaatattaatggaaaggcactgatcttattttcccaaattataggtttattatgaagccctttaatctttctttgaaaggccttgccatgagactgaatcatttgattttttttctacagtccttttagaaacaggaaggcctttatttataagtttgataaaatccaggcatgagcaaatgtaaacttatttatttacatgtatcagatatgaatgcatgatgtcacataacacttgcaccactagagcccaccacctgtggaaatgtccctgtacagcagacagaatcaattaatgcagaagatttggtttgtattgggtattggcaagtggagtacaagtcctatttggggtaaaaaacatgttctcttgaaaaaaagataaattattttgtggggtaaaagagtttctttaagggcaaactggccagtactggaaaagacacatggccatgagcataataaattttaaataggtacctttacaaaattactacatggttatttctgtaaacatgcacaaaatattcattcatgattaccttttaaatactaatgtaataaggtaaaattctcaatttgtggtatttatacatttcatttttgtttttattatcctcttcaatattgcaaatataccccattgcaaagctatcctcacgaaactccaaaatctctgtacaaccatgttatttaaataatactatttgaatgatcatatcagaagatgaacagaattgatagcaatgtcttccaagacttgtaataataggataggagtgcttacatttcctggtgtagacattttttataacacttaacaaatggtcactaaatgaaatctacagtaggcaacccacagtctcatttccatctgtctctctctaaacataattgccttcaatcagctcttgctctatgggttttttaaattgtgtagaagtgcttccttgatgaatacaatatggaatatctcagctttatccccagagattgaggcatatctgtaaaaaccttgaaagtttgtaggtgttatactagcaactgattgctggaaagttactatttaccgtatagccttataaaaggtttagctttctctcaaaatctttgcaagctatttggaccatgctgaatgatttcttgaatgagttgactcatcttttgctgttcacacacatattcctgaaaggatgaatcaccaagaagagtgaaccttgagcacagactgaagcttggccaaagtaaataccaagccaaataaatcagcattttcttcagctgggtcacccgtgggcaaaggtagaatgggctacacatgcacagacctcaaagtttcaccgaacagagagtagagggaagttccagggatggggagatcctgacacagccaatcaaatcattctggattggaaaggctcagagaagctaggagacagaaaatgccataaaaatgtatcaagttaatttcacgcttttccaccttcaactttagcacaaattaaatttaatgctcctcagcctgagtggtctgcatgcaaaatggtaccacgtggttgaggctgatggagataaaaagagtttagtgttatttacaaaatagtatgaaaatatttgttttgtgatcatgagttgctttacagtaattaaaatatcccctcctcttcttcttaaaggtactgaaactcttgtagcttacacacgttaaaattaaactgtttactgttccgcaatattagataccaagttaaggtgtttcaatttccacaaaaaatgagtggtttcattcattagatgatctctaaaacatcttcttgtactaatgatttagaatctaaatagggcctatctttgtctcaacataaatgttagaataaaactccacaggacaaaaagacatgatgtgtgtatgatccatatgtccaggaaacaaacacgtttctaatattcagtagaattgctgataccagctttctaaccaagatgaaacaaatccaggctaaccctgctgacacacgacaaccctaagcggtagctaaggattagggactttgacctgtaaatatttgtgagaaaataatacaaaatttattctgcctttcttctcttattttcttggtctggaatataatatcaacctaccaggaaccctgaagaatttttgggcttacagaaaagtctgccttcttccagatctgttccttcaggaataacgagatgttacaaacccacaggaactgggtatttgttgtaagagctagggagaggatctagggacaaggaagaaaacagaaaaagtagtcaaaagttatgtttcgggtcatttttcaccacaattaacatattcttcctgctccttatcagtcctaggacatttttcctctgttttattttatagtatggttacctttcagggcctagagttggaagtttctgctcaataactcttgagagaagcttttcccagcaactcctgtgtaacccactggtcttgtgagtgaacgtgaaagtgagaaagttgtgtttttgctggttctcattgggttggacctactttgctataatgtttctttttgatggggcaaaagaggtggtaaaagtcttttaaacttttaatttttttttcaaaaggtaaaagaaatgtaaaggctttggagatgtgaatggggacattgggttgccatggtcatcctttttcttttcattacaataacactcataagagagtatagtgcagtctgcctactcaccaaagaaggcagaaaaagaataaaagtatgttttatgcaagctaaactaaaactttcccaaatgatgcctaaatatgccttgataatttttgttcaccactgcatttctataaagtataacatgaatctaaaagatttcaattttccagtgcgaattatagtgaacacatatgttcttttcttgggcaatcttatggaaatttttttcttctaattcaagcaatatgtccttgagaaatattacttcatttttttcctgaatatcatttttttttttcttaagcctccccctaaaatcctgcagtgaagttaaatgcccatgcttttctctactggaacccatccaccctctctctgctcaatgcttcagtctctggtagttttcttttctttctcttttccttccctatcctcacctccatctcctggattggtaatccccttacccacctttttaaaagttgctcagatacctctgtgagactttgtctatctgccccagaagtgttagttgctcccaaaagtaccatggaaaccttccagtagcacttacctaattgcactgcagttatctgctcacgtctccttctcccactggactgtgatattcttaagggcatgactatgcctttgtcaactttgtatccctagtattcaacctagtacacggacactcaataactgtttgataaatgaatgaatcaagagcgggataaaagagaggcaagcagagcacagcgtaaaagaattagagcaagcatataaagggcagcataaaaggctgctgactgtcccacttccctctccacatctcctgggagagatggcggcagtatcaatgtggacaacgtgaggtaactttgaagtggaagctggacctggtcaacaggatgcagtaaaggaagtgaaattattgatctggtagactctggctaaggggtagtggttgtcatgtacttgtgtgctaaaggactggtgatttttaaagcacataagcatgcttgtaacttgtagataagtaataatctgcaacaagtgttaatactaatgatgagttacaatttatgaactaccccctatgtagcaggcgccttcaaggctaggcactattctgtgttatcagcagtcatctcaaggaccctgtatcaattttaaattttaaatataaaggggaaaaacgaagaaattttaaatatttcagactaggtcacacaactgttaagttttgaaacaaactgaactgcctccatcaaccgaggtcaaaatccactcttgccagagattcataccaggaaaatgtcctggaaaccagtaaaactagcacctgaacaggggtggatttccactgacatgtgaccaaaatcagttcttagttgattcttttttttttttttttttttttttttttgagacggagtctcgctctgtcgcccagcctggagtgcagtggcgcaatctcggctcactgcaagctccgcctcccgggttcacaccgttctcctgcctcagccttccaagtagctgggactacaggcgcccaccaccacgcccggctaattttttgtatttttagtagagatggggtttcaccgcgttagccaggatgacgtcgatctcccgacctcgtgatccgcccgcctcggcctctcaaagtgctgggattacatgcatgagccaccacgcccggcagttcttagctgattctaagagtcaccggagtcctttgatttgctgctttttgccagaaggacttcagaaagttctcaattattttgtaacagtgctctgttggaactttggccaagggctacattttgtcagaattaacaagcttatagtatgtcaggatctttagcctgtgggagtgttaatacaccattccttctgagtttccttcagagccttagggacataaaacaccttgagcctcacattttctttttcttaaccaaagtccataagaaagcctcatgtctgttcctctcatgtgcgctcattctagtactattaatactattaatatcatgcagtttttcccagactcgctttcccacttctttactcccttccaaatcttttctttccttcctctgggacctctgtatcatgataaacaaagcttcacacccttagtttcttcacagaaagctcctttcaccttcttactgagctgaggcctgaatctggcttaagaacatgtacccttctgttgtccccttccatgatggcagttgtttattttctcagtcctgaagagctacaggtgagggcgtccctctctcagaagttcctatctctacaactgagctgtcttcagcctttgtttacaaatctgtgcttccacaattctatactcaacatttttttcaaaaaataaaaataatggccacatttttcttttttgagacttctttttctctctcaccacctgtgtctcctcatcattgatctggatgtagtctgtttttcttacttacttttaaaaatagttatttatttatttatttttttggtttgcaatttgtttatagcttcttgcatgtaaaacatttaagacaaaaatttccctcaaacatttacttgtattgtgttgcaaagttttaatatgaagtaattttattagtgttcagttcaaaattcttatttcagtatgatatcttctttcttaatgagttttgagcaatgcttttttaaaaaaaaactttaaagtatatgatttaaaatagatcttttgtttttgttttgtagtaatttcatcgtggccagagtacataatctggatgatatctattctttgaaattagtagagaattacctactatttgcccctcacccattttaaagatggttcatgtgtgcctgagaagaatgggaattttctgtttgtcagatccaaggacctatgtatttcctctaaatgaagctagtattctcaccactttcttattgtcataatttttttttggtctcctttacctaagaataatataaaaagatgtgttgaaacaatgctggggtatctatttctctctgtagctctagtgtggctttttttttttttttataattttaagctattttacaagttgctacaagttttgaatacataggtcttctatattgaaactttatcattaagtcatgatccccactccctttttatctctatgagttctttggcataaaattaaacagataccctagctttgttttgattaatagttgctcagtatatctctgcatctttttacttttagccttttaacagcttgtattttaggtttgccactttgaaaacagcataagactggatttattccctgagctgagaattctcttctctgaaaggaagtcagttcatttattcatttttgattgctgatatttaaacttgtttctaccatcttactttgtggtttctaattctcacttttctgtgattttttttccccttgccttttttcaattgttttttccttcattctatttttctcttctacttctttggaggaagaaaatctatttttaaatttatttgtatgcctttaatggtcatttctgatattttaacattcatgattaacaaaggttaatcaatcttaacctactcctgaggaatattaggactttagaacaattttcaatcatctcttgacatgctgttgcaatccagtattctttctccttttctaaaacctcataagtaaaatagtttaaatttttgtaatgtgaaattatctcctaactgatcactctgcttccattccagtatttctaaggtatattctcagcagagcaaccaaataatcctttgtcttaacacataaaaacaaactttacttttattaaaatttataatatgcatacaaaaaagacacagatcttaatgtgtgcagcttgatgaattttccaaaaatgaatacattcatacaactaccagctcaagaactggaagcttaccagcatcccacagcatcttttatgtcccctccctaacgtgagatccttcctcctctgctatgatgaccactcttttctgacctctaacaccatacattagtttgcctatttttaacttcatgtaaattacattacccaatgaatattattttgtgtttagcttctttcagtcaacataacacttatggaaaccatgcatgttgtttcatgtggcagtagttggttcatttgtgttgcttcacagaatttcactgtatgaaagtgccaaaatgtatcatttttctattgatggatattgggcttgtttctagctttttgttgttttaaataatgctgccatgcacattcttgtacatatcttttgaagcacctaagtatgcaaatccgtgttatatccctagaagtagaattgttactaatacataatagggcatatttacagtcactttgacaaaaggctaagtggttttccaaagtggttgtaactatttgcctttcataatgatgatgaacatcagtgcatgagtacctgttgcttcatagcctcagcaatactttcttttcaacttttaatcttgagttaattttagacttacacaagagttgcaaaagcatggcagagaatttctatattcaacacccagattaccctttagttaacatcttacataatcatagtatacatcaaaactaagaaagaaacattgatacaatactataaactgaaataaagattttattctaatttcactgtgctgcttttgttccagaatccaatccaggatctgatttggcactttgctgtcatgtttccttagtctcttctattttgtgacattgtcattcataacctaactgtatttaaaaggcactggtaggagtttgtgcagcatgttcttacttgtgtttgtctgttttcttttttttttattttactttaagttctgggatacatgtgctgaacgtgcaggtttgttacataggtatacatgtggcatagtgatttgctgtacctatgaacccgtcgtctaggttttaagcctcacatgcattaggtatttgtcctaatgctctctgtccccttccccaccaccctctgaaaagccctggtgtgtgatgttcccctccctatgtccatgtgttctcattgttcaactgccacttatgagtgagaacattgttcagctgccacttatgagtttggtgttctgttcctgtgttaatttgctgaggatgatggtttccagcttcatccatgtccctgcaaaggatataaactcattctttttatggctgcatagtattccatggtgtatatgtgccacattttctttatccagtctatcattgatgggcatttaggttgtttccaaggtctgatatgttttcatagttagatcaaggttgtgcattttggggaagaatgccacaggagcttcatgccttctcagggtgtcaaataagtgagtaaatgatgttatatggatatgtatgatgataactttgatcagttggctaaagtggtatatgtgctttactacattgtaaactaattgttttaccctttgtaattaataaatatttggaggaagagactttgagaatctacaaatatcttgcctttgtttaaattttcactgctaattttagcatccacaggtgaatcttgcttatatcaattattaccatgctgtcccaattgtgattttttctattttcctcattcctttcatttattaattgaattttttctataaggaagtgtcattccttttatctaatttctttattcacttatttttattgtggtattaactcatggatatttattttctcagtcatagtataacactatcatcatttattttgttgttcaagtttttctgattctagtgataaggagtcagtgggaagtgataccctcatccttaaacaacttggtttattgcatgcctctttactttctagtacaagatgcttcaggttgttcctgtatttttccagctttgaaatcaactacttcttcaaagaaccctgattgcttttattagagaatgatatttagaagcccagagatctagacaccaattttgctcattgcatggagatatccctgtgttgaattcctttcagtgaatagagctaggaaatatatatatgtatacatacccaggcatgaacacaaatctctgacatctatcatctctataatattgctctatctaatctatctaaaataaaatccatgagattatattgataactttgactctagccaccaagtattcaaactaaccttctttctttctaacttctttctttgacagtgagcaatctagttctcatgacctataatatatttacttagttttgttcaagcctaatatacatgtaattttataaatgctaaatgatacacctatgaaaggtacatttatcaactatagtttagtttctgtacagatctttcttcttcagccttatagtattaataaaagtattttgtccaaggttacggaaatcaactactttcttcctgacttccttcagtgtggttatgtaatttacgtttaatacagttagattcatccttatagtttgcattccttcttgagtttctccaacattttggttcatttcttaaatttatgtatggtaaatctcactctttttggtgtacacttttatgagtttttggcaaagatatagactcagacatctatcaccacattttcttacagaagagttccatcaccgcaaaaattttcttgtgctgtcgctttgtagtcaaaatgcagtactgatcttcccaattaatctattttctatgtatctattttttgcttaattatatgggcaccatataaatgtactcaagctatgtgtagcctttggggtctggtttctttcacttagtaaaatacatttaagattcatccatgcggaatatttttttttcttttttcttttttctttttttttttttgacagagtctcaacactggctcactgcaaactccgctgcctgggtgcctgggtgcaagtaattctcctgcctctcctgagtagctgggttgccaccaaaagcagctaattttgtacttttagtagagacggggtttcaccatgtgggccaggctggtctcaaactcctgacctcaggtgatctgcccgccttggcctcacaaagagctggcattagaggaatgagccaccatgcccagccttgtttctttttatattgtatgtatgtaccacattttgtatattaacctaccatttaaaaggcatgcatatgattatgagaaagctgctataaatatctatatagaaatgtttgcatgaagtttccaattatttttagtcaataaacagaagtgagattgctgagtcatattgtacatatatgtttgactttatatgaaacctctatactgtcttccaaagagactgtaccattttcaattcccaccagcaatgtatgagagtttcagttattctgcatctttgtcaggacttggtagtgccatttcctccaacccccatccttctaatagatgtggatggtagcacatagttttaatttgcagtttatttattaactgtctcttcttgtatttataagctattcatatacactgtttggtaaagtgcctcttcagatctttcagcaatttgttttattgggttgtttgttttatttctgttgtgtttagagaatttgttttataatctagatacaagatctttgtcagaaatgtgattttcaaatatttacctccagtctttttattcttggatcagtgtatttagcagagaagattttaattttgatagagttcaatttatttatattttcttttacagattgtgtttttggtgatgtctataaaatctcatcaagcacagggtcatgcagattttctcctacattttcttctagaagttttatagttttaacgtcaatgatgtattctgtgctaatttttgcattaggtgtgaggaatagattgcctacctatatccaattattttaacaccatttgttgaaaaggctaactttttccattaaattatttttatatatttgttacaaatcagttgactatatgcaagggcttacttctgggctgtattctgtttcacctatctatgtatctatctttcatcaatatcagactgtcttgattaatctagttttatagtaaggcctaaaatcaggtagtgtgatttctccagttttgttcttatttttcagaattgtttggctattctagttcctttagaatcaatttgttggtatctacaaaaggtctgctggaatgttctgttgctttatgttaatctatggattaaattggagagaattaacatgttagtagtattcactcttctagcacatgaacacagtatatctccccatttatatagatttgacatttctttcatcagtgttttgtaatgtttagcatattgaccttgatactatgcttttatatttatatcaaaatatttcatttcgggtgctattgttaaggctattttgaaaatttttgaattaatagcaagcatatagaaaatagtgagcggtggctaactcctgtaatcccagcactttggggggctgaggaaggcagatcacttgaggtcagaagttcgagaccagcctggccagcatagtgaaaccatgtctctactaaaaatacaaaaattagccatgtgtggtggcacatgcctgtagtcccagctactcaggaggctgaggcaggagaatcgtctgaacctgggaggcagaggttgcagtgagccaagattgctccactgcactccagcctgtgcaacagagtgagactccatctaaaaaaaaaagaaaaaaaatctctaaagagagacaattttatttcatctattctaagctatatgtcttttgtttattatccttgacttatcagactagttaagacttctagtaggatttagaaaaggaattatgagaaaggacattcttgccttgtcccagatctttaggtgaatacattaagtttttcataattgtgtatgatgttaattgttttttgttttgttttgtttttttaaagatggcttcttacagattaaggaagttctattactagattgccgaggatttttaaaatcacatatgcatattgacatttatcaaaagctttttctccgtgtattaaggtgatcatgtatttttccctatttaatctcttaatgtggagaattacattgtttgatttttcaaaattgaaccaggcttgcatccctggaaagaagaaaccacttgattgtggtatattattctttttatatattgttggatataattttctgatattttgttgataatttttgagtctgtgttcatatgagatgttggttggtctacagttttcccgcaaagtctttctgtggttttgaaattagggtaatacttgcctcatagaatgccttgtgagttgttaccttctattttctgaaagatattatgcagaatacttttttttcttcttaaatgtgtggtagaattcttctgggtcttcatttttttgaaagattttaaactacaatctcaattcagtaattatagattatctatttcttcttgagtcagttctgatagtttgtgtctcaagaatttggcccgtgtaatctattttttgaatttaaaatatgcagttatttctagtatctaattttattttacagtttgtggggtatgtagtgatatcatcccttttattcctgatatttgtaatttgcattttatcttttttttctttgtcagactggttagaatttatcaattttgttgatttttcaaagcactggtttttgttttcattgatttttccctatttttgtttctaattttattgatttgtgctctttattatttacttcattctgcttaatttgtattcagtatgctcttctttttctagtttcttaacatggaaacttagattattgatttgtgacctttatacttttctaatatagtattacatactgtacattttcctgtatttccttagctgcctcctgcaaattttgctatgttgtattttcattttcagtcagttcaaaatatttcctaatttcccttgagattttttacctttgacccatgggttgcttagaagggtattgtttaaattccaaatacttgataattttctaggtatcttcttgttatcaattacttctttaattccattatactctaaggacatattttgaataaatgttcaatgtggaatttaaaataaatttaaatatataaataaatttatatttattacattttattatttttattaaatataaaataaatttatatttatttaaaattaaattaaaatataaatatatatatacacacacacatttgtatctatctataaatagtcctattgctggtatggtgttgaagactctcaaggttccattactagacgacatttttaaatctcactcaaacttttggcttcaactgtccaatttgataatttcaaaatcggtgtctatagcataaatatctacttttatgtctagagttttgtgcaaacattttgtgcatatttcctttcttggaggatattcagtttcttcaaaatcaatagttcccaaattttaacacacacctacttttcctaccttggccagtattattttcataatatacccagttgcccaacccagaaacctggggtttatccctgattcctcccttacgtatctcctattctaataggtcatcaagtcctgctatttttctctttattttccctaaaaaatccttcttatttcttgtccaaacttcttcagtagtactctaatgtttcctttgtctccaaacttgaatataatccaatttagttttcgtaaccatattgaactatcctttcggaaatataaatttaacaattgccattgcccacctctccttaaagttcactatgacttttcattgccttagctatattaaaacaaacaaacaaacaaacaaacaaacaccttagcctagcctagtaggttgttcataaaccagctcttcctcctatatctcagttttattgccattcttccattcttcttgtaactcacactttggccacactgaactacttacaaaacatcttctaccttcatctgaaatagttttgtctcttatgtattacgtttgctccataaacttgtattgacaatatattatattgtcattgtttgctattttgttcatctcccctatacagcattagctctttcaggatagagaatgtaattttatcatctatacatacttaactgtacccagaagagtgtctgatacataataaatacttaatcttgctttgaatgaatgactaaatgaatgatttattgaataaaataataagcacttgagccaggactagaaacaacatattctgcttccaaatgacacactgactctgtttttagtagaatattaattagttattgccttactatataccatgtcagcaaatggaaggtcttacttataaaaaggcaaagtaatgtttgcactttgacttgatttttttaatctttttggctatggaaacaattactccaatgtcttgaataaatactcccaaaagatactcaggtccagtctttttaagcaatataactgatagctaaatgcattgctttgcactttctccctgaggagtctggctaccacttttatgccaactcagaatctcaggttatctggctatgttgtactctcatcagtttacctcttcactaactggaagagcttagtgttgtctgcaacttataaaccacctccagttagtttatgaaaggttcaataaaaattgtcccagtccaggttaaaaatgaacagttcttaataaactgattcttatcctttgttttataaacctcaactggtttccaatctacaaaacagtggccttaacctttggggcagagttttgccaaaagtatttagaatatttacactgaatctaatgtttcttccttacatattaataataacatttttttcctcaaatatctttatggtattagtcaaacctaaaatctccttatagacattgagttgacatagcatgatgaagctgcagaatttaacatatagatgttataggttactcaggaagtacagtgaagtgtggtacttgggtacctcattaaggaatttagataatgattttgttatttgaatgttttgaaatactgtctgtgtcagttggcaaggatgaattgaggtgttttctaaggcatcaggataatccactaaacataaaggttagcacatagtaagattttaatagatggctttttttggtaaattattcctttttatttcaacttactcttcagaaagctgtaaagatgaatggattaatttctataaaattctcacaagttctagaaagcattaaaaatgagatattgttgctgttttagttcttattaaatggtatacttcttttgcttcctggattgtattctactgtactctagattgtgaatattaaatacgttgtcttaaaaacactgttttggaagctttatttgggaccttcctatttatgtctaccccaactcaacattttcagcacaaattttaagaaagattagagttaaatattaacttttatgatttcatttcgttattgagaaaagtactatgtgtataatgccctctttcctgaatgaggataaatggaatgatatattttcattcattgaatgtggcacatttcctcttagggattgagttaatttcctctcaaaatgtccctcttcaccatctcgtggtcttcccccaatttcagatgctcattcacacaataagacaatattctgcatggagtaataaaagcgaaatataacaaagataaaaaatcagatctggcatttaggagacagttttaatatgccacaaattctcacatccttagactgcttcagagttaatagacttattgtctattaacaataaggactattccatgtcctgtggaaccatggaatagaaataactgataaggaaacaaattagctaaaacatagttaagacatcacctttgtagtgattaaaatttggttcacgaagtatcatttgtgactgatgcaaaacacagagtcaaaccaattaaggtccttaaagaacccagagaacttgactgcaaaaatcatgtttaccattgttttcaacttgaaataattgttttatgttcacctgaattttccacttcactcgcctcattcctcagaaacatctctcattattaaccttgctttgctcaatcactctcctgtcctgcttcaccatgtgctctcctcacctcacctccaaccccagcagatctttttagtggcacctttatttaattattaatttagcaccttctcttaagattgtcatctgccaagaaaaccatactctccatagctctattcacacacaaaaaatctactttcataaatattatccagtaatagtcaggtggtaatcctggttttgactcttcaaagtatattgtcctaccactaccttcctttgttaagcatgaaatgcatatgccctaggctgtattaaaagaaatgcagtacactctggaaggaaattgccccattggactctgtagttgtcagggaatgcctgaagtgcttcatttagttctggacaccacattttaaaagagacattgccaaaaaggaagataatcaatgggaggtatccaggatattcagcaaagttaaaaaggtatcggaaaatagttggagggaagtagggcttgttagtctggaaatagggatatttaagagaggtcatgtgtcctgctttttaaaatctgaagggattaaatctattctgtatttcctccaagaaccaaacaaggtcagtgggtaaagattatatgcagaccattgtaagtcaatataaggaagcgaaccctgttgacttcacttctacgacatattctgatctttccatttcccttcacataaactgtagtccaagacacaatcatcacttatgtcaactgcattgataacctgcgatctggtctccctatttctactatttttgcttctccaatccatccttcaaagagaagccagagagattattattattattattattattattattattattattaaagttctgggatacatgggcagaacgtacaggtttgttacataggtatatatgtgccatggtggtttgctgcacccattaacccgtcatctacattaggtatttttcctaatgctatccttccccttgccccctattccctgacaggccccagtgtgtgatgttcccctctgtgtgcccatatgttctcattgttcaactcccatttatgactgagaacatgcagtgttcggtttactgttcctgggttagtgtgctgagaatggtggtttcaagcttcatccatgtccctgcaaatgacatgaaatcattcattttgtggctgcatagtattccatggtgtatatgtgccacattttctatattcagtctatcattgaggggcatttgggttggttctaagtctttactattgtgaatagtgctgcaataaatatgcatgtgcatgtgtctttatagtagaatgatttataatcctttggctatattcccagtaatgggattgctgggtcaaatggtattttttgttctagatccttcaggaatcaccacactgtcttccacaatgattgaactaatttacactcccaccaacagtttaaaagtgttcctatttctccacagcctttccagcatctgttgtttcctgattttttaaggatcgccattctaacgtgtgagatggtatctcattctggttttgatttgcagttctctaatgaccagtgatgatgagctttttttcatatgtttgttggccatataaacgtcttcttttgagaagtgtctgttcatatccttcacccactttctgatggggtcgtttgttcttttcttgtatgtttgtttaagttatttgcagattctagatattagccctttgtcagtggatagattgcaaaaattttctcccattctgtaagttgcctgttcactctgataatagtttcttttgctgtgcagaagcactttagtttaattagatcccatttgtgaattttggcttttgttgccattgcttttggtgttttagtcaaaaagtctttgcccatgcctatgtcgtgaatggtattgcctaggttttcttctagggtttttatggttttaggtcttatgtttaaatatttaatccatcttgagttactttttgtagaaggtgtaataaaggggtccaatttcagttttctgcatatggatacccagttttcccaatgccttttattaaaaagggaatcctttccccattgcagcctctgttctgttccattggtctagatatctgttttggtaccagtaccatgctgttttggttactgtagccttgtagtatagtttgaagtcaggcagcatgatgcctccagcttctttcttcttcttgcttaggattgtcttggctatataggctcttttttgaaacttaaagtagctttttctaattctgtgaagaaagtcagtggtagtttgatgggggtagcattgaatctataaatcacttttggcagtatggccattgtaacaatattgattcttcctatccatgagctggaatctttttccatttgtttgtgtcctctcttatttccttgagcagtggtttgtagttctccttgaagaggtccttcacatcccttgtaagttgtattcctaggtattttattctcgtgttagcaattgtgaatgggagttcactcacgatttggctctctgtttgtctattattggtgataggaatgcttgtgatttttgaacattgattttgtatcctaagactttgctgaagttacttattggcttaaggagattttgggttgagacgatggggttttctgaatatacaattatgttacctgcaaacagagataatttgacttactctgttcctatttggataccttttatttatttttcttgcctgatttccctggccaaaacttcccatactttgttgaatgggagtggtgagagagggcacccttgtcttgtgctggttttcaaagggaatgcttccaacttttgcccattcagtatgatattggctgtggatttgtcataaataactcttattattttgagatatgttccatcaatacctggtttattgagtgtttttagcatgaaggggtggtgaattttatcgaaggccttttctgcatctattgagataatcatgcagtttttgtctttggttctgtttatatgctggattaaatttattgatttgtatatattgaaccagccttgcatcccagggatgaagctgacttgatcgtgttggataagctttttgttgtgctgctggattcggtttgctagtattttattgaggattttcacatcgatgtttgtcaggaatgttggcctgaaattttctttttttgttctgtctctgccaggttttgttatcaggataatgccaacctcaaaaaatgaggaggagcccctctttttctattgtttggaatagtttcagacagaatggtaccagctcttctttgtacctctggtagaatttgactgtaagtctggtcctgagctttccttgtttggtaggccattaattactacctcaattcagaacttgttattggtctatccagggatttgatttcttcctggtttagtcttgggaaggtgtatgtgtccaggaatttatctatttcttctaggttttctagtatatttgcatagaggtgtttatagtattctgtgatggtagtttgtgtttctataggatcagtggtgatatcccctttataattttctattgtgtttatttgattcttctctcttttcttctttattagcctggctagtggtctatctattttgttgatgttaaaaaaaaaaaaaaaaaacagctcctggattgattttttgaagggtgttctttgtgtctgtctccttcagttctgctctgatcttagttatttcttgtcttctgctagcttttgaatttgttgctcttgcttctctagttcttttaattgtgatgttagggtgtcaattttagatctttcctgctttctcttgtgggcatttagtgctaagaatttccatctaaatgctgctttagctgtgtcccagatattctggtatgttatgtctttgctctcattggtttcaaagagcgtacttatttctgccttaatttcgttacttacccagtagtcattcaggaacaggctgttcagtttccatgtagttgtgcagttttaaatgagcttcttaatcctgagttctaatttgattgcactgtggtctgagagactgcttgttatgatttccattcttttgcatttgctgaggagtgttttacttccatttatgtggtcaattttagaataagtgcaatgtggtgatgagaagactgtatattctgttgatttggtgtggagagttctgtagatgtctattaggtccgcttggcccagagctgagttcaagtcctgaatatccttgttaattttctttctcattgatttgtctaatattgacagtggggtgttacaatctcccactattattttttgggagtctaagtctctttgtaggtctataagaacttgctttatgaatctgggtgcttctgtatttggtgtatatatatttaggctagttagctcttcctattgcattgatccctttaccattatgtaatgcccttctttgtcttttttgatctttgttggtttaaagtctgttttatcagagactagaattgcagcctctgctttttttttcttgctttccatttggttggtaagtcttcctgcagccctttattttgagcctatgtgtgtctttgcatgtgagattggtctcctgaatacagcacactgatgggtcttgattctttatccaatttgccagtctgtgtcttttaattggggcatttagcccatttatatttggggttaatattgttatgtgtgaatttgatcccgtcattatgacgctaggtggttattttgcccattagtttatacagtttctttataatgtcaatggtctttacaattcggtatgtttttgcagtggctggtaccggtttttcctttccatatttagggtttccttcaggagctcttgcaaggcagtcctggtggtgatgaaatccctcagcatttgcttgtctgtaaaggattttatttctccttccacacttatgaagcttagtttggctggatatgaaattctgggttgaaaattctattctttaagaaggttgaatgttggccccaactcttccagcttgtaaggtttctgcagagagatccactgttagtctgttgggcttccctttcagaagagaaaggggtaagctgacctgtctctctggctgcccttaacattttttccttgatttcaaccttggtgaatctgatgattatgtgttttggggttgctcttatcaagcagtatctttgtggtgttctctgtattttctgaatttgaatgttggcctgtcttgctaggttggggaagttctcctggataatattctgaagactgttttccagcttggttccattctccccactcattttcaggtacaccaatcaaacgtatgtttgatcttttcacatagtcctgtatttcttggaggttttattcattccttttcattcttttttctctaatcttgtcttcatgctttatttcattaacttgatcttcagtctctggtatccttccttctgcttgattgatttggctattgatacttgtgtatgcttcacgaagttctcttgctgtgtttttcagctccatcaggtcatttatgttcttctctaaactgattattctagttagcagttcctggaaccttttatcaaggttcttagcttccttgcattaagttagaacatgctccttgagctctgaggagtttgttattacccacttcctgaagcctacttctgtcaattcatcaaactcattctccgtccagttttgttccctggctggcaaggagttgtgaccctttggaggagaagaggcttcctggtttttggaaatttcagcctttttcgtgctggtttttcctcatcttcttgaatttatctacctttggtccttaatgttggtgacctttcaatgggatttttgggtggtcatgctttttgttgatgttgatgctattgctttctgttggttagttttccctctaacagtcaggcccctcttctgcaggtctgctggtttgctggaggtccactccagaccctgtttacctgggtatcaccagcagaagctgcagaatggcaaagattgctgcctgctccttcctctggaagctacattccagaggggcactcaccagaatctagctggagctctcctgtatgaggtgtctgtcaacccctgctgggagatgtctccctctcaggaggcacaggggtcagggacccacttgaggaggcagtctgtcccttagcagagctcaagcgctgtgctcagagatctgttgccttcttcagagccagcaggcaggaatgtttaagtctgctgaagctgcacccacaggcgccccttcccccaggtgctctgtccccggaagatgggagttttatctataagcccctgatggggctgctgcctttccttcagcgttgccctgctcagagaagaggaatctagagaggcagtctggctacagcggctttgtggtgctgtggtgggctcctttcatttcgaactttctggcagctttgtttacactgtgaggggaaaactgactacttaagcctcagtaaaggcggatgcctctccccctaccaagctcaagtgtcccaggtcgacttcagactgctgtgctggcagggagaatttccagcctatggatcttagtttgttgggctccatgggggtgggatccactgagcaagaccactcggcttctaggcttgaggcccctttccaggggagtgaacagttctgtcttgctggtgtttcaggcaccactggggttacagaaaaaaaaaaaaaatcctgcagctagcttgttgtctgcccaaacagccgcccagttttgtgcttgaaacccagggccctggtggtgtaggcacctgagaaaatctcctagtctgtggattttgaagacagtgggaaaagcatggtatctgggccagatagcactgtccctcactcatggcttcccttggctagcggagcaagttccccaatcccttgtgcttccgggtgaggtgacatcccaccatactttggcttgccctccgtgggctccagccactgtctaaccagtcccaatgagatgagccaggtacctcagatggaaatgcagaaatcacccgttttctgcattgggtctcgctgggagctgcagactggagctgctcctgtttggccatcttgcctgggactgagatttttaaaacctaaatgaagttttgctttctccatctaaatccattctagcattctctcacttgatataaaagtataaactctaaatttctttgcattgcctataaggtcctaaatgatccactctgccttctctgtttctgtccttttccttcttgctccatatgtcccagccatactgaccatctttcttttccagaaagaaaactaaactccttgtcaaattcagacctgtgcatttgctgttgcctctgctggaacacttggctcccacctgcttccactgctgactccttcttgtcattcagcatttactcaaaggcttcctccttagagcagccttacctagctacttttgctaaaggaattcttccttcttattgttatagctctttgttttatttttttcccccatagcccttgtcattccctaaaaacttccattcttcttgtgtgctttctaattgcaatgttagattcataaaagcagaactttgtttaactactatatctacaatggtgaggacaatgttgggcccatgataagagtcagtaaaaatgtgttagacttggatgactctgtaacacattatattctaagattttattattgtaggtctcatcattcttaaactcatcatgtccataaacaattgcagtgtggcttattttttatgtgaatgcttatttgcatttaaatattgcatcaacagcatattttatctacaacatgctagcatagtggtttaaagtatggtcctgaagtccctcagattgtgtggatttctatccatgttctgctgtgtaacattgtgctagttatatagactctttacacttagtattttcaaatatttttatatacaaattatggataataacattgcccctgccctatagtgtgttttgttgagaaaatcagaagaaatatgtatagcacttaatacagtgcctggcatatgctaaatcctcaaatgttagctgttagtaatagtagtagtatttaatgtttttacacaactgtgcaactgtcaagccagtacttttacatgaaaataagtcaatagcaaggtgaactggacaatgaccaacaatttaaatatgtcatcaatgttatttagtccagaaaaataaatatataccattctcatgctattttttcctaaccttatgtgtttatactgacaagtgataagctttctgataacttcagagggagagaggagcaaaaaagagggattcaataaaagtgcattttaatctctgaatccttctataattcggaattttctcattctaaaagatcctaatgcaaaaattagaattcatagtgatggcaaacaactgtacccatattgtatatatatattctaagttgtttcacttgtatgtattgttgttgggatagaaaaggaaaaaaattacattgatgttcaatatcacgtgaaatacatattttttaaaataccagtgatgatgtaatcaacattacttagcagaagaaacaaactttacattctcttatctgctttcataacggtatataaagtcaatacaatagacacataattatacatatctactgaacattaaaattcaccttaagtattaattctttattcatatgaataattaaaatttgctttatttaagtttttaaaagtacttttgagaaccggcttatttctaaggactaaatacccttgatatatgcttttgatcctgattcaatgaaattgtttttctatttttctttgttcagtatataaaacaggcaaacccgcagtttgtacttcatgactagccttaactcttgttgaagtatagcaaaattatagtcctgtcaaaacatattagtagctgtggacaatctttggctacctctagttttcatgcatatttgtaatcttaataattatctatgcactgctttgttgaaaggttcattgttctgatttctatttagaaaagctttcttcttttaagaatacatgattacccaaatagtctaccctaaatgttgtatttctttggcgtagtaagtctgatttccttagcatggcaaatcttctctgacttgtgagaaaagtcaattgaaaaatgaaccaaattatttcaatgagaactcaagcaaatgtgcttgtagaatttcaacaagtgccgtatcggttaaagaaaaatgatttgaaggctgagtgtctagctaagtgcctgatttctctgtgcatatttatcattaattaatctataaatgtagctacccatgtttatggtatatgtagtggttattgttacagaaatcaggtgtttcatcaaatatactcatttagcacaaaacaaatatagtgtcggcctctttcattgaactctcagcaactaaagcttaagtcaagtatgcattttccaaaatgtaatgaaatcaccatcaaaacagaatgttacagtgccagctgtctcctctttggttttctaaagctttatttgttgattaagtggcttgcatctctacaaggccaccactcacttttctaaggccttgaccacagacgattcaattgcttggctgttaaattttcagccgtcagtgactatttgaatattatctactaaaagtcaaatttttctgacagaaaccacagtaaatcagtggatagatacttaaccctccagaactcaacctaagggaaacagttcttcttatgcttggggagttgtaacaacatctgagaaatgctgccgggagagcagaatgtgcctgtacatggcttatttaagcttcgaataagtaagagctttatgctgaagatactcatgaacaatgatttacatacaaaacaacactactaacctatcccactggtaccttgccagggaattattttctagtaggagatgttacacttatgctaattcaaacacatctggaagtttcttatatatatgaggcttcctggcagtgacacctcgtactcaatagatgggcagctctggatcacatagttgctagaacagtgtcccctcccttcttcctggctgcatgggcattgcttcattggctgtcatctcctttcagggtacctttattttgaacaatggcaagcatttgggacatggttaactgtggttgtaggattagggataaagaattaaggtgctctgtgagttggtaaggagggcccataggagcatacatatcctgatctctcatactaataaggatgtatgcaacaaggcactggcatttcttctaaccctagtatcttagtgacatcagtttaatttctgctccagctaggtaacagaagatgtgggaatggaagaaaatggaggaaacccagagagagaaataaaaggatataagctatggtggatgtaaaaccttgagaagataatatagttttagtcttttattgtgatttaaaataatgtttactatttaccaagaatgcaaagtaccatggctgaaattttgtgggaaataaatttctatgcagaacaatgcaaagatatttgagcaccaacataaacagtcaaattcatggggacaggcaggtaaaatggggagtcggtagaggtagcatgatgacaatgtcaccaggatgaatactattaaaagtgtttgattttgtttaccatattgatttttaaaattgtcatttactactgtggcagaaaaatccacccttgaatgacgtttcacaacttatgggactgatttagtatccaaatttaacccctgtatctgctagttccaataacttctttccctttggggaatggtttgcagtggtatgggtatgttcatttgcccatcatcccttgccacactctgaatttcaggcaagagatgcaacgcaacttagaactatgaagcactggccgggcgcggtggctcacgcctgtaatcccagcactttgggaggccgaggcgggccgatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaactatgaagcactgtaactgatcccagttacatgctttgaatcaggtaaagagacacagacgtgatcagataacactgacatgttgaatatttgggacatctgagtcattaattgagattccctattccaataatgtattataaagaaataagacttattgtctaaataaaagtaggctatccaaatagagattataatcatctattgaaaatatcatgatcagtgtaccattaagtggcatgtgttcactacaaagctgacaaatgcaccttttcaatacatgatcgagatctttatgttcggctttatgcagtttttttattattatttctgttaacttctgttcatcattttcagtatagaacttaacagtttatcctctgtttattcaggtagaatgtggaggtcattccaactccatactcttctgtaagacttttcacacttacgctgctatctagtttccccaacagcttgacttgctctgcaataaacataaatgcttcttctttttcttaccactattatcatagggatatctgcagatatttttgacattttcaacatctttacaccacagagcagagaataagcaaaaaaaaaaaaaagtgagtaatgcacataggtcttggtcccatgggggccttgtggggaaccggccataagcacatgcagcttacacacatgccatttattacactttatgggcatgcttgcatggaagaatatgggtgtatgctgaaaggatatatccactgaaaaggactgggaaggtcttctgtcccttgggacactgagtaaactgtgtggtgtgcacctgtgtttttgactgtgaatgattatatgaagttacgtgtggaatattcacttgtggcatcacatccacgctcaaagttttgggtattggagcattttggatttcaaatttttggattaggaataatcaacttgtataaaatatttgaccaattttgaccaatatatatgtattagtatgtctcttttagtcttcttgcatgttttagcgcattttagcatagtcaagagcatattgtacatacagtgctatatcctactttttgactaccctttactcttaagcaagtccttacatcattaaaagtctcaaaacataattttatgcttatatattattgcaattatatttgcccactataatttatttaatagtcataggattttttctagcacttcattgttttaaataacactatcctaaatatcttccttcttttctttatttgctcatttatcagatttttattaaatggtttttctgtgtcaggtgctgtgtaccaggaactatgctaggcctcgaaattatcaaagtgagtaagtggagaagataggctataaaaacaaataattatgataaagtataataaatgctaatataaaatgttaatataaatatgtgtttatatttctgatcaccaactaaggttatattatagaaagagaattattgggccaatgtggataagcattttaaaggctataggtatgtggtaccaaactgctttccagaattattccatcaatttatgaacacataggcaatgtgttagcatatttctcaccactatcagcatattattaatattctataaatgtttgctaatttggtaagtagaaatgatattttataattgacctttatcacatttccttggtaaagctaaactttttcatatactaatcagctttttctttttcttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatcggcccgcctcggcctcccaaagtgctgggattacactaatcagctttttctacgtctttcttttgtgaactgttagtccagtttctttgcatattatttcattgaagcattggtgtttttattatcaatatgtatgttttctttattaatttattaacctttttgtgatgtagttttagtaaatattcactctcattgtgtgtgcacttcaatttagttatatttttgacacccattaaattttaaatttttagatggttaatttgatatttaattttatgattttttctgatatataattatatatttatatttgtaaatgtgtatttgtaaatatatataattatatatatatttacaaacattaggttgaaggacatatttaaatgcttttctttcatgtatatttttttcagttgtaaaaacatagctactcatttaggcctctgtaagatatagaaggcttatttataagttaggaagataaagaggacttaatgataaaattagtactggaatagatcaacatagacatcaggatctcaggaagatctagcaatctttttcatgatcttcccctggtggaatcttatttatctctaggtattagatcccccttataactttgacttgtcatagtccctcatggctttgatttaattcagtctttttctctttacatatacttttaatatcagatcctattgctaactggccatgggtctgtgtttctctatttagattccaaagagtatggtcaagttaatctttatatacgaggcctccctgcagattcttggtcaacatatggatttgctgtccattagttggaatcctctctttgggtgattggctggagcaaggaggaaagaggtggtggtgtcagtgagtcaagctgaacaatagttgtcattggctggcatttcattcatctctaagaatgaaatgtggatattggagtcctgtgactgactttgctgtgaaaaagctgttgcaggtaagaatgtaattaggcattcaggagcttatagtactaacctcagctctgctgccaactagccctggatccttatactaatgtcttaacctcccttaaagcacagttggctcagctgacaagtgtgatggttttgtagtctttaaggtccattccaattccaaaatgtctacaattcttatatataatatttgacaatttaataaaaatgtgaggtacttctctctgctctgcaaagttgctggctttgatgagtaatcagagtattgccatcacttagctgtgaactaaatgaagtaatgtatttcagaacacttaagacctgatgtattttaaagagctaacatccaagagaaacatgtgcagagttgacagtccttggttgattacaaggcagttgagttaataatgttttatgagcaacctatttttattttagttattcttttgaactcaatactaaaattttccaaattccaaacacaatcttaaattaaaaaattaataatgtcaacagaaaaccttttaaggaccagattgtcatttgaggttattaatgctagctttacataaaaacaactgtctgatttcactaacttagcaaaattactgttcatttatgggtcataccacagtttacatatttaatagatggccttttgcatgacggttgagggatcctggctcttttcatctcgtggtactgctgtctcctaggcctccttcagatttccacataggtttctttgcttttaattggcaataggcaaacagcaagtgagaggggactcttggccagtcctggaagaagatatgaaatacttccattctcattctttgacagagcccaggaatatggtcctgtccaaattgcaagggaggctggaatatgtaatcttccaatgtagcaagaggaggatgcagggttgctaacatctagacagtctttgccataattggtagaatgtgaaatatatgctaaaatgaaaaatcaaggaaccaaacaaaatgaaatttccattttttctggctgaatcgataatagtgaaattgtcaaaacaaattttcatatagaaatacaaaaattaagatagttttgggtcattctttttcatcataaaaagtcaataaagtttgcaccaaataattacatttagcagcagattttggtgttatttttcccaaagtaaattatttgttcatttattctttaaaactgaattttaggtttcaggcaaattaaggtaacaaatggctcagtagaacactaagaatttttgcataatattacttttgtacacaggaatcagtcacattttcagagatttttttcttagtttcacataagaaacctaacaataaactatttcttttatcttctagcttcattgaaaggaccacaccaaatgaatcatgacattcctcaaggctgattttccccctttcttctccttatactcatcttccattcactctcctgtataaactattcttgtttctattttcctcttctgcctttatgaattttttaaagattttcagtaaactcagtaacatcttttccttcagctatatttctgttcccagtactgttatgactttactatcagttatacttatccaataattcagagtatattgaaaactagaactttcattagtgttaattagatgacctatacacattctttcgtgcacagaaaatattgttgcttgaatacgggagtacgttcgaaacatattcagttgtgtcatgttctgccatgttatccaacaacaacaaaaaacaagactaaaattctactaatttgaaatgattttaattttttacagtgttttgttttctgactgatagaccaatatatgtattacattcctttgtattctgagacacaactgtttgggttctgaagacaacattcttttacttcaaatgcttgacatagtgctttcctttaactggatagcctagaaatagtagcttgtatctcttttttcttcagatacaaccatcaccttctttcaaaagtaaaatataaagctgcttttccgtcagcatggttagaaattcatttatcgataaatagtctttcttaggttctcctcattctgtcacaataaatcatcaactatttcaaagaatattactattaaaatatttttaaaataataatggttgttatggatactgctaagtgctctacattgtggaatagtgtattattgtgagactatcaacctttaaccctattaagactctatttgggaaaaatatttaaaaatttgcatttcgatatgagttgaaaaattctggataatataatcagatagtttataatggaataattttgaatcgaacttttttttttttgagatggagtctcactctgttgctcaggctggagtgcagtggcaagatctcggctcactgccaacctctgctgcctgagttcaagcgattcccctgcctcagcctccccagtagctgggactacaggcacatgccaccacacctggctaatttttttgtatttttagtacagacagggttttgctattttggccaggctgttcttgaactcttgatctcaggtgatccgcctgccttggccttccaaagtgctgggattacaggcgtgagacaccatgcctggatttgaattgaacttttggtgaaagaaaatatcggtataaaatttacaaagttttgttataccaataaataaatccactggcttattccctttttaatttaaaatcagtaatgtaatgatttttataaaggacttacactaaatgaacacctactaagaagcattgtttatcttgcctataagatcataggcaataatatacaccttccttgccaccacattgttatatatagtatgtataaataagtatggacagccatatgatgaaatgctaattaaccaataaataataattggtaaattggcttgctaatgtgggaaatatacaatatatatctataatataggcagtaattacaagtgattatttctttgtggttttctgtattttcatcatttctgttttaactatgtcacgtttgtaataacacaaaatgataaatgtagttggaaaacatacctagtcacagaaatggtataaatataaataagtataatactttaaagaggtacagatctattaaagtgtactgtttcagagacttcaggctaagtgctagggatgcattatctctaccctcaagaagcctgttgatttgtagctaaaatgttagggtaattcaaatgaggacagattatttttgatagtatcccagacaccaggttcttatgaaaccagaaagcctggaaggtcataatacacttaaaaaacctcaactccctgtaaatgacatcaaagaagcatctgaaaagtattagagctggagaaaaatactcaatttgagaattttaaaaatggttagactaatagaaaatccatttttgtatcataaatataatacttgaagaagaaaacgaagcttggaactggtactatttcaaacacttgttttaaataatggaagtttatagtttataaatattgaatttctactacactttaatatagtgtattctcttggatatagaccattcattatagggcatgttcccatgtttccaatttcattagaagctaagaggacttcctgtgttctatggctgtgccacgtcaagaaggtggtagaggctggagcagtgttagctgtcactgttctctcttggtgatgtagactagatgaaggtttcttctttagtggccactggaaggctgggaatgtgaatgaaggactgtcaactgtattcttttggtgcaatagtagaatattaacttggaatttttaagttttaaaaacaaaacagttttcacagaaaagtaaaaggggatatatagctcatcccctattatcctaacttattatccagtgggtagggatttgtgtaaaattataattttaaatgtttcatgaggacctagaaatttctatttcctgcctaaaaatagacttctcatgtcttctacggcaaaggtttttaaacatggcaattaaacatcaattaaagtgattcaagattgtgaaatggctgacttaaaaacaatattagcacatacagctgggatgctggcttacctgaagacagagccatggcatccatgatttggaagttcagtgattcaataaaatagatttcatttacttggtaattttaaacattttaattgttttgatgtgtgtagacttttacaacattttgttgcttctctcagcgatatgacctgaatttacctttttcatgtagatgcataatcaatttaatttccagacgaaaatggatagtcttttggattttctgcctaacatacaggttggtaaaatttctgtcaaagcatatgaggatcaatataaacctctaagtgttgtagtgtgaataagaagtgactcacttgcttttaaactaaactctttgtaattggactttttctctatgttttttaaggtctacagtgaaccacccaataatggtgcttcaatatgaacttcatacaggttatagtcttcagaagggatagtaatatatggttgcaggtagaaagaaagggactagccaaattataccaaaagccctgtgtttctagcagaaaaaaagcaaagaaaaaagttaccacaaaaaataaactggaacatgtgaaggtaattggtcaaaaatttaacagtagcacagacatggtatgagaaaacacttatgaataattgggtgttcaaacatttggctaaggataaacatagagaagcaatctgattagacattttgctatcagtatgacagcaaacaaatgttcttaccaaacactctttttagcattgtagaattgatatatcctatattgtccattttaggttatattatatttactatgtgtatttgagtgtgtgtgtgtgtgtgtgtgtgtgtgtttattataagacagattatatagatagatgatagataaataaatacatcaatagataaatagttagataaaaaatcaggctgtaaagttgaaaacgttgagaaaggactctgggacattggtctgggcaatgatttcttgagtaagacctcaatagtacaggcaacccaggcaaaaatggacaaatgggatcacatcaagctaaaaagcttctacacagcaaaggaaatgttcaatatgcaaagagacaacttacagagtgggagaaaatatttgcaaactactcatctgacaaagaattaataaccagaatatataagaaactcaaacaaatcaataatgataaaaacaaataatatgattaaaaaatgagcaaaagttctgaatagacgtttctcaaaatgagacacaaatggttttctttttctcgttgaaccgtttttcatgataaacatgtcaggaaatggtgaacaggtatatgaaaaaatgttcaacatcatcagtcatcagataaaaatcgaaactacaatgaaatattatctcacactggttaaaatggcttttattaaaagacaaaaaataatgaatgctgtcaagtcgggggacctctagtggtcaagtgttcagtaggataagagggcaactataggtaacaataatttattgcatatttaaagataactaaactagtggacttggaatgtttttaacacaaagaaatgataaatgcttgaggtgatggatataccagttacccagatttgatcattacacattgtatgcttacatcaaaatactacatgtaccccataaatatgtataactattatgtatctataacaattaaatattttttaagttaaaatatattttttatatttaagagtaagcagaataactatcatttttctgggtttcttggagggtctccctgcaaaatcaaatgatattcctaattttttaggttctaaaaatttatgttttagggatttattcctcagacctaatattctgccttttagcctagcaatttcacacctcactgtaaatcaatttgctataagttttttctgcttttgcatatccagttaattctcatgaagtgccctttcccttactcctgtctcccacacctaatgtttctagacctggttcaaatgtctttttcaattcaaaaccttccttgagctatctaaatgaagttgataacttacttctttgattgtgtttatgcagagtatttaaccctaattattgtgttcatcacattaaattgcatttattttgtacctttctctccattagactgtgaattattaaggatatatcttctgccttatatgcttgataactctagcatctggtatttggtcttacaaattgttcactgaatgaatacatgataaaatgagtttgtgtcggcagtgaagggggaagctttaaaccttgaatgtctgagggagaattcaaggggagcaaggtgaaggagaaagataccactgtggggggaggagccaagatggccgaataggaacagctccggtctacagctcccaggatgagcgatgcagaagacgggtgatttctgcatttccatctgaggtaccgggttcatctcactagggagtgccagacagtgggtgcgcgcaccgtgcgcgagccaaagcagggtgaggcattgcctcacttgggaagcgcaaggggtcagggagttccctttccgagtcaaagaaaggggtgacggacgcacctggaaaatcgggtcactcccacccaaatattgcgcttttcagaccggcttaaaaaacagcgcaccacgagactatatcccacacctggctcagagggtcctacgcccacggaatctcgctgattgctagcacagcagtctgagatcaaactgcaaggcggcagcgaggctgggggaggggcgcccgccattgcccaggcttgctgaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggaggtctgagaacccgcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacattaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcaatggaagatgaaatgaatgaaatgaagcgagaagggaagttcagagaaaaaagaataaaaagaaatgggcaaagcctccaagaaatatgggactgtgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaacgtcgggttaccctcaaagggaagcccatcagactaacagcggatctcttggcagaaaccctacaagccagaagagagtgggggccaatattcaacattcttaaaaaaaagaattttcaacccagaatttcatatccagccaaactaagcttcataagcgaaggagaaataaaatactttacagacaagcaaatgctgaccgattttgtcaccaccaggcctgccctaaaaaagctcctgaaggaagcgctaaacatggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaatcaaaagacacagactggcaagttggataaagagtcaagacccatcagtgtgctatattcaggaaacccatctcacgtgcagagacacacataggctcaaaataaaaggatggaggaagatctaccaagccaatggaaaacaacaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaacggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcacaaataaagatgttctttgaaacttacgagaacaaagacacaacataccagaatctctgggacgcattcaaagcagtgtctagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagggcagaactgaaggaaatagagacacaaaaaacccttcaaaaaatcaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaataagtagaaaaagagggaatcctccctaactcattttatgaggccagcatcattctgataccaaagccgggcagagacacaaccaaaaaagagaattttagaccaatatccttgatgaacactgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccaacatataaacagagccaaagacaaaaaccacatgattatcttaatagatgcagaaaaagcctttgacaaaattcaacaacccttcatgctaaaaactctcagtaaattaggtactgatgggacgtatctcaaaataataagagctatctatgacaaacccacagccaatatcatactgaatgggcaaaaactggaagcattccctttgaaaactggcacaagacagggatgccctctctcaccgctcctattcaacatagggttggaagatctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaaaagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttgcagattcaatgccatccccatcaagctaccaatgactttcttcacagaattggaaaaaactactttaaatttcatatggaaccaaaaaagagcccgcatcgccaagtcaatcctaagccaaaagaacaaagctggaggcatcacactacctgacttcaaactatactacaaggctacagtaaccaaaacagcatagtactggtaccaaaacagagatatagatcaatggaacgaacagagccctcagaaataacgccgcatacctacaactatctgatctttgacaaacctgagaaaaacaagcaatggggaaaggattccctatttcataaatggtgctgggaaaactggctagccgtatgtagaaagctgaaactggatcccttccttacaccttatacaaaaatcaattcaagatggattaaagatttaaacattagacctaaaaccataaaaactctagaagaaaacctaggcattaccattcaggacataggcgttggcaaggacttcatgtccaaagcaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacattcatgcagccaaaaaacacatgaaaaaatgctcatcatcactggccatcagagaaatggacatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatactgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgatttcatgtcctttgtagggacatggatgaaattggaaaccatcattctcagtaaactatcgcaagaacaaaaaaccaaacaccgcatattctcactcataggtgggaattgaacaatgagatcacatggatacaggaaggggaatatcacactctggggactgtggtggggaggggggaggggggagggaaaaaaaaaagataccactgtgtacactgagatggaattcacttacttagaatttcatttagagctgaccctttgtgccagcgacaacctgagctgagcttcatgtacctaaagccaggtcccggatttgcaactggggctgctgtttgcaaagcccatgggagatttttgacccttagagtcctctgaaaaccttttcttaggagtttttttcttgttacaaccacctattatgatctatctcttgtgataatttcacagaagtcttcaccaaattgtttgttcaattaatccttgaagaattttttttttcatggacaaatagatggtttcaaaatattgagaagttaaaaaaatagtgttgcatgtaagaggagaaaaactgcattttatacatatagatctgaatggagaggtaatttacaggagttcttcaatttaatactggtcaatgtcaatagatacaactgtgctgtcatattggggtgatcaaggtaaaagtttcagagtggatttaaaaatggctgtttgtaaacatgtaaaaataaatctgacatgatttttttctgttggaatacttcatctggaattaaaaacctaccagagagataagtaattttaaacctatttaagtgtaatttataaatagactctggagaactagaaagcagttcaaagcgtccttcaccctcaaagaagacgttgtcagactatgaaccacttcacagcatttgtatgaaataaaggcactgaaagtctcatgatgctgtgtcttacttgtctacccctatttattcatagaatgcattagttgggccccttaattatttcttatctacttactgcctatataagtcatattgaagaattttatcattacatttaggatttttttatttacaacttggacaagtgtattattccacagagtattacatgtgtgcaaatttagtaatagatttttgaaaattggcctccccagcaaaacagaaggtaggaattcttgcaaacacttttgcccatggcactgagctaggtacatagaattctgtggaaatgaattagtttgtaacagccaaaaacagtgttgaaggagatatagcaataatgttgatcttagttataagggtaaaataagatcacttgaaaaacctctctcagtttttgacaaattaatgagtatggctgtcttcttccccttaatataattctgtatatgtgacacaaatgctagtctggttgattctgagaaacagaaaataaaatactgattactcttagaaagacataagctaatatatatggagggaagaacaatttagatacgaaaagaactggctgcaaaaacagcaggaacttaaagaagaacttttaagttgtaatttctgcctttcttcacattgccctgcgagaattatttcctacagtaaggagaaaaaacagcagcaccaacccagcatcagtgacaaatggtgaggaaacagcagaaaggcaatccaacctagctgggttggagggtgaataacaacaggttcccagatattttgggtggatcctgatgattttctcttctctatcctccctatcaggactagtgaggagaaaagaagagtcctcaaagtacgtaattgcttactgtggggcggtgagcaaagagagtgattctgcccagattgcaaaattagaaaatctcagactggaggtggattccttcaccttataccagataaaagagaattgtggaacagaaattcaaaataaatataaataaaatcttaaaataaatataagtaagaattaaatattctcaaagagatgagggagaataatggaaaagatgagcagaataatacattttgaaaaaaatagaactcagtagataaattaaaatagaataaatacaattgggtaacaaactaatgaatttgaaattagaggaaaattttaaaacatcacaagaaagagataaagaaaaagagaagaaaaaacaaaattttggagagaggaaggatggatatataattgttaacctccacattgaaggttttccaggaaactatatttttaaaaaatgaaagagaggaagtatttggagaaatagtggcctaacatttgtaagaattaaaaaagaaaaatattgcaaagtttcatagtgccaaaccttttagatgatttaaaaagacaatacaaacatattaaagtgaattttaaaacatcaaacacaaaaaagagattactaaagttttctaataaagaacagagtatttacaaaaaaaacaagaaatgaaacactaatgcaattattgttaatgttatattcataatagaggagaataacatttttcaagagtaataataaaaggactttaaatctgaaatattatatgcaactaacaataatttacatgcaaaggaaacatacttacatattctcaggcaaacaagaactcagaaatttcatcaagcaaatgactcttttgaaaatactttcaggaagtataatggtaagttgaaactagaaaaatctatgaaatacatgaaatgtacaggtaagaaaacagcatagtaaattttcctgttgctaaaacaaacctaaaatctataaaagatccataaagctcagagttaaaaatgcaaacgtggtggcaggggagaagaaaataagagacaagaaagagagaggtgatatggatatggataaactaagaaatgggtagaagaaaaaaagtaatgtagatattcatcattgttttactggtaaccaaacaataaataaaacacaatattaactttcatacaagaagaaggaacttcttgtatgaaattgaatggaaagtgtgaaaggcaaattaaactaatacacagaaaatatacaataaaaatcaaatattaagaaagaaatgagtcctagtaacaatcgcaataaatgtaaatgtattaaactcactgacaaaagacagagaccttcagaatggattagaagaaacattatccaacaaaagataaaatacaagagaaaacttcaaagaaaagatgataaaagttgagaataaaggtaaaactttcaattacaaacaatgttggattagtttaccataacaagtgtctcactgaggacaactataagaagggtaaaattttaacattatttttatgcacatagaagagtttatgagaccaggccaaaattaaagggaaccaagaaaaaataaacaagtatgaaagcaattttgactattatcaggcaaattgcaaccatgcctcttctttgagaatgttactttttctgtggaggtcttttatccacatatacagaaatctagaagtccctgagaatttactccttccacacagcccttgaccagtggctcacagaagtaggagtatagcaagttagcttctttgccttgggcaactctgaggttaacttactccagcgttctcctgcaagatcaggccaaagctatatttgcagggctttatctgagactgcaccctggcatggctttcttctctccccttttctgctttccatgctaccttgctgatctctatagagactattgcctttctaaatcatttgttcatgaatccttgcctcagggtctgcttctgggaaaactgacctaagataccatctctaatattgtcccttcctcattctttctagtttttattttttaaagtctttctgtcatctgttgtttctgttggactctatcaagtgatttattgtgggtattattttttaaattttgactgtaaattcatgtttcttgggactttatctgtagaaatcctttgaagcctggatggaatgtgtattccctcaaacataatttgcctaggtttatctgagatccctgaagaaactactatttggggccactttaaatagattgttggatttaggtttgttaggccactaagtcaatgtggattcagtgtacaaatcagcatgaggagtgttctttggctatgaatgttcaggtgagatattttgtctgaattcagcacaaaaatcataggaaagaatttccttctcttgtgctgtggggtggatttatttctggtacaccccatacacaggatagagccatttagggtcccagcattatgtaggtatgccctactggctttatcactttggtgagccataggctttgtcttctgtgccttctgtcctgtggggcagaaaaaaatggaaactaagatttgataagattaactacatagtctaaggtccaaataatttcagtgctttcttaactttctaaataagaattttaatttgaccttgaaaagttccttctgtcttgaaagagcaaggatatagttattagatttaagaaatttatttttacttaaatataaaaatatatttaagttaaaatatatttaagttaaaatatatttttatatttatttttatatttaaaatatatttttatatttttatatttatttttaatataaaattgttatattttgttttaatataaaatatatttttatatttaattttatatatttatatttatttaaatgtgtgtattaacacaaacattaaatgtattaacacacatttaaatatatttaacacatgacacgtgtgtttcttccaatgtcaagtaaaggccatgtttgctgatatgccatacatttatttgtttatttatttattggagaggttatggggggttttccatgcatattaaacatgctgctgacttaaaattctattatccagagagcagcataattcagcctagtccatttaaatttgataaaaattatatgtattaaacaataatgaattgatcatcaacagcaatgaacagacttaacaggagaggaaagacaaatgtcagttaatactctcgctttgtgaacaagtagttgtataatttaccacaataaattgttttcatggctttttagtcaaggctatataacagagaatgccagtgaataccaataataacaacaatattggagcctattatcaactcagctataagaaaaataaagaatgagtacggttgttatggaatcaggaacatattcagggaaaagttagaggaaatagcactaagttgtcatacattacttcaaaaaatgaaaaaaaggtattttactttcttccttacataaggagaaggactaacaattttctctaaggataagggggaaaaaacctttctaccttttaccctctgatcaggacctcttgttctagagggaataaaatatatctcacccttggaatcaatcattgtgaatggatgagttgtgtaggcaaatatagttttaaatgaaataaaattgagcttaggtgaaattagtgagaaccagtatataagtaagaaaatttttattgatttcaatatgttagttgagattttaggctaagggattgtcacaggtaggatcatattacataaaatgatgaaagtaatagacaacaatccctgtgaaaaagcttgagaattcctcatagctgcaatagagtcactgaaaaggatttatggtacttgtataggtagaagtatttccatttttctatcattttctaatattattgctaccaagcatcatttttattaatacccatgacttgctctgggtattaaaaaaattttactcctcaaattgcatggaaaaagtaactgttaattcacttttttttttttttttgagatggagtctcactttatctcccaggctggagtgccatggtatgatctcagctcactgcaacctccgcctcccaggttcaagtgattctcctgcctcagcctcctgagtagctgggattacagggtgcaccaccatgcccagctaatttttgtatttttagtagagataggatttcaccatgttggtcagggtggtctcaaactcttgacctcatgatctgcccacctcggcctcacaaagtgctgggattacaggcatgagccactgcacctggcctaattcatgtttaaataatcacaagcatatataattggaaatcagatcagcaagaaataaccagtagacaacggagttgatataaagtaaagatcaacctagtgttctaatttttattcattcattcattcattcatttactttttcatttattctcctattcatttcattatttattaattattaactagtttttatgtatcagaaaccatatggggcttatgagtttttattgtggttaagtgcaaagttcccaagagccttatgaaatattaaaagtaactcaaggcccctctactataaactttgtagattataattttttgaggggttaatacttatgtatagaaatcattgagacctagagagtttaaatgatttgccctagattgtacagataattaatggttgtctcagcactagaagccaatcttcttaattctactgaaagtagataatatgatgactcatatttattatgtaaatattatattttattataaacatgacagttcatattgactattacaattaacatgcagtataaaatatgtgttagtgttacattgttgttaccattatattgtattatattgcagatattttttcttttggtggctgcatacaaatgaattataactatattaataatatttttctttaaaaaactaaagatgacatttttaagtcctctctcttggaatctgtcattgcacttggctaaaatgtagctacagattatttgtactatatctttcgactgtaccaattggcaacaatttttctctttaaaccctaatcaatgaaaataatacttctgtgtctcagtcaatcgcagttgcttgtaaatgacctttgactgataagtttaattgaaaactgtggtcagcctagtctgtcagcaagcatgtcatataacacaagataatttgaaaaaaaatgcaacaatgcattcaatctgtggcagtagatcaggaaaattactgcatatccagtgctgaacagaagaaaaaataatagggtattttctgttgacctccttaagaaccaacctggatcaaatctacttaaattttaaaaccagatgaaatcaagtgcgttccatctctttgtagctaaacttcttaagcccctcacttttagtagcagcagactgtgttttcattacttattcatctcaggatgcacttataaatataaaatatcatcatttgagtttgttataccattagctttaaaattttataaactactgaacaggtgtttataaagttgaataagttaaggagatttattgttgtaagaaaagtgtatcagtaggaaataccattgataaacagaaaaacgaaagattgtaaaatttactgagtgcatttgagaaaaaatatatttttcaagctttcaaaatattaaagttgtcttaatgactgaaatgtgttttttaaaaatcctgtgtttaaaaaaattctaatgaaatttgttacattttgtctctacaaaaatagtcatctcacttttattttcacgcttccatttgtgaagtatactccatgcacctcaaacatttatgatgagcatattttctgatccaggatatatgtatattagaagattttttccttttttcataagaaacattattttaagcttcccaaaaaattaatacctcagaggttaaacaaggaagcttttcactgaaaaaaacttgtgaagaaattattattctagatttactttcaaccaccaaggaaacttgatgtggcagtaaaataaatcttggaagaaaatataagaaattaaaaaatgctcaaagttaaccaaaaggacctttacaggtttaattcattgaacaattattaatactaagcacctatttggtgccaagaactatgaaaatctctgcagaagagaacaaggaaagatccttatcctctaaccacttatagtcaaatgggaaatgcagccatgctaacaggcatttacaatacagtctactaaattccaccaaagggctatcataaggtatcataagatataggagggggatctaatttagctttgaaggatcaatgaaggctcctaagagagattattgctaagacttgatggatgaataaaagttagattatagaaagtttgagaacagtaagagtgttcccagcagagaaaagtacttctgcaaaagctaggaatcataattatgagaatatagtgcatcagcccactgtttagaatagatgatgagaggctaacaaatacaggcaggaggcagaattactctgttcctattttgaatctgtccttgccactatgaagaagttatcatcaaaatagaacagctagaaaaacaccattaacaatgaattgaagtcccagaaaaagtaaaaagaagagactataggaagccacccagacattctaaatgaattcaagtttgcagtcatagacaaattacattccaaggtgtcgaaaggacttacagatgtaatcatagaatgattggcagtaatccacagaaatcacagagaaggggagtgctgctagaagatgcgatctaagcaaatatcaccccaattctctcaaagggttaaaaggtagattctggaaactactagatcagcaatgttgatctttaacagcattttagaatggattactttaacaaggaattgaaatcacttagaaaataatgagacaacctctaagatccagtctgagtgcactaaaagcattcctgccaaattagcctcatttaattttctgtaggttgagtagcaggggagattttagggggttgggaggttgcaatatttgtgtttaggtagggattttgacgaaatcactcgtatgtccttgggaacaagggtagaaatatgactgaatgacagtggacgtaagcagatatgtaaagctggttgaacaactgcatgtagttattaatttgatgttagcttgcaggaaggtttctcacagcacgtctcatggctttgtctctggctttgtcttggtcacatttaaaaacccaatctgggtgaagaggcatcagtctgcaaagggtcagctaatgtactgacttttagaaacataatttgaagtgttttagtagatagaacaatgcataaaaaacagaacatggagattgtggagccgaattaatgtactgttttggtttttgccatcagttccataagaatacatttggcggggaggttttaaaagttcaactcgaaaggagtataaaatgaaattaaaaaaccgctttaggtacttcagtaaccacaaactctaacaattacaccggcttaaaaaaagaaagtgaattcaaggtaagactatgttaatagaagaacattttcaaaatgagggaaatggccacaagactgatttctaatatttcactgaactcggacatttgtcagacctatcctgagtgttacatacaggtatacacgcatggtggacggaagctatggttttttcctcaacatccattacaccttctctgttaataccagcaataaggtttgagtgaacttgacctcaccctagcttcaagagtaagctatgctcagctaaggccaatcaggaaaattccatcttcctttgcactgtaattggtttaattaatccaggcctaagcttatcagtgtgtggcattcccctggttttacggattggttcaggggtggccaattgatgtaaatctcagtgttttcttttttttcagcagttaatgggtagcaacctgcctttcttgctgaatgaggcatcatgcagcactaattactgctggcaggcatccaacagctaggagggaagtcagtctggggagaaagttaacaccgataaaagtggagcagagcaaaccactggaaaatggacccagcgctctgatggaactgtgcctaaattaccctggagtttttagttattctttaagccaacttgagtttgatttttctgtcgcctttaattgaaagcattctaagattcaagaacaaattctaataagattattgtcaaaacagagggaagccatgccataaaaaaggaagtttagaggaacttgggaagagaaaatcttaagggttgtataaattgtttagttcagtcccatggaagagggagtggattgttgttactgtttgagaattcaaaactagggctgttgctactaagttctgagaagatgaattttgattcaacataattcactgagaaatactcttttgagaatatttctaatttttagaggcattccattgtagaaagagctgtttgccaattactggaagtgctaaaacaaagaataatgaaccatctgtaagttctattcagccccaagattgcatggtattttgccatccttatttatttaaatgtaggtaaggtagttacttgtttaaaagagcttgatttctgtcttggcttccccatctaacctgagagatgttttcctcatctgaagagtgaatgggttggaatacatggtttctaatactgtttctatagctctaaattgttttgctacccaaaagaaattgctggtggtatggaagcaaggctcttggcctgctgtttctccagatagtagtaaaaatctaaaacaagataatagtaaaaatctaaaaatgaaaaattagaatagcagcttcaaattaatcacattccttctcaaagttagaatgagggattgccttgggaaatgctactcagatctaattcctgaagatattatgtgcatatttcagaaatggaaggttctattgagtgaattatcaaaaattcaatcacttaacaataatttattgagcagttatattccccagcttgtgctagacactatgataaagaaaatcttacctgtctggctttgtctaaggtagaaagtatatcataagttttcagtatagaacattctctgttatacagaggccacataacaccttccttatcctttgcttttagtactaaattcaggatattgccaaggttctctgtatagaaaagaagagaaagtgagaagaaataaaagtatcattctaagtgcttattagattgttttgagcgtcccagaaagatctcttaaatagaggctataaacctatttcatactatacatgcatgtaatattttactgaaataaataaaagatcaatatcttttagaaaatataaataggcaaaaagagggttcataaaccttctgagtgtctagctaataaattcctattgtatgttcattactgtgcaagtgctttggagtctgtgtaaaatgcagttcctgcctcctaggaggtaatactggaaaaaccaagataaaatgaatgagcttttgaatacttttgtgcacaggtgttgatctatgtggaatatgccatgagtgctgcaggagcatagaggggagatgaaaaaaaacgcagactgggaagttaatatggagagagtaggtcttagccttgaaggataggctgaaacttaaaaggcagcagagttgaaaactgctgcttaggtgagggaaaaatacttgaaaatgttcagaagcaacagatttttatatagccatgaggatactgactgtattaggcaaaagagtttgtgggaaacacggataggtattctgagatgtcttaaaaattaagcaaagacatttacattgcatagagttttaagcagggagatctagattgtttttgagcagagactaacataagcaatgtttagggaaatgtatattggcagtaactatagcatgaattggaggataaagaggcttgctaggaagtgattaaagtaatccctgtgtgagtgatgatgtcaagacatgggtagttccatgtaacaaaccagcatatgtactccctcaacctaaaataaaagttgaaattattttaaaaagagcaattgcaacaaaaagaaaaattgacatatgggacttaattaaactaaagtgtttctacacagcaaaagaaactatcatcaacagagtgaacagacaacctacagaataggagaaaatattcacaaactatgaatccaacaaaggtctaataactaccatctataagaaacttaatgcaacaaacaaaaactaataccccctttaaaaggtaggcaaagaacatgaacagacagttctcaaaagaagacatacaagcagtcaataaacattttaaaaaatgctcagcatcactaattaacagagaattgcaaatcgaaatcatgatgattttgactcatctcacaccagtcagaattaccattattgaaaggccaaaaaatgacagatgttggtaaagctacaaagaaaagggaatgcatatatactgttgatggaaaaataaattagttcaggcactgtggaaagaaatttgaagatttctcaagaacttaaaatagaactaccatttgacccagcaatcccattactgggtatatatccaaaggaaaataaatcattctaccattaaaacacatgtatttgtatgttcattgcagcactattcacaatagcaaagacatggaatcaaccaaggtgcctatcaattgtggattggataaagaaaatgtggcatgtatacaccatggaatactagacagccacaaaaaagaatgaaaccatgttctttgcagcaatgtggatgcagttggaggccattatcctaaccaaattaatgcaggaacagaacatcaaatacaacatgtgtggatgcagttggaggccattatcctaatcaaattaatgcaagaacagaacatcaaatacaacatgttctcacttataagtggaaaataaacatggggtacctattgatacaaagataggaaaaatagacactggggactattccactgacaggactagataggtcatcaagacagaaagtcaacaaagaaacaatggacttacactataccctacagcaaatggacttaacagatatttacagaacattctacccaaaagctgcagaatatacattcttttcattagcacatggaacattctccaagatagaccatataataggccacaaaacaagtcccaatacattttagaaaaccaaaattatatcaaatattctctcagaccacagtgaaaatcaactttaaaaggaacccacaaaactatgcaaatacatggaaagcaaataacctgctcctgagtgatcagtggtcaacaatgaaatccagatggaaattagaaaattctttgaactgaacaataatagcgatacaacttatcaaaacctctgggatacagcaaaagtggtgtaagaggtaagttcatagcgttgaatgcctacatcacgaagtctgaaagagcacaaaaagacaatctaacatcacaactcaaggaactagagaaacaagaacaaaccaatctcaaacccggcaaagaaaagaaacaacgaagatctgaccagaactaaatgaaatggaaacaaaaacaatacaaaagataaatgaaacgaaaagctgcttctttgaaaagattaaaaaaattgatagaccattagtgagattaaccaagaaaagaagagagaggatccaaataagctcaattagaaatgaagtgagagatattacaaccaatactgcagaaatacaaaagaccattcaaggctactatgaacaactttatgcacacaaactagaaaatctagaggagatggataaattcctggaaatatacaatcctcctagattaaaccaggaagaaatagaaactctgaacaaaccaataaaaagcagtcagatggaaatggtaattaaaaaactgccaaaaaaaatatctaggatcagatggattcacagctgaattctatcagatgtttaaagaagaattggtaccaatcctactgacactattcgaaaagacagagaaagagggaatactccttaaatcattctatgaatttagtatcactctaataccaaaaccagggaagcacgtaacaaaaataaaaccacaggccaatatccctgatgaatatgaatatagatgcaaaaatcctcaacaaaatactagctaaatgaatcccacagcatatcaaaaagatagtccatcatgatcaagtggatttcacaccagggatccagggatgttttaacatatgcaagtcaataaatgtgatacatcacataaacagaattaaaaacaaaaatgacatgatcatctcaatagacatagaaaaagcatttgacaaaatccacatccctttatgattcaaaccctcagcaaaattggcacagaaggtacatactttaaggtaataaaagccatctatgaaaaacccaccgtcaagatcatactagatggggaaaagttgaaagcattccctctgagaactggaacactggaaaggatgtccactttcaccgcttctattcaacataatactggaaatcctaggtagagcaatcagacaaaagaaagaaagaaaggggatccaaatcaataacgaggaagccaaactgtcactgtttgctgatgatatgattgtatacctagaaaaccctaaagactcatccaaaaagctcctgtaactgataaatgaattcagtgaagtttcaggatacaaaattcatgtacacaaatcagtagcaatgctatacaccaatagtgaccacgctgagaatcaaatcaagaactcaaccccttttacaatagctgtaaaaaataaaaataaaatacttaggaatataccctaccaaggaggtgataggcctctgcaagaaaaactacaaaacactgttgaaagaaatcatagatgacacaaataatgaaaacacatagtggatgggtggaatcaatattgtgaaaatgaccatgttgccaaaagcaatctacaaaatcaatgcaattcccatcaaaataccatcatcattcttcacagaactagagaaaactatcctaaaattcatgtggaaccaaaaaggagcctacatagccaaaacaagactaagcaaaaagaagaaatctggaggcatcatgttacctgatttcaaactgtactataaggccatagtcaccgaaacaacatggtactggtataaaaataggcacaaagaccaatggaacagaacagagaacccagaaataaacccaaacacttatagccaactgatctttgagaaagcaaacaaaaacataaagtgaggaaagaataccctattcaacaaatggtgctgggataattggcaagtcacatgaagaagaataaaactggatcctcatcttccaccttatgtaaaaatcaactcaagatagatcaaagagttaaatccaagatctgaaagcataaaaattctagaagataacatcagaaaaacccttctagacattggcttaggcaaatacttctttaccaagtacccaaaagcaaatgcaaccacaaagataaatagataggacttaattaaactaaaaggctgctgcacagcaaaagaaataatcagcagagtaaacagataaccaacccacagactgggagaaaatcttagcaaactatgcatctgacaaaggactaatgtccagaatctacaaggaggtcaaacaaatcagcaggaaaaataaaatcccatcaaaaagtgggctaaggacatgaataaacaattctcaaaagaagacatgcaaatgaccaacaaacatatgaaaaaatgctcaatgtcactaattatcggggaaatacaaatcaaaaccacaatgtgataccacctcattcctgcaagaatggtgataataaaaaaataaaaaaaaatagacgttggtgtggatggggtggaaagggaacacgattacactgctggtgagaatgtaaactagtacaactactgtggaaaacagaatggtgattcttaaagaactaatagtaggtctaccatttgatctcacaatcccactcctaggtatctacccagaggaaaataagtcattatatgaaaaagacacttgcacacatatgtttacagcagcacaattcgcaattgcaaaaataaggaaccaacccacatgcccatccattaatgagtggataaagaaaatgtgtacatatttaccatggaatactgcttagccataaaaaggaacaaaacaatggcatttgtggcaacctgggtggaactgcggactattattctaagtgaactaactcttcacttttgagtgagaacatgtgatgtttggtttttggaataaaataccaaacatcatatgttctcataagtgggagctaagctatgaggatgcaaaggcataagaatgatacaatggactttggaggcttggggggaagggtgagaggggtgtgagggataaaagactgcacactgagtatggtgtgcactaaatcaccactaaagaacttattcatgtaaccaaacaccacccatacacaaaaacctgttgaaataaaaaataaaaaccaaaaataaacagaaaaaaagaattggacaggaaattgaaataaattattttatattgtttatatcaagctatctagaaggtaagcagataaaagtttgcttaagttgctcttacatttaaatgttttttcatctttttgtgttggtgacatgcaaaacagttcaagcttttctctactggtttgtgttgtcacaaacactggacaccagagtatagtttgttctctctatattatatgctgtatgttatgaatgtgtttttggattatgtataagattaataatttaaactctcaatatgctgagaaatgctgaattcatcatgagaacacaataagaaagtgatgatgctacatctattacttatttccacaattgtgttgataggtgcacaattactttggggaaaagcaaaataaaactacagggatacatcctgagagaaaaacaatactgaagctagaaaaaaaacctcaaaacattggatataggttcatttggttttcttttgtttacattttataatatattgcttgatttctacatagtaaagttaattatattgtgaaataaaaaaatgattttggaaatgggcttggaataccatcccttttgaagggaagagatacatagtacaagtgcatgaatgcaggtaggttggaagtttgagggtggaaggatgaggatggtctctgtgatttctatttgctcagacatatgaggcaaaattatcacttatacaagattaagtatgtgatgtttcaggtttgtagagaaagaagagtaagtaaaatttagttatcttatagtctaggaaagagaactgatttagtaaaaggtagttactaggtggtgctgaagtttgcttttataaatttaaaattatcatgacttcatctttacttcatgttcagctgcacagaattatgaggtaggtgaagagctaaattcaacctggattagaatcctgtcaagaaagaaggattgagaaagaaaagggcaaggaaagagaaggagtgtgcaaggacatgattgtaatcaggcatggaatgcaagtgagtgaggaagaaacgaagcatgcagaacaatcatgggagtggaggtgctggagtctataagtgggaagatgaaaggtgttatttgagatatttgagagtgggatttgggagatggaacagttattggcaatgacaagatgaagaggacatccaggagagtgcatgaatggggaatggcatcaaggaaccatgaggcctaagtgttgcattttcttcccatctattgaagtcaccaaggttgatcacaggactagtaacagaggaaaaaaacaatgatctcagagtgatatggtttggctgtgtccccacccaaatctcatcttgaatttccacgtcttgtgggagggacctggtgggaggtaactgaatcatgggggcaggtctttcctgagctgttctcgtgacagtgaataagtcttataagatcggatggtttttaaaaaggggaatttctcctgcacaagctctgttctcttgtctgccaccatgtgagatgtgcctttcaccttccaccatgattgtgaggactccccagccatgtggaactccaataaacctctgtgtgtgtgtgtgtgtgtgtgtgtgtgtgtgtgtgtgtgtgtgtgtgtgtaaattgcccagtcttgggtatgtctttatcagcagcatgaaaacagactaatatggtaagttgataccagtagagtggggtgctgctgaaaagatgccccaaaagggggaggcaactttggatctgggtaacaggcagagtttggaacagtttggagggctcagaagaagataggaaaatgtgggaaagtgtggaactccttagaaacttgtttactggctttgaccaaaatgctgataatgatatggacaatgaaatcaaggctgaggtggtctcagatggaaatgagggacttgttgggaactggagcaaagatgactcttattatgttttagcaaagagactggtggcattttgcccctgccctagagatgtgtggacctttcaacttgagagagatgatttagggtatttggcagaagaaatttctaagcagcaaagcatttaagaggtaacttgggtgctgttaaaggcttcagttttataagggaagcagagcataaatgtttggaaaatttgcagcctgacaatgcaatataaaagaaaatcccattttctgaggagaagctggctgcagaaatttgcataagtaatgaggaactgaatgttaatcccaaagacagtggggaaaatgtctccagggcatgtcagaggtcttcaaggtaaccccttccatcacaggcctagaggcctaggaggcaaaaagtggtttcatgggctgggcccatggtgcctgtgctgtgtgcagcctaaggacttggtgccctgtgtcccaggcactccagccatgcctgaaaggagccaacacagagctcaggctgtggcttcagagggtccatgcctcaagcctttgcagcttctatgtggtgttgagcctgccagtgcatggaagtcaagaattggagtttgggaacctccacctagatttcagaggatgtacggaaatgcctggatgtccaggcagaagtttgctacggggcagggctctcagggagaacctctgctaggacagtgtgaaagggaaatgtggggttggagcccctacacacagtccctactgaagtactgcctagtagagctgtgagaagagggccatcgtcctccagaccccagaatggtatatccactgacagttgcattgtgtgcctggaaaagctgcagacactcaatgccagcccatgaaagcagccaagagggaggctgtaccctaacaaaccacaggtgtggagctgcccaagaccatgggaactcatctcttgcatcagtgtaaactggatgtgagacatggagtcaaaggagatcattttggaactttgaaagatttaactgtcctgccagatttcagactttcatggggcctgtagcctctttgttttggccaatttctcctatttggaatggctgtatttactcaatgcctatactcccattgtatctaggaagtaactaacttgcttttaattttacaggctcataggtggaagggacttgccttgtctcagatgatactttggactgtggacttttgagttaatgcagacatgagttaagactttggggactgttgggaaggcatgattggtttttgaaatgtgaggtcatgagatttgggaggggccaggggtggaatgatatggtttggctgtgtccccacccagatctcatcttgaattcccacgtgttgtgggagggacctggtgggaggtaactgaatcatagggcaggtctttcctgtgttgttctcatggtagtgagtaagtattacaagatctgatggtttttaaaaaggggagtttccctgcacaagctctcttctcttgtctgccaccatgtgagatgtgcctttcaccttctgccatgattgtgaggccttcccagccacgtggaactataagtccattaaacctctttcttttgtcttgggtatgtctttatcagcagcgtgaggacagactaatacacagaactgagatcatcactgcatcacaggccagcaagtgatgggaggcaatatgacagagtctttaagaagatgaacgctggagccatacttccagggtacaaatccccactctaatacctcctagctgtttgactgtgaatatttcacccaatatcccagtacctcaagtgcatcagtagaataaggataggaacatatgtaactcagagtgttttgtgaatattaagtcagatcgatgcctggaacagggtaatcattttgagccctgacatgctcgaattttcagattaagagtgaacaacaggtatgtacatgcgaatattccaaaatccgaaaaaatctaaaataggaaacacttctggtccctaggacgagataagggatattcaacctatgtaaatgttagttgctgtcaactggtagtgtcttcagacgggagtattttcggtgtgtgtatgtgtgtgcatgactatgtatttatcagggagcatatagaaattagcaaggaagagcaagaaccagaaagacataaagtatggttgagaaaagagccatcacttgagaaggcttcaggggcagctgtgaccgtggggagggccaagtttcagtgagagcccaaaggtaacaagaatgactggaaaaaagacaaagatataacagttagctgcaagcagactatgagtttcagaagccacaaaacaagaatttagagtggtggggaggagaggaagaactgggtcagatttaagggcatatatagaaccatgtagagataagtgtcctcatcctgatggataactgggagggcagcgctggtcctgccgagtcaggtaaactaaagagattaggtatgaggaccttggtcctggttatctttcctcctgagaccaagtgtcatgtagtttttcagaagatggactgtggagcttgcaaaaatgaacaaagttcttctgtggcctgtgtaaagtctagaggagtcactacctagcagggaggccagaccacttctaagtaaaagaggggaagttaattattattattattagtgctgaaactgaatcctaacagctaattccggtccccaagactaggtcaaaacctctttataagttttcaaagcacctaatttcttcttcaaagcacatatcataatagtgatcacataataaattgtatattcatttaatgactatttcccctcacctcttttattcactgatagagcatcagaactttgcatgtagtagtcactatagctaatgcatatctatgtatctgtatctctatttacatatataactatatcatctgtcttttagtgggttttatattaggggttaagttgccaaatagatttatttggcagtgatcatatctaatttcaaacatttgctctctaagcctggtgcctccatgttacttatccagggttaatgaaggctgtgtttggaggagcagcccagggaagaatggaattcagctctacagttatcttgcaggctttacttgcagcatctttatagactttccgcaggagaaaaacaatggagacttggcttgaggaatgaatcagtccaaattattgaaacttgagtagcagagtaggcttaagctagtatgaataagagtttgcttgggatgtccttttcacagttgaattcaatagacaaagattctttttacattatctggaattgctcagtggttatttcattttttgttcctcaactagatcatacctctctagtgacaggagggagtgtcacttgggctgcaggcagccaagccttgtttggccaaagccaagtagtttcttgttatgctatgtgagctatgtttgggaaaatcagactggcattatgtaataatacataaaaaaggccatcttgtggtcaaggtgctgtggttaatgggtgagaaaacaaggttgcagaccacttgccaccctgttaatagggcctcctggaattaataaggccgtgttgtcagggcataggggcataaacgcaacaccagttcatttgttgctgcattccccatagtacataactgtctacagcagctatggtgtacacgttaataattattttactcagtgaccggaaatagtctatttttttttcactgtcatactctcagatagctgccgtagcattgcttttttgcacatgtagtagcacacttggttgaaactgatttttggagttgggaaagctatcaggggactgctgaaatgaggcagcttgtggtattttcccctcctccttacccctagttgaattaatacccaatttaacaatttaaacaagtgtctgagaacctaggagagaatttcaggaaaagtcaatagtgctttgcaaatagctggggtccagtgaagttgaatcagtgagctgagcaagaagagggaaacacagattcagagcaaatacaggaaggtggggaagaaagatagcaggggtaggtagggtggcagcaaaagagtaaggaatatcaggatccttgagacctgcaacaacttgcacatttgacttagtgtcctgttcttttcaccctagcttggcctgttatttggctgaaatctgtgtcctaaagcaaacattttaggtggggttgatagtaggatcccagaaaatctttacgtagaggctggatttaaatccactctgctctcttattcccacccatttaatattgtcatgcttcctgacaagttataccggcagggactgaaaaggaagactgacctgctcttggccttttcctcccacatccactttttgcctgcacaaatagtacataaacataatgcttgagaattgcaaaatgttcaaggtgatttttaaaatacagctataaaatggaaatattcaaaagcattttatgttgtcttagactcttgagtaaattgtgctgtgtgataacattttttctgtcattactcttggaacacaataaccttctttctggtctccttcctgccacttgtacctctctccacacaacaaccagtgattggtatggactgaatgtgtgtgtcccccccgccattcatatgttgaagccctaattcccaatggggtggtagttggagatggagactttgagagctaattataattaaatgaagtcataaaggtggagccttcatgatgagattagtgtttttataagaaaacacaccaaagcgctcttgtgctctctctctctctctctctcatacctgccatgaaaaaacacactgagagtgaacagagggccgtctgcatcatgggagagtcctcctcaccagaatctgaccatgttgacaccctgatctcagaattccaagctttcagaatatgagaaaatacgtttctggttaaacctcccagtctatggttttatgttatggcatcccaagctaactaatatagccatctctcaataatgtacattatatctgaaactttgaaactttcccgctgaaaaccttttaaggacttcttattactcctggaataaaattaaaatccttatcatagtctacaaggtgctgaatagtctttttttttttttttctgagacagagtgttgctctgttgcccaggctggagtgcagtggcgccatctcggctcactgcaagctccgcctcccgggttcacgccattctcctgcctcagcctcccgagtagctggtgtagactacaggagcctgccaccacacccggctaattttttagagactgggtttcaccgtgttatctaggatggtcttgatctcctgacctcgtgatacgcccgcctcagcctcccaaagtgctgggattacaggcctgagccaccgggcctggccaaggtgctgaatactcttctcttcaacctcatctcatattgtcccatgaaaagccattttccaccacagaaactttgcactactcatccctgcctgcaatgctcatctttcactgcttattttatttatttgccttataaatatttctagttactatgccaattatatacataactttctaaatatgtttttattgtttgtctctctatgtactgttacgtaatgaagaacataaactgcatgaggacagatatgttgtcctttcctttcaccgatgtgttccttgcacctagtacagcattggagacataacaggtacctataaaatattcatggagtaagtgattactagcctagaattctcaaagcattttttaaatttttttattattatactttaagttctagggtacatgtgcacaatgtgcaggttagttacatatgtatacatgtgccatgctggtgtgctgcacccattaactcgtcatttacattaggtatatctcctaatgctatccctccccctcccccgacccgacaacaggctccggtgtgtgatgttccccttcctgtgtccaagtgttctcattgttcaattcctacctatgagtgagaacatgtggtgtttggttttttgtccttgtgatagtttgctgagaatgatggtttccagcttctactcacttccttctttgattcattattatagttttgttttctttagcttggggttcattataaaacatatttacctttcaattccacatttttaattaaacatgggctgctggtgttgttcatggctgggaataatactgtttatataatatctagtatttcctcacatgtatctagaaggcttctccacaataataacttttaacctggaaaactgaggcccagctttgagccctgaacttagagggggctaccctggccttccaggacctcacctctattcaatgggtcaggagtccatggatccaagaggatacactcacccaggacctgcccactgattttatgaccggatgccaagacacacagaactctagaatcccacactcaaatcacccaagcctgcttctaggtcttacaggacctcttttttcaagactgggtccagcatgtaccacaccccttggcctgaggagtagctattaccataggtgtgagcagagtctagacaagtatactggggtgtctgcatgcctctgtgcaaggcaggacagaccaagtgtggagatgggaagagaaatcagcctgacaatcagtaattccagaatctgtcagacagacttggccacaagagtaaagaggccttgggctcaggcattcaccccaagacatttgctgagttgttctacaagcttggagttggaataaaaaagaagactagtcatggaaaattaagataagaaaaaaatgaagaaaatttgctgttaataaggaagttttaagagctaaagaagccctaaagtaaaaattatattactaggagaatttatttgtttatctattaagtttttttggctagagtacaaagatttttaaaacactacaagtttcatatattaccttttctcacgagccaattcttgaaaaggtaaagaaagttagttacttcctgtttcttcataagtattcttgaagaatttaatatagactagaaagtgatttttaaaatgctttgtgccaatcttccagaagttctgcacagttgtactgattgcctctgtagatataaaatggcaaagtttgtgactcgaaagcaaaatatagacatgttctgatccttccctgaacgcaccttagtgttaacggtcagggtagaaggatggctgtggatcaattttcatggagtagctgttactccctgcctgaggagacatgaaagcagccttttaccctgaagtaaaagagcagctatcttgatttatatccactcccttactttactctggtttatgctcataagtaaggaatttaagctatatagaatatgtatcccccaaaaaacagaatcatagaaaaaatacagcatataactaaattattgttacatttgcattttaacagaccttaatgttattaatcttaaaattttgttatggataacagctatcattgtacatatttaaaattgtctaactagagacaattggctttgatattacacaattgccagttagaagtccttagaagttttataaggatagagaggtaaagtaattcttaaaatcctgaatgaaataagtaaagataagatcagaaaggtaaaagtgaattcaaaaaataaaggggctaaacagaaatacaattggatctattgatgagggcaataaaagtaaacgatgcaaattatctttgaccaggctgatgggatttgaagtgttgaaaagtatctcttcctttctttttattaaaacaaagaaaacaccttcctttctctgtctgtaaacttatagaaatgcatgtgatcagataggaaagagagtttgacagtcaaaatgttgattgaggcaaggacaatatggttcataggttttactaatggaatttttaaaaatcaaagtcttcaatgaacatttcacgcacattcactgttctcaaagttgcccaagtatacaaaatcatgtattagattcattgagctacactgcaaattataaattagtattggtttgtataattttcttgtaagatatggtatttactttatcttcaattagtaaattcagagcctatacatgtgtagtgaattctgtttatagggcacaaaaatctaaacattaaaatcttgaactattacatggtagggtttggactaagatgaaatggtagtgaaatgggtatctttgataatgttacataagaagcatcatagagtccaacatttttcatactgaaaagctattttcaggtgatttattgccaatctggtgccttctctctgccaaaaatttaggtgcttatgtgaacacatatacaacaccaaagtacagatcggagaattcacaaggaatgtcatccccaggaaataggcaaccatggttggcattttgcagagcatattgaaagaaagtacaccttaaatttcagtatcggatggatatcagcctaaaactataggaccatataaagactgttggtgaaatctgaagtttgagcctttctgatagagagactgaaattaggcaccatttaatgcaaattggtatggaacacacacatatatagattatagactcagaatatgaacattcagacaagactagttttgagataccggttatctaatgtgaatggcctggaagttaataccagaatcactctggatatcatttgtagttttgaaaatctagccagacttattatcattcctaataaattgtgcatagttcttatttcatgttgtggaatgattattctctcgtaattttgagtttaataaaaaataaagtcctgaagaaaatgatctcaaaaagcaggtatttataaagagagttatttatctgggtaaactcactaaaattttagtgagtatttgggtgctcagattttaaaatcaggcaagaattattccagctgaatggtgtttaaatagaataagacttattattttctgggtgtgttttacctaatcctggaatgcatatgataagataggctgtagtctacagtttttgcacctaaaatcattcagactttaacacaatgaagttgccttttcattcttgatgaacatccgttaaattcagagtcacagaacaagataatatcagaaagaagtggccgggtgcggtggctcacgcctgtaattccagcactttgggaggccgaggtgagtggatcatgaggtcaggagatcgagtccatcctggctaacatggcaaagccccttctctactaaaaatataaaaacttagccaggcatggtggcacgcacctgtagtcccagctactcgggaggctgaggcaggaaaatcgcttgaacctgggaggcggaggtggcagtgagctgagatcgtgccactgcactccggcctgggcgacagaatgagacttcatctcaaaaaaaaaagaagttgtatcatttttctgtggggcaaaattaaaagttgtatatattatcacttgggaagactgaggctgggagctaattgttgagtttcctaaaatacaatataaatatttcttatggagccttttaggatatctcaggtgatcagattatgattactaggcaaacgcaaaagtaagttttaaaaacattcttcttcctgtttacaatggaatttaattggtctgataaatcatgtatgtgctatcaattctctttcttattgaaaatgggtcaatacaagtatatgcagttttaactccacaattggacagataaaatgttacatgtaaaatattaaacttaacaaacctaagcatcagtcatttaaaatgcaagtagctggccttgttgaaccattcatattttcctaaatccaacatattctctcatatcactttgcctctatacaagttccttagaatgacctctctcctctttctaatttagctaattcctgctcatctgttaaaactcagctcacccatcacattctccaggcatccttctttatcatccttctgcccatgtcagttattccagtttggatattctctttctgtgtttccataaccttccaggcttttgtctgttataacacttatcctccaatactatgttcatctttttgtttttctgctttaacagagaataccaaatgaatcttttaattttaaattatcagtgtaagcagtgccagatagataataggtgctcaatactaggtgcctaaaaaattaaagttagtagaagaaattttgcagcatatggagtgatgtcagaatgcaagtgattcagtttttgatagactttgatgtgttggaaaggagaaacatcaattgccatcagtgaaaacgtcttattactagtcatctggaacagttcatatttgacgaacctaatgagtatagaagctgcctaaagagccctctatcagatgaaatggacagccctcttcaaccaatgacattgttggtctgagggctagttaacctaaaaaggtataaaataaaagactgttgaggcaagattctgaagcactctatcactatcataattttcccagttaacatatttttagtgcctattctgcatcaggtattgtattagtccattttcacactgctataaagaactacctgaaactgggtaatttatgaagaaaagaggtttaattgactcacagttccacaggcttaacaggaagcatgacacttggaggccttaggtaatttaccatcatggctgaagttgaagggtaagtaaggcccttcttcacgtggtggcaggagacagagagagtgaagggggaagtgccatacactttaaaaccatcagatctcctgagaactcactatacttgaaacagtaacgggaaaatgtgcccctatgatctaatcaccttctacccggcccctcccctgacacatggggattacaattggacatgagattttggtggggacacagagccaaactatatcaggtatccataagcattttttgtacatcatttttatttaatcattacaacttaattgaaataggcattggtatttcatacacactgcagatgagaaaattgagaatttgggaaaataagtaagttgcttaaagtcacacagtaacagaatttaaatgctggtctatctctaatgcccatgatcttcactgttcagctattctgtttccattagatacagcctagattattcattggtgtttcatttccctacttattgtcaccatcagttattttctgactcttccccttcacagcagtgaaccctataactgactgactcctcaagcaccctcttccagtgttaatctagcagcaggactaatttatcaagactggggggaataagaggaaagtttgatcttctcacttgaaactcctactctcaatcctccatttccttctgctaaatattcattatgcagaaaggaacacagaattaaaacaggaggaaatgaaatgggtgggtgacatgatttggctctgtgttcccacccaaatctcatcttgaattgtaatcatccccacatgtcaagggcagggccaggtggagataattgaatcatggaggcagtttccaccatgcgttctcgtgatagtgagtgagttctcacaagatctgatggttttataaggggcttccctcttcactcggcactcattctctctcctgctaccctgtaaagaggtgacttccaccatgattgtgagtttcccgaggcctccccagccatgtggaattgtgagtcaattaaacctcttttctttatggattgattacccagtctcgggtatttctccacagcagtgtgagaatagactaatacaacggagaagagaataaccttaattttgctttttccatccctaatcctaacaccatcaccacacttcttctactgaaacacttacaatgtgattatgtgatgaaaagaaaagagacagagatgagaaaaggaaatcatgtggaaaatatgatggtaaataccatcagcattttttcttccatctctaccagccaaatccccctaactcccaaactcacttatcccttgtataaataaacatttctattgaagtataatacacagtgtacaaatcataaatgtattttaataattttgtacaaaatgaacacatttatagtcaccacccacatcaacaaacagaacagtatcaacacattatgaattgaaattgcattttcctggtgattaataagctgcaacaactcagatatttaatagtcatttgaatattttatttagtgagctgtcttttcaagtcttgcctatttttaaaattgtgttgcctgtcttttattaacttgtaagagtgataaacacacacacacaaacacacacatataacacatatatgttatatgtattgcaaatattttctttcccttatttgtttgcctttgaagagtattgtctttgatgaaaataggatttttaaaattttaatatagttttacataattccatataattttttagttttctgtaatccatgaaatgttaatgtaatccaactcataaatattttttctaatgattagtacattttgtggtctgttgaagaaatctttgctgcaaaattatgaagatattctcttatgttatcttccagaagctatgttttatctcatgtaaattttgatctataatccatctggaactgatttttgagtgtggagtgaattgtgtgttaagaatcattttttcttctgaatatgcaattaactcgttattattttttggaaaagccctcctttctccacagcattgtgtcatctttgccctaagtcaagtgttagtagtggtgacaatctgctgctggactctattttgccctgatttaattgtctatccaagtgccaatgccatactctcttaatttatgtaatgtcttcaaattttgttctttttagaatagcttggctaattgagactctttgcattccattagtcttaaaatctgattgcccatttttacaaaaatataaacaaaacaaaacactttctagaatttttacaggaattgcattaaacacataagccaatttgcagaaaactgaaatctattgaatactgagtcttccaatctaaacacttggtatattagtaacctctcagtttttgtaggtctctttagtgcttctcacaataatttattgatttgcatatttagaacttttatgtattttgtcatttcctacatattttattatgctattttaaatgtgagtttttagttttatttcttattggtggtacatataaatacctttgctttttaaatactgttcctctgtgcaaagacattgcttaagttgtactgcttttagtaatttatctgtatttacgttgggctttttaatgtaaaaacatgtaaaccttaaataaaagttttatttctttattttccatttttgtactttcttccttcctttttccttccttacctccttctccccactttctgtcacttttccatctctcttctccttgttcttcctcttctcttgctctctctttttctctctctgtatctctctccctgtcccttccttctttttcattttttttttgttttttgccatattgtactagtagaaaccttcaaaatgataatgaatacaaatggtaatagggtacattcttatcttattcccagtcccatgatgaaaacttttaatactatagcattaaatataatgtttattgtagatattatttctacaatagacatcatctacaatgattagatatctcttctaatcataattttctaagataatttaattatggtctgtaatcatttccaatgcttttcctgcatcttttgaggtcttcatagaattttcctttttattttgctaatgtgatgaattactttaattttataatattaaagcaaccttgctttctggaataagttcaagttttttgtaatatagtttttaaagtatatacatttgaattttatttgttcgtagttttacaaacattgcattatatttataaaatatattgacttgtaattttcctttcttataatgaactagtcaagttttagtatcaagctttcattagccttaaaaaataattagaaaaattttacttatgttttttagactagtttgcatggatggtactatctttcttaagctgctttgaagaaataactattacattgtctggttcttacatttctttgatattgttgtaaatttttagttccagtttcaatttgttgtaagctctttatagtatttttatattttataataaaatctgtaaaataaatctacctgtttgtttctgatgttagtaattagtacctccttccatatgtaatttcagttgttcatttttatatgtagggtatcagttgactttcgtatattgactttttatcttgtgaaatttcaatgcttacgtattaattccaagatttttttttgttgattctatagaatgcttttccacaggcaatcatgtcttctatgaataaagacagttttatttttttcttctcaactaacatgtatttatttcattttcttgttttattgcactagctatgaccttcactgcaatgttgaatggaagtggcaagaaaggatat

SEQ ID NO: 206 - DNA, 11917 bp, Homo sapiens
aagatagagactatgactattttgcaaattcccaggactcaggagggagactgaaacacagcaggtactctacaataaatattttttgaaggagtggatgggtggatggacggatgggtggatggagatgggaattaattgaatgaagcccttcaaattgcaattgttaagtctaggacaaaaatctgcatttgagatatggaaatgggaactttaatttattatgacaaaattctgaatcttgctctctggttcacaatttcctcccgtcttaaagaaaatgattggatatttaagatcatttctaggtctaaaataagatactttgataatatgatgacttaacattttgagtcttatgtttagctatgattcatctctgaaccagtaatttggaatgcatttttaataataacaatattaattactaactgacttcatgcattagttagctaaataatcaaaataacatttctacaaagtaagaatcattaggtgcctctttatccaaatgaagaaactgaggtttattcaggtaagtaacttgtccaagagcacagaggtgggcatgatagagttgaggctatggatcaggtctggctcactctgattcccatgcctggaactgttgtctattatttaacacaccttcttttataagacatttgtgtgtaagaggtccataacttgagaagaggtacaatgttgtttctttacagctaggccagtcaccagtgttgctgacctggacatagggttaggattaggaaattccatcaagcataaaacaagacaaagatgaatatcttgtgtcaatgtgttcaggattcagccacaaggcaagagagcagataacagggcagaaggaattaagagtacggggcagtttgggtggactgaaggtaaaggcaatttgaaattttggacagtagccagaaatcagggcatatagaagaacaaaaaagatcagaacaatagcaagcaagagagcagagctcatgatagtgtccattgaccttaatcactggagcagatctcttctggtgggatttttttttaatcattgcatatagcagaaaccaattttcgattgcaggtctgggaacagcatgaagaagcagaattggcggctccaagctaactggggcaggggatcagtagcagctgcgggtgagaaactcctgacaccttagcataccttcttagcgcttgagagtttcactatctgttcagtcccttttgcaaggggaaattggttctgcagcatatatcgtagcttcccagctggaagagtgcaatgatggattgctggagtccacacaactgatgggttctttcttttttcccctgtcaggaaaaagtgactcacggcaatcatatattggtgtcatatacataactcttaccctccctgcccttctgcaccacccccaatatactaactcaccattggcataaatctacttttgtaattctacattgcaagttcctggtatttgcaagatgctgttctaggtggaggagatgaaaagatgaatgagatatgattcctgcctttgaggagttcacagtctagatgggagaaaggcatgcataaaccaataatcatagctaacagatatggagcacttatagcaaggcagatgctattatacttgctatatatattagctatatatattacctcatttaatcctcaaagctaccccataaggtacgagtcttatcctcactttatagatgaagaaactcatgcacagaggggctaaataaattactcaggatcactcaactaataagagttggaacccagaattctaaaccacacaatgtggccacagggcctgtcttgtgaagatgacatactgccttctcataaataaaaaattactgagtacaattatcagagcaagaattgagacatacagaaaaggaaaatgaccacatgaaaagagtaaagatttgcaatgagtagagtaagtgggattatgttgactgtcataggacttttaatatacttttcaatttttctggaccttaagttattcatggggagaacaatacatatgttcaggtgttattgtaaagataataaagactgtatagaaaatacctaccacagtgcctggcatattagatatttaataaatgatgcttataattgaaatagtggtagttgttgttgcttttgttatcactgtgatgttgtacataagtactgtagggacgcaaaggaattgtgactgattctgtctgaagagggaaggtggttgaggaaagatattgtgaggcttggcataaaaggtggcatttgaactggaccttgaaagataatcattttctagacagatgaagggaagaaatgcattctaaatagagacaacatgtgcataacatatgtggaaaataccaagtttttgttggtttggataaatcatggtatgtgtgtctgcatgtgtgcgcgtgtgtgttgagagtggctggagatgacactataaagatttgaagggcacacatcatgaaaaccttgcaagtcattgaatttagccctaaactcataaaatatgaaaagttatatggtaactaactcagcagtgttttggatccctctaaactagttttttaatggaatgtttccttttcttccttctaaatattttaaaacacaataatactgctttataagacaattatatggtgttcaacagctggccaaactttcagtttcattttactctagagttactatgtgtacttctctgtctatcaacaattcatgagcaaatcagccagtgtcagaaatggacgatgaagaataaatgtggcagaaatattccatataatgacttgttggaactgttgcctttactggtcaccctacttttgacccagacataaattggcaaagacccattgctcaacatttagataagaaccctttttttttttaaatttcaactattagtttagatacagggtatacatgtgcagatttgttacatgggaatattgagtgatgctgaggtttggagcacagatcctgttaccctagtagtgagcatggtaactgataggtagtgttttaacccacccactcccaccctctagtaagccacagcatctagcatctattgttctcatatttatgtccatgtgtgctcagtgcttagttcccacttattagtgataacaggtagtatttggttttctgttcctgtgttaatttgcttaggattatggcctccagctctatacatgttgctgcaagacattatttcattctttttatggctacatagtatttcatggtgtatatatccacagttgctttatccaatgggatgatttcatgtctttgcttgtgtaaatagcacagctatgaacatacgaatgcatgtgtctttttggtagaatgattttttttaatatatacccattaataggattgctgggttgaagaacccattttttgactgttgttaaatttaattatccctgtgaagggtaataagcagtatgtgtgtgtctatgtatgtgtctttgagtgtgtgagtgacaaaattcttgtttatataaatattgtacacacttgtttgaaaccatctgatgtctcactttcccagcactaaaacgaaatgaaacaaaagcacaccaataaataaataaatacttggccaaaaagatactactttttgggacaattaataagtaaaataagcataaaagttttttgaagaatgaagaaatagaaaaacaaaatgctattatttcctttggtctttaggcagaaggacaaatccaactacaatgattttgtagccttatctaaaagccaattagggggaacctccatctgctctcattgctaacatagtatagtcaagacgccttttgaacaactgtttgactcttcagcagttattgctattgtagctgattctcatcactttcttttctcgcatgacccctggaatatacaaatgatcacatagtagataattgtatacaattgtttatttagccttccatcagaaacatcattgttactattgttttaatgaaaattaccaaataatcttaatctggattattcaaagaatgccttttactttgaatgaactgagttttgctgtagaatgccttagtgaagaaagttattacatatggttctttgtgtttcctttgcttaggtttgcagacaagatgaattattttaatttttttcttataagttcatcaggctaactctttaatcatttttattgcccatctcatctcagttatattaaatctaattttcctatatttgggtacattggtaaataccaaattatttttaatattcaaatagttgtcccatcagaattatataaacagtattttactgtcattgttaagtgaatatttaacatgtccagttctcaaataccgttttcatttttgactccattacattgctagtaaagtcaaatctgccgtaaatggatggtacattctttctgtccattatacatgacttgcttttgcttccactgagtgaattttaaaaaattatttttaccaattgtactagcctgatttttcaagtataaggtcatttttacttacatataatccttcaaaatcatttatctaccttgtcataatgcatgctaacagcacccttcaattcagtatcatctgcaaatttcattaacatattgtttactccctttccaggtgattgatgtagatattaaatatgactatagttaacatcaatcccttcctaacttggttacaaatttcttcaaaataaaatagcatttttagtattactcctaatttgtagttcttcaatcaattttgtattctaatggtacgagaatgtttaatgcaagttaattttaactttgaaagtctgtctcagattgctaaaataaaacatgttctgctttctgtatttctcacattaagtaattctaattctctaaaaattgtggacaacctcgttaacctgtaaaagtaatttataaatccaagttatctctgaaacatgatgcaatcatcttggggagacttgaatgtctacaaaatttctctagggctttataatatcgctggtctgagaaattccattaatgtttcatttggaaatgttaactcctatgaaactagggtattcttgtgtttttttttttttaaatatactttaagttctgggatacatgtgcagaacgtgcaggtttgttacataggtatacatgtgccgtggtggtttgctgcacccatcaaccattcatctacagtaggtatttctcctaatgctatccctcccctagccccacatcccctgacaggccccagtgtgtgatgttcccctccctgtgtccctgtgttctcattgttcaaccccacttaggagtgagaatatgcagtgcttggttttctgttcctgtgttagtttgctgagaatgatggtttccagcttcatccatgtccctacaaaggatatgaactcctccctttttatggctgcatagtagtccatggtgtatatgttccacattttccttatccagtctattattgatgggcatttgggttagttccaagtcttcgttattgtgaatagtgctacaataaacatacgtgtgcatgtgtctttatagaagaatgatttataatcctttgtgtatatacccagtaatgggattgctgggtcaaacagtatttctggttctagacccttgaggaatctccacattgtcttccacaaaggttgaactaatttgcactcccaccaacagtgtgacagcattcttatttctccatatcctctccagcatctattgctttataactttttaatgatataacgccattctaattggtgtgagatggtatctcactgtggttttgatttgcatttctctaatgaccaatgatgatgagcttttttttgtatgtttgttggctgcataaatgtcttcttttgagaaatgtctgttcatatcctttgcctactttttgatgggattgtttttttcttgtaaatttgtttaagttccttgaagattcagggtattagccctttgtttaagtttcttgtagtttcaggatatcagccctttgtcagatggataggttgcaaaaattttctcccatactgtaggttgcctgttcactctgatgatagtttcttttgctatgcagaagctctttagtttgattagatcccatttgtcacttttggcttttgttaccattgcttttggtgttttagacatgaagtccttgcccatgcctatgtcctgaatggtattgcctaggttttcttccagggtttttatggttttaggtcttatgtttaagtctttaatccaccttgagtaaatttttgtataaggtgtaaggaaggtgtccagtttcagttttctgcatatggctagccagttttcccaaaaccatttattaaatagggagtcctttccccattgcttgtttttgtcaggtttgtcaaagatcagatggtcgtagatgtgtggtgttatttctgaggcctctgatctgttccattggtctatatgtctgtattgatatcagtaccatgctgctttcattacggtaactttgtagtatagtttgaagtcaggtagtgtgatgcctccagctttgttctttttgcttaagattgtcttggctatatgggcacttctttggtttcatatgaaatttaaagtagttttttctaattctgtgaagaaagtcaatggtagcttgatgaggatagcactgaatctataaactactttggacagtatggccattttcatgaaattgactcttcctatccatgagcatggaatgttctgccatttgtttctgtcctctcttatttccttgagctgtggtttgtacttctccttgaagaggttcttcaaatcccttgtaacttttattcctaggtattttattctctttgtagcaattgtgaatgggagttcactcatgatttggctctctgtttgtctattattagtgtataggaatgcttgtgatttttgcacattgattttttatcctgagactttgctgaagttgcttatcagcttaaggagattttgggctgagatgatggggttttctaggtatacaatcatgtcatctgcaaacagagacaatttgacttcctctcttcctatttgatcatgctttctttctttcttttgcctgaatgctctgatcagaacttccaatgctatgttgaataggagtggtgagagaggacatccttgtcttgtgctggttttcaaagggaatgcttccagcttttgcacattcagtgtgatattggctgtgggtttgtcataaatagctcttattattttgcaatacctttcatcaatacctagtttatttatcatttttattatgaaggtgtgttgaattttatcaaacgccttttctgtatctatctgttgagaaaatcatgtgtttttttcccactggttctgtctatctgatggattatgcttattgatttgcatatgttgaaccaatcttgcatcccagggatgagtctgactttatcatggtggaaacgctttttgatgtgctgctggatttggtttgccagtgttttattgaggattttgcatcaaggttcatcagggatattggcctgaaatttactcttttgttgtttctctgccaggttttggtatcacaatgatgctggtctcattaaatgagtgagggaggactccctctttttctattgtttggaatagcttcagaaggagtggtatcagctcctccttttacctctgttagaatttggctgtgaatcctggttctgagattattttgattggtaggctattaattactggctcagtttcagaacttgttattggtctattcagggatttgtcttcatcctggtttcgtcttggaagggtgtatgtgttcaggaatttatccattacttctagattttctagtttatttgcatacagatgtttatagcattctctgatggtagtttgtatttctgtgggatcagtggtgatatcccctttatcattttttattgtgtctatttgattcctctctcttttcttctttattattctggctagtggtctattttgttaatcttttcaaaaaacaagctcctggattcactgatttttttgaagggttttctctgtctctatctccttcatttctgttctgatctcatttcttttcttctgctagcttttgaatttgtttgctcttgcttctctagtttttttaattgtgatattatagtgttaattttagttctttcccacttgctcctgtgggcatttagtgctataaatttcccttgaaacactgctttggctgtgtcccagagattctggtaagttgtgtctttgttctcattggtttcaaagaacttatttatttctaccttaagttcgttatttgcccagtagtcattcaggagtaggttgttcagtttccatgtagttgtgcgcttttgagtgagtttcttaatcctgagttctaatttgattgcactgtggtctgagagactgtttgttatgatttcctttctttgcatttgctgaggagtgttttacttcgaattatgtggtcaattttagaataagtacaatgtggtgctgagaagaacatatattattttaatttttggtggagagttctgtagatgtctgttaggtctgcttggtctagagctgagttcaagtcctgaatatccttgttaattttatttctcattgatgtgtcaattattgacagtggggtgtcaaaatctcccactattattgtgtgggagtctaagtctctttgtggtctataagcacttgctttacatatctgggtgcttctgtattggtgcacccactaaatatatattggtgcatatatatttaggctagttagctctttttgttgcattgatccctttaccattatgtaatgccctttttgtcttttctgatctttgttggtttaaagtctgttttatcagagactaagattgcaacctctgcttttttttgccttccatttgcttggtaaatattcctctatccctctattttaagcctatgtgtgtctttgcacgtaagaggggtctcctgaatacagcaccctgatgggtctcgaccctttatccaatttgccaggctgtgtcttttcattgtggcacttagcctatttacatttaatgttaatattgttatgtgtggagttgattgtggcacttatcccatttacatttaatgttaatattgttacgtgtggagttgattaacattaaatgtttaacatttaatgttaatattgttatgtatggagttgattgttatgtgtggagtaaagacagtgcagtctttatgatgctagctggttattttgcccattagttgatgcagtttcttcatagtgtcaatagtctttacaatttggtatgtctttgcagtggcttgtactggtttttcctttccatatttagtgctttcttcaggagcaaggcaggcctggtggtgacaaaaatctctcagcatttgcttgtctctaaaggattttatttctccttccacacttatgaagcttagtttggctggatatgaaattctgggttgaaaattcttttctttaagaatgttgaatattgtcccccactctcttctcacttgttagggtttctgcagacagatctgctgttagtctgatgggcttccctttgtgggtaagtaacctgacctttctctctggctgcccttaacattttttccttcagctcaaccttggtgaatctgacagttatgtgtcttggggttgctcttctcaaggagtatctttgtggtgttgtctctgtatttcctgaatttgaatgttggcctttcttgctaggttggggaagttctcctggataatatcctgaagagtgttttccaacttggttccattctccccatcactttcaggtaccccaatcgaacgtaggtttcgtcttttcacatagtcctgtatttcttggcggttttgttcattccttttcatggttttttctctaatcttgtctacatgcatgatttctttaagttgatctttaatctctgatatcctttcttcagcttgatcaattcagctattgatgcttgtatatgcttcacgaagttcttgtactgtgtttttcagctccatcaggtcatttatattcttctctcaactgattattctagttagcaatacatgtaacattttatcgaggttcttaccttccttgcattgtgttagaacatgctcctttagctcagaggagtttgttattactcaccttctgaagcctacttttgtcagtttgccaaactcattctccatccagttttgttcccttgctggcaaggagttgaggtcctctggagaagaggcgttctggtttttggaattttcagcctttttttctcctcatctttgtggatttatctatttttggcttctgatgctgaggactttggaaaaggtttttgtgttggcgtcctttttgttgatgttgatgttattactttctgttagtttttcttctaacagtgaggcccctcttctgcacgtctgctggagtttgcgggaggtcctctccagaccctctgtgcctgggtatcaccagcagaggatgaagaacagcaaagattgctgcctgctccttcttctggaagcttcatcccagagggtcacccaccagaatccagctggagctctcctgtatgaggtgtctgttgacccctgctgggagggtcaccccatcaggaggcatgggggtcagggacccacttgaggaggcagtatgtcccttagcagagctcgaatgctgtgctgggagatctgctgctctcttcagagcctgcaggcaggaaaatttaggtctactgaagctgcgcccacagccacatcttcccctacgtgctctgtcccaggaagttgggaagtctatctataagcctactcaagcctcggtagtggcagatgctcctcccccgaccaagctcgagcatcccaggttgatttcagactgctgtgctggcagcaagaattttaagccagtggatcttagcttgctgggctctgtggggatggaatccactcagctataccacttggttccctggcttcagccctgtttccaggggcatgaatggttctgtctcactggcgttccaggtgtcactggggtatgaaaaaaactcctgcagctagctcgctgtctgcccaaatggccgtccagttttgtgcctgaaacctagggccctggtggtgtaggcacccgagggaatctcctggtttgtgggttgcgaagactgtgggacagcatagtatgtgcactggagtgcactgttcctgaaggcaggctccctcagggcttcctttggctaggggtgggagtttcccgacctcttggacttcccagctgaggcaacaccccaccctgcttctgctcgccctctgtgggctgcacccactgtctaaccagtcccagtgagatgaaccaggtacctccaggtacctcagttggaaatacagaaatcacccaccttctgtgttgatctcactgggagccgcagactggagctgttcctatttggccatcttaccagccacccaccctcctttttttttttttttttttttttttgagacagagtcttgctcttgttgcccaggctggagtgcaaaggcacgatctcagctcactgcaacctctgcttcctgagttcaagcgatcctcctgcctcagcctcctgagtagttgggattacctcagtagaattcagttgggtatttactttattctaattttacttgccttctaatgtaaatgattatataaagtatttcttccagttggtgtgtatgg

SEQ ID NO: 207 - DNA, 133 bp, Homo sapiens
ctcagcataggaaccaacaatcagctgcacctgttgccaattaaagtattaatggcacatcaatcaaagaaaaatcactgggaatggagattacacaagctctgtactcacatcattttttggaagtcatcct

SEQ ID NO: 208 - DNA, 5805 bp, Homo sapiens
acttcactgactttgtcctttacattgacaagctagataagatgatatcgttttaaataatcatttgcgtttaggtatttctctggcagttttgtattacagtttaaaaatagactagcctatgtctatggctcatgttggctatggtattttgaacttgatttctgaggctgctgacagcttttgaaagatttaacaactggcagcaagaaaaacttccatagaatctcttctctgaaattttttctgctggaaaaaagggcatcacttagcaggtaatatattgcaatgaaaatatggttatgaaataatggctcattaatatgataaaccataacataaccttttctattaaatgtaaaaagaaatttcttgaaatgaaggcattttccttcctgtggcatatttttccatagttgttgatttggaagaattttttaaaattattattcaaaacagtcattttgatttgcacaggagataacagttgttcatgacatttttatttctgcataaacagatttccattctggcgaaggttaatacagtaggaatttgtttttacttttggatataccgtgatacactagagcactttgttttgtatggaaccactaatttatcctttatgcctttacgatcttgtcagtgccgcatgtctcccttagtttttctaatctaaaataatcccagtgaaatcctttgattgtctgtttggacctgctccattcctaaagcaggaatgtaatgggctttatggcacttacttgggagtaatttatccagcagagtgactatagatacttgttttaataagaatatgctttatggtaagtgggtactgctatttaattagccaaagggaaagtagttcatgatacaatctgtcccaatcatcttggacattaaacaaaaagtcaggctaagttatttatgtgcatgcactttatttgtagttgctttgagcaaacctcttctttgaaactttatagcattttctgagtgagctgaattgtgggaggaggaataggggaagaaaaggacatgagagcattctataaaatttttgaaaaagaaacagaagctttacttattgctatcaaggttgtgaatacaggcataccaaatggaaaacaggcagggaactatgatttatcctctgctatttggtagtttgcatctttagtgcatagctgatggaagaatgttgcaggatgtcagtaagacattatgggattgtgtgttcctgtgtgtgtgttttccttggatttccattgctttcagcagcaacatgtttctgaagattcacaattatagtcctatatttttattataaataactaaatttaagaagttcaatgcatatccaattatttcaatacttaaagcaaagtgtaagcacgtggatacattttaagaaatcttcccttcctaataatactacaatgatgatataatgggggtaagtaatatgaatttctaattgtccaacagtttgggcatgtaagtaatattaatatatttatggatgaacggggaaaaaagaaaaagtgaaaaaaaaatgagacaatatccctagggtattacagccctggttatggtctgctcagtaattacatatttgttccctttcttaggcgtaaatgtctcagtcactgactataagtacaaagggcccagaagctggaatctgaagacaaacatggctccactacattttactctcattgccttgggaaacattacttaaaccagaagaatctattgccctctttacttcacagtgctacagagaggattacatgagccaatatttgtgagtgccctttgtaaagtgaatgtctagtgtaagtcagcacttgcttataaagctccttaagcataagattttggttatgaccatgtttgcacatgcttgcgcgggaccttctatatggttgaggcttcctaagtggagtctgggtgaaccagtcttctgtccgtgcccttcttgcatggtgcacaggcattttgctcctatttcttatacctctattattttgtctgtattacatatcttgcctttttcaaagttaccatgaaaactaaactcaaactaaagggctttaattcatgcagtttgtgtctgccatctaagtaacaaaagcactatcttttcacaattgacctatctctcagcagtggcacaaaaatgtggtgcatggactagagtcctaaggagtgcactgtggatgaaggactctgaatggccatccaggtggtcagtgttaagtgctaccctccctacactattgtgtaatctttgtataatttccatcttaccctcagctttactttgccatcagtatgctctctctccctctcccttctgttcacctgggaaatcttttaagctgctaaacaaaagccctaagaatggttgcatattaagttattttagacagcttggggaggttatgaaaagttttggagtcattagcatttcaacaattgactgccccactgtccccgtctttaggaaacacaggcagtgcagtcggcccatgaagtgaaagcctgggtgagcctgtgtttagtacttttaacgtaagaagacagaaaaggaaatactaaagaccgaactttccttcaactctgtggtctcacacatccctcagtgacttggaaacttttctgacatgagacagtgtgcagagcaagataaccactccccttcctcctcctgaagatgtgtaaacagctggtgcatgcaatccctctggctggagggaagtaaatgcagactgatgttaaacaaatataggccagtatcaggaactcagaaaatattacatatacaatgtgacaaggggccctgcagggttcatgatcattgcaggtattaagggtcaagagttggggtgtcagagccaataattttttttaaggctatgtatttgtttcttgtttggaattacgttggttcttttgctagagttttcttagcatgacatcacacaattgtgaagaatgttcatcactataaagctattataattcctcatttttttgttggctttaattctcaaattttatatacctacaagtcatgttactttaatcacatcttgagaaatcaatgagacgtcactttttccttcaacccatgacacttacgtgagctctggataggaataaaagtgagtggggataaaagcttctgttaactgtgcttttctcctagcaggcacatggtgttccaagttcttggctatttcataggaatcttgaatacacaattatgaactaattatcaatgcctgattcatcaagtaacactcatgacatgagtctgagtggcacacatctgacagcaagtggagtaaactaaacacactgtccctgtcctccagaactgtgtcagccttgctgatattaaagcttgataagccacaatcatctttgtcttgtgacatggtagctactcaatcaatcagttgacaaaactgaatgagaagtataaaataaaacagaaaatcaagcaaacataaagcataataggaacaaaatagaagggccaatttctcttttatcatcaactttgtaatgctggaagttctgcagtcctcagggtctaagaaaagtggagtaggcgtctatctcggtatcaggatttatacttatatttactattatggcattgaatggcttacttttgtctttctcaccagactccaagttcctgtgggcagatctcacgtcttatttcttcttttatccccacacattctacaacttctacaagatagatgctcaatcatggtttcacaatggatgaatattaaatgaatgaacgaacacagctcagtcaggagtagaactaatatgcagtaaatcctacttgtatttttcaccttagtgaggtcacttcacaccccagatggcaatctttcctatataaataagcttaaagaaaagaaaactgtgttataatcactctcagaagaaagttcagccaaaaattgccatattaagatgattagcttgtatgtaactgagtatcttaggaataattcatgtcctgtgccagttggtgagcttctattcttcttgcttgcagacccttattagagattttctaacattttttaaagggaaagggtgaactataaattatagagattgaaaatggtaatgattctatttgtattattattcataatcataacccaattcttaaggttctgtaccaaggattcacaatacatatgaatatatatgtacatatgcatatatacacacaatctaaactctgttctaaatgacttggtaaaacattttgctgtttctttttctgggagggcaagcaaaataagtcataagtctgtctgagaagctgttaggcacaatctttaaaagctttaattcttttcaaagcatacttgcatcaattacttccttcctctcatatcagcatggaaagtagacaggacaggtagggagcataacctccttttttctgagagaaaactaaggttcatgaacccattcacttggtcctcagcaaattcatatagggcactaactatgcataagctacaggagttgctggttttacaaagtaaacatggtttcccttcgagtaactgacagcctatttgagatagcattgcccttggaatcaggtaaccagggtctctgcactaggcactgagctttagaaggccctacctgccctctctgactgcaattctctccatggggcaaggaatccatggagccaaggagatatatatacccagactttgagcaatctatcttcccatctccccccacctctagaccacacactaggtacctgagactcagaattccccacccagtggggaagccctacttcctgggcttgtgaagcacctcttccccacttcaccctcccaaggacacacattcaccatgccaagggttgagagagaaggttggagagagctccaggcaaatgtagtaacaggcctgagaagaggagatagagaagtcagcaattacaatgctgcctgtggtgatatggaagtgaacagggaatgctagggaaaggcagaagggacacccagcccaaatgaggcatgaagaaggagaaagagatgggagcaaaggctgttgaaaaagaagctgagcctcggaggctgggtcagaactaccacatgaggttagaaaaagaaaggagggcattttagaagagtgaaagaaaggtgtacgcaaaggaatggtggaggattaatggaattgcaagttcttctatgtgcttgaagaaatgaaaaaagaggggtagaaaataagttgaaagggagagatggacaattaatgatatttgtcactattcattttactttcttatggcgctatgaacctgattttatttggaagtagtgacttctccccatttaataccattcggtggactaataatcaggtgccctgctttctccttgactagattcaagagaaatgacaaaaagactgagaatctctgaggtccttgggtttccagaggtattcctgcaaggaacagtcaagcagcatcaaaccttcagaccttctgaaacagcctggttcctcccagcactgggtctggttctgccgccctcctttccaacatgtcacgtcagtcatcctcccaacaaattcagtagttggttaagcaagccatatacagtgttagttgactgaaatcaaagctctatagctaataccagaggaaagcaaagttctgattttcataaggttttgaatgctgtgctatggattttggactttattttgaaggca

SEQ ID NO: 209 - DNA, 76415 bp, Homo sapiens
gctcaactaagcacttggttcaattgtgtcatcaggacattggaaagtaaagaggtaagcttttttttttttttttttttttttttaagattgtgagttttctttgtcacaaaaaggtagcttttccacaatgatcttatgccttggacttagccaaccaaggaagtcttccaggatggagtgggtaagagcagagaaaaggcaaatgggcaatgctctgagctgacgaggttcaggatgtgcttgcctacaatataacaccttgacatattgaatattgtaagaaggaatttgagaaatggtgggtacaggaaggactctgtgactgtattagtctgttttcatagtgctatgaagaaatacccaaggcttggtaatttataaagaaaaagaggtttaatggactcaaagttccacatagctgaggacacatcatgatcatgctggaaggtgaaggaggagcaaaggtgtgtcttacatggaggcagtcaagagagcatgtacaggggaactgccctttataaaatcatcagatctcatgagacttattcactattgtgaggacagcatgagaaaacctgcccccgtgattcaattacttcacaccaggtccctcccatatgcgagctactgttcaagatgagatttgggtggggacacagccaaacgatatcaatgaccttcccctgaagcaggtcagaagaccttcatgtgagaggaaccctttctatactgggatgaaaagcacatccttatctctgaagatggaggaaggacaagagaaacctgaaggaataagccttgctaagtttccttcagtttactactcatagctgatatcctttgtcctatcacatttttccacaactctccactcttcatcaaacttactataaaaacacttgggtttaactgtttcttctggtcttcatttccttatgaagtctcctgtgtcacataaaacttatattgaataaatgtatatgattttcttttgttaatctgttttataactgagaacctagaagggtagaagaaaagatattttttctcccctacagggccactcaggggaaagggtcagatatcttgcagtccctgagagtggtagctactgaatcagccctataagttggtgacagaggtggagagagagcgagaagagtcctatagcccatttcattatttcatgcatacatttatttaacagatatttggtaagcaccttctatatactaggcactgtggtagcattgggcatgccagacgcttcagcactctgcctgctcccccatgctgtgtggaggtggccaagaagctgccccgtgccttgcttgtctcttaaaggctctctcaggtcaccccaagttctgccacagtggctaatttcccaaactgctttgtggagatagtcttaccatggggaagaaaaaataaaaagacagaaagcaaaaaaggctgatgaacagtgcactcttcatatgaaataaataaatatctctacatacatatatacatgtaaacatatataaatatgcatacatagtatactcttcataaaaaatagacaaatatatatacatatatgtgtgtgtgtatacacattagtctgatatcagtctgatggtctagtccaaactgtcattacaaatttatggttggacttctaacaggcaaagagcatactggcacagaggactaagccgttgagccatcattgttggaaatgtattgttcaggacatttgctaatttattgatgcagcagcagagttagaatcagattcacgcgaagaataaattggaatattttggtgcatttctttaaaaaaaaaaagccactttaaagcctatgtattaaaatgacaaagtcttaaataggggtctctttttctaaacaaaagatatgcaaattgcaattcaagatttatattatgataaaaactgaaatacaaaagagtcattatcctgcaaaatgtaaaagtacattgcttcatgagtctataatgatataatgggatgttgatgtagtaagaggtgtcagaagggagacaatgaccttaaaattttaagtcagaaacattagaattgaagagtaagtatctacctacccacctaactacccatctatctattgaatactgcactttttgaaaatttgagatgaagaatagtctatttttatcttctaatgttgtagccataattggatggaggaggggttgggaaattacttttaacataaccatttctactctgaaattggataaaaatttaccttgaattttaggtttataggcctgtttctcataaaaatcagtggtgtgttaggaagcttggagaccatttctggcctagccatagggccagtgccttaacatcaaatgtcagtgattccaatgctccctgcataagaacgacttgcagttagtttgcagggcctcccactgtttagatgatcacagtcatttccaattggtcattgtgtttccctgaaggaaggtgggacaacttaaaaagactgtattagaacagcatagatttattttatcaaatcgcagagaaactccagcaaacagatatttagctgtggttccaacggagacacagtttaagtaatcaagtgatacaccacatgtgaagcagatttacaggattgttctctctactaaacagagcagaatgtctgctttagctttatttggcagaaatttatatacttgcttcatgatttgatcttaacttaaacaaaggacgttggtctcagccaccactgatttcagggcaatagctctgtctaatttctgaaaggcatcagaattgtgacactttgaaaatcagatggttgcacagtgtagaagtatcttaaatgtttatttattgttttagtgagccaaaccctcatttttttttttctgagggcgcaattgattacactgaaagttgtaggcagaaggatctgacttttatacaaatgtcagaaccttcgcaaagcaattccaagaacttcaagacacaccccaaaaagccaggggctccaaatgaggcctaagaaaatactctcagactgaactcctgatgattttccagttcagaacatggctgagggtcttctgtcacggcgagctcatggtttatgattttggaggctgtgcaatgctcctttctatttcatcttgacttaatgtcattagtcttccttcacagaaacctgagcgttcattttctaatctatctagatgatacgctgacagcatttcccctgatcgagactttaccatttatgtctctgcctctgttaatcattttcagaaatgagatttatagtaaaaaggattaaatcaattctgactacctccaaatttctaggatttcagggattcttgatgaacacagaaaccatggccccttggagaggctttattaagaagatcttttttgcctttgtgagccggcctttcagaactagccgtctctgtggatcatagcaagtcaacttctctatgttttgtttggcaaccacaccacagaggctcccctctgagcaactcaagctgtttttgattggaaatagattagtgagctatcaattttcttctcctttattctccatctttccttctttctcttcttcctagtcctaagatgagtacccttaggagacgtgtcagcctatttcaattaagtgtttatcttttaagtttctcatcatggggtaaattatgacatttttagaagccagggttgaagagaaaaattatacccatccaaactaaatcacagcttatagcttattttcttcctttctaatttctctaatcttcagcttacttcaaataacatcactactatgcatcaggctttgtgcaaagcaaggagctttcacaaatataatcactttccttctttcttctttccatcattccttcccttttctttttccagatacactcgactttccttcactgaacatatttttacatcctccctgaaaaactttggctctcctcctcttatactcactgggacgtaagtacaggcatagcattccctgactttctcccaccctttttttaaacactgcctatctcatgaggtgtgctgtctcagcaaaatgacagtgatcacactgatttatctttgatcatgtgtctaggtgatcagattctgtgcctttaagttcagctgaaccactacttactcactgatagttgtcctaagctatctgctcctgtgtcattccatttgctatctcctccagtctagagtaggcctgcatttatataacctccttggtttggtttcctatgtctgtccctgttctcagatccttggtctaggtagacattttggcttccctagctcttatccttattgctacatagattccaggtcctagaatgagaactgcaaaccttctggactctccacttttgggggccactctgggcaactatcagaaatacaatcaacttatacccacagagtctttccccagtaccatcctactccattactgtagggcttgccacagtccccaggtttggagaggggagagtaggtaatgtgctacacattttgcctcacacatttttgcctcaatttagaatgtcttattttcaccactgtgagctggcccatgtctgtatgctctaaagtcactttgccatctctctaatctccagtgaagactaagtgtttgtatatatagaatttgcataccatacacacaaagatttcagtgtccagaatccctggctatggatgcctgtgctgctgctccatggtaagaatacttggaaatggtagatacatccttcaattttgactgagacagtatggtgacgtgcacactcccagctctcctgtcaccatgccctctgctagtgtctagggactactaggcaagagccagaagttttactcatacaaaaaaagtggattttggcaacactttaatatatgaaaggttaaaaaggaatttcacaagtaatagacagggtactttacccccttgttagttgataaagagggatttagcaagtaggaggagactaacaaatattactaacttatagtttcaggggttccatgactcagatcatgcccctggggtgctcagtatcatccataatcacaataagcacctgctgtatgcacaggaccctctacaatccactgaagatgcaaagtgttataaaagatgcaaaatgctgtaaaagacagctgttcctttccaggggatttggatgagtccaaagagaacactataggcttaaaagatagaaactatcataaaacagttgtttggacaataagtactaaaagtgtttcaaagagagtacaatgactgcaactgagacagtcaaaatggaactttactggggatcacagccagcttcatgaatatgagacctgtgtagtctcaaggaaatttaatcttgttttaattctctgctcttgtcattttgagattcttaataatttaatctttgaatttgtgttttataagcaaagtccaaagggggcatgcgcatgagcagagaagatacgtacaacatgcgtgtcaatctctccttgctgccctatttgcatgtagtattcacaatgccctgtgagcctacagttctggtggacctacaagatgtgggagttaagggagattcaaagcaagtacagagttaagtgtgttgtatctatgacagtaatttggggaggaaggggtggggtaggggggcactgacaccctctagaggccatgcttttcattccaggagaattctggttagcttcaaaaacagaccacagaaagaaggcatggagttctaagaaacacaaacaattaaggaactctatcggatcctttctacccatgtcaattctgtgcattaatcaatcacttatgctggaaacgacgacgtggaatgaaaggagatgataggccaatccatagttccttttccttttagtctatccttattcactagtaagccaaaagtagagtgttaatagaatatacatgtgaaatattttgcgtttgttttgcatttgtttattttcttatttagaatgacattaaacagaaaataaaaaagaaatcatgacaattcagaagagagaccatagaagacgggaaagcattttataatttagtacatttaatagcacttgtttcctgcatttcgaaaaaggcctccaaattttcactttgtgctgggccccacagattataaagcactacctaatggtcttgatggaaagatggaaccttgagaagccaagatcctctgtaggaagtaatatctttgtgacctgaaatgggtttccctgatttggtctatgggtatcaaaacggaaatgtgaatactcaaaagtacttgttcaatgccaccatgtatcaattttcttctattgattctaattttagaaagttaaacctatcccaaatgtttgatgaattctcaattttcttctcttcttgttactctatgttctctaatttttaatatattcagctcttagaccttcatctgtaattgactttggggtaaaatgtagaaccaggaaaactaagtgttttcaatttgcaaaatactcctttaagaccttagctgtctgctgaaccatattaagactcctgatttttatttgtaaactccttataaacatttctttggatttctatccatttccattccccttgctgtccacagccctgaacactgcttgtattctactactcttctacctgggttctcaattccaacccagcaaccacctcagtatctcctttatggaatttccctcttctactcttgagttacatacatcaccctttctacctgggataatctcatatagtatgattactcctatttctcgcttacctcgttaagaaaaatagagattcttcagtcttactccacttcaccttaactacagattcaccaaaaagaagtggaagtgctttataactacaaagcacaatacaaatatagtccataacattaatgtcattttcattatattaattacagttaatccttgcttagggctctctctatgccggacagtgttctaaacttttatatatattaattcatttatattctcacaacgacccttttaaggagttactagtatttctcacttacagataacaaaacaggcacagagaggttaagtaacttgtcaaacaggtaataagtagtggagggggaattccaactcagcaatacccttgttatgccttcctaaggagagatgctgaaaagtgtcataatgtcattcatagcttagtatgcaataacactgataaattaacatgcatttacaaaggctctacttccatattcccaagaggaacggggaagcagaactgaataatctttacatcaggaattgcctgtcagaaaaatccacccactctttgactctatgattttgtcttgttccattttattttttaattttggagaacagacttctcggggaagtcagattttactttgattttccacccgagactggagagtggagagcctacatgcctttgctgtctcccacagatgcttattctagctgtgtgaccaccagctacatgactgcactgcaatccacttggaacttcctagcaggaccacccagaagctgcagctggtgcagagtatgtggccgcctggcctgtttacatgagaatgtgagcctaagaaagtggacagtacctgctttctgctgtcagccaaagccttcattcccctggaaagacccagtgtgtaatctagagacattcataggttttagccctaactattctccagacttggaagtgttcccttcccaatgttggacagcttctcccaggatgcttgtcacatgccccagtccagtggagccagctgtagctttggaaatgtgggtcagacagactccaaatgtgctgatcctcagatagcccactttgaaagagccattttctcatacaaaaactttccgttgaatcatatcctatgcactatctcaggcttctcagagagcaacaacacttaacttgtaagaaaaaaaaaaaaaagaaagaaagaaaacatgtccttaaaacccttgcctgtatcttttgtgggcagccaagttcatgcctggccaccaccccaggagggcctttggcaatagtcacagctgaaagcctttctagccagatgaataacagtgtccggaaaagctgacctgggggctgagtggtgcctctggaagcaagttttatagagctgttagtaacgcctttatcacactctttaggtaacagatttattgctgaacaggttatcttacgtctatgtttttgtaaatcaaatcctttttaaaactttgttttggaactctttagagagctcacaatttaaagaatttttgtaatggaacattttataaaatcacgggaataatcactccttcagacatctgcttccagagtaagttcagattttcaaagataaagttgccttaagttgagggggaccggtattaacagctctgtcccgtctactttgtccttttaactaggccactccacgctctctgttgcatgctacaaacaggccctggggagtagagatgaggagtaaagcctagagataaatgtcacaagcggttgaggctttttctccaatgttaggcacagagcacagattcttctgaggctgaaccttgagaggaaaggcaaactaaaatttattgaattagtactatgtgacaggcatttaatctcacaacaacccaacaagggaagaaggaaatgataatactcagtgaatcctactacctactgggaatgaagctggtagctttacagtatattttttcatttagtctttataattagggttgccatacttagcaaataaaaatatagggtgtctagttaaatgtgaacttcagataaacaataaataattttttagtgtaaatgtgttctgtacaatatttgggacatatttgtatgaaaaatatcattatttatctgcaattcatattgaactaggtatcttgtatattacctggcaatcctacttatactaatcctaagaaataggaattattatttccattttataattgagaaaacgaaaactcagagtcattaagaaatttgcccaagatgttaactaatgtcagagttaggataacagtctcgttctgtttgactctaaatcctacatattagcaactataccagaaagtcccctcatcctagctaataaagaggatcagtttttagtcagctaaataaaccaccttaagtaaaagggctaagttcaattttaaatactatttattaatgatctacctggtccaaaatcctgtattggggctggagagaagaaagaatatactgccaagattatttaggaaccagggccagccctcacataaaaacataatgaagtggataagatggttgagagagaaagaaaaggaaaacagagggaagaaacgctcaacatgttactcgatctcacgtttttaaacaggaacatttgtgttacagttgattctgctctaaaactttgaactaatggtgaggtcccctgtacagcatcttatgcgagaagcggtgttaagtgagggaaattgatggtcatcctcagtgtctctgaggaagaagatcccttcttgcaggagatcagcatctgcctttctggagtgtccccagcaccttgagtttgtggctccaggtcacatagtgacttttagggtcctgcagtggtttggctgtcacatggcttacctcatggatggaccagggtgaccttggcacggctgtctagtgaggagattgccccttccttccctcactgcccatagctgccagcttgtgtgatgaaattgatcaggaaagcttaaaaagaaggcagaatccaaggcagcaggtatgagaagctcaaaaaataaaatagtatcatcataaagtaatatttgagtagctcatttgtgttaagcattgtatcagctgtgattcatgagcattattcccaaatatcacaagaatacaataaggtaggaattattatttccatctcacggatgggaacactgaggctcaaagatgttaaggtacatgctgaaggtcacactgtgcacatgaatgtctgctctgaaaccctgctcttgtacagcactgagctctctccttaaaaagaagggggcgggtgggtgcgaaggaactggactccttccctccatacaggcagggaaattcacactaaacagcaaggggaaagaggaaatgcagaacctcagtgcaaaggagcaggcctgaatgtagtaccattctgtcttatctcttaattgaagccaggggtatacatgcccacttctgtagctaacatcaaaaatagaaatcaacactgtgcaaatgtatatctaatggtatagcttacagtatgattccctttccccatatcattttacaaaatagaaaagattaggggaaagaaacttagaaatggacacagaaacaaaaaagcatatatatatatatatattgctattatagtaagggcctttttaaagtcgaaattctgttttcgataagaaaagcttttaagaacttttttatgtagcattgtttatctgtatttatagtcaatttattccttcactttgcttctcctatactataatgctaagtttcccttcatattttcccaatggttaacattctgcttctgaaaattatccattaaaattttatcaattttgtattttggtgagacagtatgaggaaatgccattgtgaaattagattttttctttgacatcaggcgcccagtcagcaatccaatcccatgtgtttctattgagacattagggtttgatataattttgggcagaaaacattttaaaaatgaaacaattgaattttctagatggtcttggggaccacttagcttaagagaatacacttccaaatcaaaagcctttcaatcattttaaatattatttggatgatatttgctctgtgtgtagtagcagtttgaatttgtattgaatgtttgaccggctcatgcacacatagatgatgtatgaaattattatttcatatttttctagtgtttgcattgcaagtgacatctggctgacaggaacttggagaaatgggatacgaagtgaatgctgcagttaccacaagcatcatatttatcaaaaggtttaaggttggcctgtctttgtttaacatatgaaacttggaacagtgatggggaagcgctatgttttggtgttgcgtgcattttttaactgagctttttagtaaaagagtagtcggagaataaacactaattgtattatttgttctgctcatgaaactaaatattatacattctaattttaagaaaacagacttaaattctgtttaatataatttccatacattttgcctttattcagagaatttgcagatttcatattagaagaacatacatattgagcactattcatcattactcagaaaaggcgatgtgggaggaaaaaaagctcaacctaatttttagttttattttctaatttgtaaatgtgcaaaaccgaagtaagacatgtgaaaacatagtacaatatttgcaagctctgaatctgctgtaatacacacatacgaatatcagcattttcctattctcccgttcttggaaatcatggggcaaattattaattaagtcatgaaaaatatcattcatttaacaaagatttatgagcctgctatggcctgtggactacccaggtgctggagatatgcagaggaattcgacaacccctgctcttaataaactcacagtcaggtgggaggggaggtcaatatgaaataactaagtacaatataaggctataaataccacaatatggaagcactgataaaggggagtagatggtccatctgccacagacaggtagggaacagaaaatgcaacataaaagccattgtgaaatcctcttagtgtatccaagtaagactcacttattttttgaaataggaaaatagaaagatggtgaaaaatcatcccagctcttatcacctaaagacaaatactgtgaacatttccatctagtgttttctcaatcactacttttttttagttttgaaagtattgcgataatactgcaaatatgccaaatgtatgaaaaaaatactaagctgctttcaaagaaaacataaaatgtcatcatttaatggatgtccatgttattttaaactggatattgtccatataacaatgtccatataaatccagttgattgtcaataccataaattagccattactctattaggatgtttgccttgttttccatctccctcaaccaacaataaattagtgacttctaagaaaaaaggcattcaggagaagagcaagagatctccaatggtgggattcctggcaccaaagtaagaggtgaaaggtgtaagtaacatcttacccttttcaacatttatttcaacatttattcggcatctactactgtgctatgtactttgcatgtgttaatttgtttattgccacaggaaccctgattcaagtgtagtatagtgaaaataactgcggttttacctggagtggagttcaaatttaattcccagctttgtctagatgcatgatttccaaatttagttaatctctctgactctcagattcctcacttatgaattgggcaatattattactcatttgtttaataatattatgcccatattaggtatatatgtatattatgtgtatggtatcttgacaggcaggaaatgtaagatgagtataacatgtctcatgtctttgaggagcttacagcctcatggcagagtcattcttgggagtgggtctgacaggtcccaggagacatattcttcctggtggagtagcatttggtctggatcttaagtaaggaggagcaggttttatctcacggttcttcaaccaaaatgttcattttctgataatcaatcaatcatgtgcccagtgttgtgcatatttgttctgttccatgttctgaataagcttaccaactagtttcagtcttaatgcctagaagaatgtggcttccgatttataaattaatacactaacctatttaagaaatgattgtgttggttcagaggtgattggtttctaccagagcctttctttctaaaagatgtgctcagccttgtaaacagggggtcctgttgctctatcagtaaccatctttggacactgtattttaaaaacctcattaatctgaatacaactgttactgttgtatacctagaatacctaggtttcacaaatggacaatggtattgagcaatgcacagacatactctgtaatcagatttgggactgcaaatgttaagtccctccctgctaaaaattcctaaatctaaaattaaagctagaatactcagacctaatggcaagttttcaaatgttcataatttagcaatttaaaatgtttcagaaaccatgaaaaatgtcatttgaaccaaaaagataatttagcaaatttttgtcttccttcttctaccaaaatttcatgcaaaagtgtatctgaagattcaacaaatatgggaaagtaaatatattttcaaattttactaattaactacaattttaaaataaaactatctacaactcctatcttctgtaatgaatcaatggtgtatcagttagctattgccataaagctgctgcataacaatttgctccaaaattcagtggcttaaaacaattcatctattttgcttttgagggttgacttaactgggatttggctggcctagactgatcatggctagtgttggctctatcccatgtgtctcttgtcctcttcttgggacttttggattagttagacatatccttcttttagtgatggcagagtcaccaaagattgagtccaatcacccagtcatttttcaaacatctgcttgcatcacatttgctgacactgtactgaccaaagtacatcatttagccaaagccagagtcaggctggatggggcactgcagagttacagggcaaacagcataaatgcggggagtggggaagaagaggggctcttagggtaatctaccctaaatggctgtggcatttactacaaagaagaatggagtctaaattcagtgggtttttattttttaattatcatgtatttaaagccttctgtattccaggcattgaatttttacctcattatcttcctgcaagcctacaaaatatatttcaacatctcaattatgcagatgaagaaatggaggctcagcaatgttgagtaacatgttgaagctttcatggctgatcagtggctgagtctagagttaaatcctgtctggggactctgggcttcagcttctgttctttctactatgtaatgatgactcttcaaaatttcaattgtaaaatttaagaacaaggagaaatttttaaaatctcatctaatgtccttattttgtagatgagacaacagagcctcagagagatgatttttcatatttttatcttactaattaataaaaaaaatctagtgactagaacctggatctcccaattcctcattttcctcattattttatacatatttttgtcattgatcatacatttactgagtacttactatatgccaagcactgtgatgatcaagtgttctattgctgaaatcgtatcctgattgtagaaatgaagagaaatagaaggtcatatgcatgcctactatgtgtcacagtgggtgtctttgttttctaaaatttaccaaaaataaagttctgaagtcctgcatcaatctatttctaccaaaatataggacaggtttttctctttggccctgatcacattctacatttcacagaggccaagttggtcttggaggctgcaggagttgcgtaggcagctggagtctcactgctgctcaaggtgggcatctagctaggtttggcagctatgtaacaactctgaaatcatacagctgccaggccccacctgaattagaactgaccttaagatggattttgtaaaccatttaaatagatctctccttttggaaagttttcagagttaaaaagaagaaaacaataaaatgcctccaattttcagaccctccctctgagatctgcttcatgcagccttcatgctctccccagcactgaatcattatccccagtgggttctaaaggcttaagactaatggaaagcaagtaaaacgtggcttagagctgcctgcatggaacgagaaccgccctctccatgttgctgggctcattgtattagccctgggagacagaggagggtgtggaagaaatttggaggcaaacctggctgggtatggaaggtgttggggcaaatcacttagtgtttccttttcggggagaaaaaaaaaaaaaaaagcaccatccaggccagggcctggcacgtagcaggtgctcaagaaatagttgttgaatgaatgatgattgaattagactgtctcccctacttctattgcttatctagttatgtttctcttgattttggagaaagcttattcagagacttagtactgcatggaggataatgctttaggctctgtgtttaatcattcaaacaatatgtttgagtgtttactgtgttccaggcattgagggcatgatggtttgcaaaaccatatgtaattgctactttcatggaacttgcagtccaacgagataaatcagacatggattttgaatccttactctgtcattcactagctctttaactatggatggcttattaatttctttgtgcctcagtttccttatatataaaaaactataataatagtacttaattaaatttatatacataaatacaaaacagaatattgtctgctctttaataagcactgtataaacgtttgtgaatatctcatatattactgggaggattagatatgaaaatgcatgtaatgagctcagcatgatgtgggcacatatgaagaacctctcaatagattattattaacctattatgggtagccttaagcattctagcaattctaaacttgatgtagaagaggtgggatgtggtggggagtggatcagagggagagtgatgttaggtctcgtgcaattaaaaatctactttcttttttttttttttttttttttgagacagagtctcactctgtcacccaggctggagtgcagtggtgtgatctctgctcactccaatctctgcctcccgggttcaagcgattctcctacctcagcctcctgagcagctgggacaacaggtgcatgccaccacccctggctaatcttttgtatttttagtagagacggggtttcacaaaatctattttcttaatcttagacactcaacaacacatgcacacacacatagaaactgcacatacactgcatacctgcacatcctttacagtaccattaagggcatatttaggaggagaggtgcctgtgtgtccctaaattaaatctttctaaaagttgaagcctgtttttgtgcattcacccccatcttatggacacagttattctatcacaccccgctaaaacacagatgaagggaatttcccagaaagaccaggaaaagatgccgtaccagctaggggatctctgggcaagtgggagggtcagcttctactccaattcaatcttgagggacgctttcccaccgtcagagtccgtcaacatctgtagaatgatgtattttccttcgcactcacgcttttttcgtatatcaagtgtttcttactcagtattgccctgttcctttggatccagtgaaatcattagagatctgccattaataattcttaattgtattcccttccttctttcccactggactcctgctagagcctatccttctgtacataatcactccgacctgttatttctccttctccgtgggtttcttcctccatttgaatagctcactcataaacagcatcattgagactcaagataagtagatgtacaagtgcctctgcacttgaagcttcccatctgggcaaatcctcatcctctcactgaagcatgtctatgacttaagtttccacagccctcttcagcagcagaggaacgcctgctccctcctcccttcagttgcacaccagccgatgtggcacacattatatcaaacttaggcccccaaatggccccaccctagcctctcagccagcacatgtatgcgttggcaaaacaggggagaagagacaataagaatattagaagacacatttaagggccacaacataaaagagcaacttaagtaacagtacaaacaagaaaaactattactataagcaaattccaaaggattgttctctgttttcacaaaaaccagaggaggaaaaaaaaaaacagccttacaccacagtgggacagggttttgctaaacatacagaagaaccacttgacagtggagatgaacaaacccagaagcaagccaccccataagttcttgaaagctgcattataaaatgaaaaataacaatttattttgaatggtagagaaagactttctgggagatgaggttgggagtggggtggagttggactacacaaacacatataatcttggaactggaagggacgttcagggcctgcaccatctgtttcacagaagaggcacagaataaatttgcccaaggttacaaggctagttagtgtttgatattccagacttcctaactccaagtctagtgctcttttcagagccccaatttaacttagaaattgtgtcccactttaagatgatttttttagaaggaggagaagaaagaggaagaggaggattgaaacaaacaaacaaaaatgatggatggttggtttaccattatgcatcctggtaaatccaggatgtgtaaaagataatcctctctcctgggaagaagaaacagttaacaggtgaccattaaccctgaagcctaacactaaaccagggcctgtgaagacttgcagttatcttcattttgttgtttaaaagactgggttccataggcagagacagagctatgctgaatagcgacacttaccatttgctcctccaaacacattctgtaggaaggcgtgggatttcacagcagtgagagcaaaactattcacagcagtaccatatgctccccaccatcaggagcggcggtactggtcactggacttggcaggcaaatcagctgaatggaaattctgaagaccacagtaggagttttctctttgtgggttttggatggtaaaatcttcaatctgttccacaggcagaaatcagagtgaaaaataattctacacaaattgtgagtgtatgtgtgtgtgtgtgaggacgtgcatgtgtgttacttctagaaaagttaaggggaagcaaaggcttggtactcatcttgcacactatcttatagaggtaggaggtcacacactgaatgcaaagaggtaaagactgagaacgcagaagatagaggattatttttagtataaattccatgttttccattttttacctctaagaaaaaaagcaagattgagaagaatttcccaaatgccaagaccatttaatagcagaattacaaccgacgataaatgcagcactttttaaagcttgtcctttctctgttattaactttgttctttcagttgtgccagagaaagcacaagagatagaaattggcagaaatatgggtctgaagaacagaaattcaactcaaatgaaaataccgtgaaaacctctagtataaaaaaagtcttttgtttaatagcaaaactttcatcaagaaaaggtttgtttgaattaaatgtaaaatttaggacagtctgttatctaatcattactagttctgtgcacacagggtattttctatttccaaagtggtctgcaatcattagttaagccacccagcatgctcagtctaaattgtatatatgtatataatagatagggagagttgctggggagaggcagcgtggcctagcaggctgagtaatggacgggtaactcagagttgggagttctcattttcatcacctggttagtctacagtgggagccaagcctgtacccacaagactctaagacaaggaagcaacttgtttcgaaaatacatacatgtatgatataaaatatcttttccaacaattgaggagttttaattttctataagtaccattggcatcatgtaggtccagtctcaattttccccataggcaaaatatatttttaaaggccagtctttctgtaaataactatattgagaggcagcacaatgcttaataagatacctgtagatgctcaccaatgtcctttttaacatgtggaaactgtccagaaagtttaaatgtattggaataaatcagtggtgtaatttcctttcctcttatttttggccatcaataatactagtatatattgttatccgagctttgccaacttcaatttttctcttgaaaaggagaatcctctaagcaagatgttgcttttaagtgttctaatgtaattttttcaaacatgaaccaaatgctggtgcccagcagagcttgtccacatcatgcctggattccaattgcatagctttccttcattttcatttgtttgctcctaccctatccaaacacattaatttgtggttcagataatgtattccatatgtttaattagccattacatgaaatgtgggaaggtgggacttttaaaatgcattctccatttctcccagtttcctgactgttaactcacattctctgatggtgtttgtttgtttgtttaattattttcacaataaagaatctgtctccaacaaaagtaattacttcaagttgtagattttctttggataatacaaatttagtttgttctatacagttaaattaattctgccctatcttgtatacaacatatgtgatgtagtcattgctcaataaataaatactcataataaaatataacttaaatagactagtattaaggagttctcctttataaagtttctggatttctaaagtgcatttcaatgtccgtaaatttccaatttttttctaagtagtttgcttggtgaaatactaatttattgacagatgtcaaatttatctcaagtatgtcctactgatgtcaaaaaaatgaccagcactgcatttggcatatattcagaaattcttaactcttcctaattgattaacggtaataacggcccctggaatgcccccaccgagtctgtagctagcctcacagtgattcactatggcgtcactgggagagatgaagcccagggctgcagtggtgccagttcatgccttttcagtgagaaggcattcaggttacacagagtgttaatctggccacaaaatgggagacggctaagtctgcctggaatgtctggctgctggttggcagacgcagcccttttttcaccttggatctgctgggctaaggatgctttcatagtaattttccaatgtcttccttgatcagtggactgcagcattttgtcattttgcagattttgttttcttcatgggttattacttccactgaactgcacttaacatctattagcttaggtctccagaagatcaaagtccctctgtatctgattattctgctctttgcaatttgtgtctccccctcaccctatcccctccccaccaatgcagaaggcttgcacgtttacagatttggtttcagtgctttccccaaatcgtttatagacataaaagcatcataaatgggacatcgtgtctccggaaagaaaataagagagaaaaagtgaagacagcaatagttattcttgtattatttccatctcaaaatgaatcttttaaaactcatgtttaaatatttccctttttgaaatgagatgggtgagggagtgaggaagaagtactaatgtcacagaattatgctaatgttatagaaacaaaattcctgttgagatttattctctttactaaatcactctaccccactcccacttttccaaagccctgtcccatctccttacattttagtttaaaatatttgcattgtcttttttaggaaccggtccacaaggccaacattccattcattttatggtttattgttaaggtaaccttaataagtaggttctgatggaagattttattccctttctgaacttttagtaaatgataatcattctctaaatttggtctcaccgctgtgatgtaccaaagatcctctatcaaacgtcgaccctgtctcatcaataggccaaagctggccccatcaaggcatttgcaccggccctagaaagaatatttttagacgctacataagaggcccagtgtacatctatcagcagacttgaagtgggtgcttgtaagttgagacaggtattagaaactcaaactatgtttggcagctaaaaaaaaaaaaaaaaaaaaattaaggaaattggaatctgaagagaaataaagacccagagccttttttgcaaggatatttcctcatcagaaatactcaacactattctctatggtgaataaagaagccaaagcaagaaaggagagagagagaaagagagagagagagagaacgtgtgagctacagcaggacttcccaaacctgaatctgtgtgcagatcacttagggaccttgttgaaatgaagactatgatccagcaggtctggagtgggatctgagagtctaaaattaaattgctcaccagtgattcagatgctgctgggcccaagaccacatttcagtaaagagttagtgtttccttgtgtccctccacaaatctgacactgcaaaaggtcacttcactccacctggcacacctcaaccccttgtgaaacactggtctctgaagaaggatgatgaggagccctagagcaatggccctttaactttgctacatattatgattccttgggagatttgaaaactctccatacccaggccacaccccatatatcaattaaatcagaatccttcggaatgggacccaggaatgagtatttttaaaagattctccatgtgattccagtgtacaaccatgtttgaggaccaatagcttaaataaaaatagcacaaggagaaaaaaaacagccaacatgtgttggcttcttctatacaaatacatggctttgtgagaaatatatacattttttttctttaaatcattatactaaatcccatttacagaccaggaaaacgaggcagagtttacgtaacttgcccccagtaagagctgacagagctgagatattctaggataagacatatgatggaggagtggagagcctgctggttagttacatttgtgtgtgaattcaaaattttcttctgtttgtatatttgattttagccaacagtttggtaataccatttaaaaatgtcaatcctccttttttgtactcccccaccctcaaaaacctaacactgccttcctaaatcattcattgccttttctcacatttgccatctcttctcctgggcatgcttagggtcctaggctctagagctaaggtgagttgtcttcagttgctggctcctggagctgacttgactccacccaagtcggttatactttgtctcacttcagttcctttggcctctcttgcccctaactgggcagcagggggagctatgactaccaaaaaagagcctgtgaactgcccctaaatatgattttcatgtccttccctaaaggaagtttatcctcacaactcttcacctcaaagctaacgcctactgcctcaaaccccagagaatgggtaaatagcccatctaggcatgcagatagcagcgaaatcagaaatcagcaagctctcatggggcccaaagatgcagagacaactgagaggggccacggccactcagtagtcagtgtgatcaaggtatagttcagcaaaaagacataaatagtaaattgcatcttcctgaagggtgtttctcattcaagaaggaccgaacaactatgataaaatgtgtaaaatacaaccatgagctcccctttttaactctggccaatgacttgaataaaaatttttatatcagtcctcagttttcccaactttaagtgggtatatgtcaggccaataaatattcatttaacttaggttgtaactgtattagaggacatacggtttggttatgagtcaggaatcccccaaacaacgttatcatgtttgaggaaaattggaaaaatcctagaaagagaacattcttttaaaattcacaacagggcaggatgccagtttgccactaaccataaatccagagaggctgtttcccaagcctgagacaattttcaaaattgctgcagctcaaaccctcagaccatgatgttttctgaggagatcaaggtatgttactacaaccacatgaagacgtttaagtaggactgaaagttaaatgtaccaactcatttcataagaaatctggccaggagcagtggctcatgcctgtaatcccagcactttgagaggctgagacgggaggatcacctgaggtcaggagtttgagaccagcctggccaacctggtgaaaccccgtctctactaaaaatacagaaagttagctgggcgtggtggcagacacctgtaatcccagctacttgggaggctaaggcagaagaagtggttgaacctgggagacggaggttgcagtgagctgagatgctgagattgcgccattgcacaccagcctgggcaataagagcgaaactccgtctcaaaaaaaaaaaaaaaaaaaaaaaaaaaaaagaagaagaagaagaaaaagaaaccctcactctctcccaaccactctgaatcatgcacacagttcatcctccctcctcaactctgatctgagaagtcaccaggggcagggtgacgagtattcgatgctattttttatccgcaattagaatctctttagattttctgctctacccttgcttctggggcttcatctctaggaggaactgaaggataaaacccagaactattcaccttaaacagattttgacaaccatgatgctatgggcttctaaagtgttgccatgagttgatgaatctcttggatagttgatatgtgaactttgtgagggggcatcctggtgtctctctgatggattttcagagtatgagatatataggtttgagtcactagagcaagtgctagcagtgtgatgtggaaatatattcagagcttattaaccttaattttacttactctattgttcacaaatatgtcctaatagtgtgtgagtttgcttctcttctcctggttgcactcaatctaatagaagaactgggctattgcaatggaagcagacagattagtagtggcacagatgcatgcaaaaatacacagacaaggcttcgctctgtagttggagcctccctggtgattctcctgtgtccttgaaattgagttgccagttcgcttacaccagctaagaagtctgcttctcctcaatgagctctgccggagtgcccctgccttactctcctgtgtgagagttacatgctccaccccttctctgctgaatctagctggcatcctgagtcagattggaacatttgaaaacacacacactcccctctctgggaaaacaattcatctgagacaaggggaagtgacaatcttactaaggaagccgagtttttaaaacagatttttttctttgagtcctagtgactacagaggcttacataatggtccaggctcaaaggaaaggtagcctggagtttgagagccttcccagtgcagcccagtgtggggatcagagtctaagggatgaggcgggtgggtggtcagacctgggagccattcctcctctccaagaatagaaactacagttttacatgttttgttttcaggcttaaacaaaaataataaatgggcagttttccctagcatcctaataggctgcctgaggcacataagcatgaacaataaaccttgttaaatgataatctgaaaaggaaaattgagaccttattcaaatttgatggagaaaacacacaggcacactccctactgttttgtcttaagcagtggaaagatctctccagggaagctgtagaagagcaagatacctttgagggaccacccaatatgggaattgggaacacattccgttgtattgaccttgtattcctgtttcccaaaatgctgggtcagtaattatttcaagggtaccatacaaatatgtcattcgatttttctttcctggcttagcatctttgctttacaccccacaataactaagtctgaagggacacagataaactagacttctttaagaactggctcttcttccatttttgtagatatatctctctctcttgccccttcaagcatgggcttttttctttttttgagacagagtctcgctctgtggctcaggctggagtgcagtggtgccatctcggctcactgtatcctctgcctcccgggttcaagcgattctcctgcctcagactcccaagtagctgggactacaggtgagtgccaccacgcctggctaatttttgtatttttagtagagacgaggtttaaccatgctagccaggctggtcttgatctcccgacctcctgatctgcccctcttggcctcccaaagtgctgggattataggtgtgagccaccgtgcttggccaaacatgggctttttaatcaaagtcaggtccaccttctagataaagtaatcaaatttccttctaattcatctttgggcatggtccaaattttcacaaatttgaatcagaataattacccaaagattccaccaaaattcaagcaaactcccaagtgaaggctgtcctcccaaaatttcagttccagtgtaaccttcaatactttgcttctagaaaagtgattcactctcccacttctggatggtgctctgtttagcaggtgtgacagctgctgttgattttctcacttggcaccctccccagcccctttctttcttgcccctttcaccgtggagacaggaaaagttccacaatgtttttctactcccgttgccagccttctttggctcgaccagtggggtgcagttctgtccatgagggactcatgcagacatggtactgcttctgggaaagtggctttctttttgacaaacaggatacatgaggctggcaccaacccttcttactttcttcctgctcagtgtatatgatgcttgaaggtacagctgctatctggcaataagcaaaggctaaggatattagagtggaactacagaagaatcttgggttcttgataacttggtggagttgccagagctccatgcatcttgtatgaatgtcctggattgcctatgttacaataaataaataaataagccaatgtatatagtcatgtgaatataaatgtgtgtgtgtgtgtgtgcgtgcgtgtgccagaaatagtaggtattctgttaacttgcaggctaatgtctctaagtagaatttaaagaaaaaagaaaacactaaaaaccaactcctttactgagttctaagcactgcgtaggaggacttatttttatcaccagtcatgttgccatcttcttatttttgccatttcacagatagggcaactaaaggctagggacctaaagcaactctaccaaggtcacgcagtaagctgctaaaagctagggaatagagccaacagctctataatcccaggcgaggcctcctctgctctatctctacccctcagttaggaaaatgtcaaaggatttattaaaaacagcctgaagctagattaggtattttaatacccaaagcacttaattactaatacagtttaaggtacattaacctaattggaaactttctgcatatggcataggtttcctccccacctcagaaaaattaatagtattcttttcaaacttttttcctggtctctctcatctttttgtgcaattattagtttccaaagttagaaagaataccacagccaagggtttaaccagtctgaagaactggtttgttttcatttaaacaaaaaatttaaaattaatacagtaatgagaggaaaaggaaagatagaattttatctgatagttacaggtctccgtctctcagcatacaagggagctggcaggaagccctcatcagaacccaggggtcatcctttgtggctctgccttgcattgcacatccagtcagcaccagagagcctgacgtatctcaccattttttgccatccctcactacccccttgggccaggccctcaacattctcctctggattactgtgatggccatctagccagtctcttgtctggttccaatctgctccccacactacaactggagagattcttataaaatgcaaatcagattaatcagtccccccacttaaaaccctttaatggttccctgtggccctcaggataaagtccagactccttgatatgacttcaaatgctcttcattactagtttatgtctagtactctatcttacacgtgtcactcccgccatattcaactacttgcaattccccagattacctgtgcttttcttccattctaagcttttgcagaagcttttgggtattccctcctgcctcctcttccttttgcttcttcttaccaatccccaagcttaatcttaatcatcttccactgcccaagcatcacttcccctggaatccttccctgactacctcctccccagacgaaaggttaaatgcctcttctatgcattcccatagtaacctactgagataatgctaaaattatttacttatgtctttgtcttcctggggcatcttgagagtagcaaatgcattttgtttacttttgagtcaccagcacctaatacaatgatgcttacaaaatagatgctcaataaaaacaattgttgaataaataaaagaacaagtgaactaaccttgtatcaagaactatgcaaaagattaataggcaagtgagctacacagtaaaaaacttggagctagaaggggcagaaggatagctttaaggttcatgaagtcacagagagctttgttaacccctgcacttggtgagaaaagcacaggtctggcatctggcacactaggtctcaggttgttctcaacaaaatccaaaggaagaaaactggcagaactagaagccgatccatgctgcctgagaaggaatggatgtaggatattcttaaagatccttacaagccacatgaagattgtgtgtgtagaagagagtttctaggatcctaactgtacatgcagttttgagctcttctctctcccttcaccctcttcctttcctctctgccaccctattaatgtcattattctggtgattttagcaacaaaaccagggtggggctccagaacctactccttctttataaactggataacttcataaattatccacacacacaaaacctgtagaagataaagctgacatttcatactagaacattatgtatgaagaagtactaaatggggaacagatgacatttctctgcactatctcctaatttaccttgttacctgtaagtaacaaagtagtttgcacagtctatactgatgttcaccttcagccagcactatcttaaatacagatggctgacttgtgtggaaatgtcacacctcttaggaccattattctttttcacacctctcaagacctcttatttttttctgactccttttatatttggttgtttcacttatgattctttttactcactatttaagtttatttgttatcattttttatcatccttgttagggagaaactccttgaaggcagggactatattatttgctttgcaggatctgcagcagagaattaggtcctatacatagtaaaccttcaataaatgtttattgttcagctaaaataaaaaacttcaaaagtttcagacaagaagacttcatgtacccatggacctaccactaccattgctttctgggattttatattacttttaaagctttctgagaatttatttgaattttatctcagtctttggggatattggtaggaaaccaccatagaataagatctatgtctttattcactatctaagcataggagctgagtagacaacctttgtttcctaccatgcctaggagtatggcaacctgtggacctggtagcctccggtaatcacacctctgagaggttggcctgaatgccaggaaagttgtgcatggcacttgcaaagaaacaggcagactgcctttgagaggcccatcacctccacctgtattttgagtataaaggatggttccatgttagagtgaattatgtgtttgtgacaaccattttccatatgtgtttaaattatccatggtagctcttgattggagttgtagggaggtggtttcctaccaatacccccaaagactgagataaaattcaaataaattctcagaaagctttaaaagtaatataaaatcccagaaagcaatggaagtggtagctccagggttacacaaagtcttcttgtctgaaactttgtgaagtttttttattttagctgatccataaacatttattgaaggtttgatatgtataggacctaattctctgctgcagatactgcaaagcaaataatatagtccctgccttcaaggagctttccccctaataacgatgataaaaaatgataacaaataaacttaaatagtgtgtaaaaaaatcacaagtgaaacaaattaatataaaaggagtcagaaaaagaacaaatcactgccagccagggttacttagaaagctttcttgaaatacagccagttgatcatactatgcaggagtgataagttatcacagagactcagctcctcacagcccttctcatacatagggttgaggtctaacctgtcatattttaaaattccatgataggcaggaaagaacatatggaaacaatgaccaacttttactaacttatttattggaatttgggggctctgggtattctcttttgtttccccataggatcaaaatatcactataatctactccaacccaaggaaaaatttcagtccttttgcacctgaggtttttcttcttctcttgaaatgtatttgcaaatgatgcctaggtacactggtgccttttctgaaagacacgatgtaacactttcacatgaaaaaataaatagataatatccctcttataaacaccgatcattctaattgtcattctttttcccaaatttcttcctcctcttagcctagggtgcttttatcttctgtcttctttgttttctgattgtggaacatgcttaaatgtcttcacaaaccttgggagccctttgtgcccaaatcataaggctttgttcttcctcccttccttgtgacatggcctcataaaaatctagtaagcaggccaggcacggtggcttgtgcctgtaattccagcactttgggaggccaaggcaggtggatcgcttgaggtcaggagttcgagaccagcctggccagcatggtgaaactccatctctactaaaaatacaaaaattagccaggtgtggtggcacatgcctatagtaccagctactgagtaggctgaggcaggagaattgctagaacctgggaggcggaggttgccgtgagccgagatagcaccactacactctagcctgggtgacagagtgaaactgtcttaagaaaaaaaagagaaagaaagaaatccagtaaatatatgagccctctctctccaaatcaccttttcactttcctttctactctccagcccaattatttcaaacgtttgccccatggcagaggatttctttccaatcttaccctgatactcgtgtatgcaaatgagggattatggcccactgttttattgttattattataactggaatatacaaaaggggtacaagtaccagggtaagtgtaggaagccactgctttttggcattctgctacaaattggcttccttctacgattgtgttggcaggattcttacaggtagtttttcctaccactcccacccatgaatgcatgtgttggacacatactttctccctctgtctctgtctctctctctttctcttacacacacacacacacacacacacacacacacacacagagccttgacctggggatggacattgaactagaattgataataaatcacccatactgtgatgggaactatggagaaacaccaaagcagcagaacatattgttgagaacattctctttgtttttccagctactcaatgttttaatttcttcctctttgtaatggtactaccaatagtacctgcctcattggatacatgaatgaatgcatgtaaagcactgagaacagggcttggcacattgtgagtgctatataagtgtttagtaaatagataaacatgtaaagcaagcgcccagcacgtggtacatcccccatatgtgctatagaagaagtcctattcttagctattgctctgaaaatccctcaaccctcttagaggagccatcagttcagggttcttgtagtgaatagctgctgggtagtgctggttctacattcaccccttctccatgcaatgtagcttttagaaaccttttagggaatacttaaattgaagcaggtacaacctgcatcaaatctgggtagcatctcctcatcctgaaatcaagctaagacttgaataagtccagcttataaaagaataaagacactagctttttttctgaattcaatagaccagtgtgtttgaaacttctttttttgatagtgacctacgttaagaaaaatatcttcttttgtgacccagtagacaagcacatgtgtttatggctgggacaaaagcttcttaaagtaatacctgtgcaatatacaacccacttggatactttctctttcttctatttcattttttaaaatactgcctataaccattaaattgatttcataggctaccaacaggtcatgatctgcagtttgacaaataccaagtcagaccgaaagtaactttaggagtgggctaataataagaaatggaatcctatgaaagactctaaaaattctctaatggaagaaagatgactattgatttgagtctgtgtacccatgtttcattctccttgagaatttaaattgcaaagatatattcacagcttcagagcttcagatgtgtttaaaaaaatgcctttgtctcctaaaatagaagtttctgataatgcacatcagtcagcaccctgggacacacaggtttccctagaacaaataattatattgaaggttatccaattgaactccaaataggcataaccatgaaataaacaagatatggtagaaacagggatatcaattgctcctccctggccctgttcctgatgtgcaacaatctttgaaaaacactggtactttataatctgtgagatcttttactaactgatatcaacattcaaggtggaggtcccattcctactggacaagttgtcatagcattctggtttcctatataacaaacatcagtaaagccttacttggctttactgtaaagcatagtacttggcactttatgaagtgttttaatgcatattatctcaaccttgtaacaatcctgtgaggtatactgggcaggtatttttgtacattatatttatgatggtaatgccatttaagacttcactgtttccattttcaggataaagagggatcattttgaaacatgttgttggctaatggcaaaaggcagcataatgtggacagagtactagatctggcctcaaagacatgtgctaaaatttgtggtgtgctaattaccaggtgggtgttcttaagtaggtctcctaagctctagccttatgttaaattttatgagtagagaaacataagtcattctcaaaagtagaagattggtgcagtggaaagtaacactaccttcagtgtcagacagaactggattcaaatcctggctttggcacaaactatatgaacttaggctagtgatgtagcctctctgaattgtatattcttctcattttgtaagataggaattacaataaaatgtcaccggccaattaaaatgtctttttaattgaaacactgtatctgcttccaactgcctttaatttattcttatagtgccaattttaaaaagtaaatctatgtccctttcctccttaaaacctttcatgatttctcattgcatttgagatagaccaaaatctttgtcttcaccaaaatggtcccatacggtgaaatctctacccatctctccagtctcagttcataccactgtttctccttctgttgcaaacatttagccaatactggtcttcactgaattctttgtggcttcagacaccttaccttttgcagcctgtgcacactgctatttcttctgtggaaaagatctcattacaattccagtcctaccaccctcatcctttaggtttcactgtaaatgttaccacctgaggaagaaagatattcctaaactcctagatcaggtcaagttctcatattctacactataatggaaacctattcttggtctttagatcccttatcacagatgtaattaaataattctacaactatttgtttaatgtgcactccttcagctaaagcttaaaatccaggagaacaggaacaatgactattcatggttgttacctcaaagcatggttgttgcctcaaagcatggttgttggagttaggctcccttcacttaaattcctccagctgggtaaccttggaaaaattactccccttctctgtgcctcacttcctctctgtaaagtggagatattaagagtgtctaccccttagggctacatgaagataaaacgagaaaataaatgatgaagtgctacagttcagtgcttgaaatggaataatagatgctagttgttgtaggtgataaatattggttaagttaatatacaaattgttaattaagtgtcatgaagcttgtacaaggcctggaataatagtagacaataaatattagtaccatccttccttcagtatttaaagaatcttctaagtactcctttctagtcaccaaagaagctgaaggcaatgttgagtgtacagagccataaggaagagatatggagtttgttattatccaagtagctgactcctaagctgctaactgaggtcatttctaagggagaaaatcttaaggatgcttaccactgagtggtaagggattgggcaatagattgggaagggaaaagagccttggcaagctgaaggcttgagggccaggttcatgccatgagtaacacgtgaaagtagcacactgtgtgtgaggacagccagggccactggaatttgttgactgatgcaatgagaacttggaacagaagtaataaaaagagctggggcccagcaggccttggaagactggaagtagtaggaaatcagaagagaataaacaagtttctaggggaatttgaagaacaagaaagagaggtagtaggctcttaatacctggcacttctcagagaaaagaaagaaacttctcatgacaaaaaagcacagaatgaagaatgaaaccaattctgcctcggctacctgaggtatacctttgtaacgtaaaccatcagtgagtaggggcaggaattaaaagacaattgggatgattttcacaggtgctaagatgctgacatggataaggtttgacatcaggagtcattgggggtttgagctgaaattcatgaaagattataggtcatcaaggcaagatagagaagtggaggtggagctgaagaattgccagtaaggatcaagtacagataatataaattacagccttaaggaggcagctgatacatacatatataaatatgaatcaagaatacatgggaacaagaaaagagatttttttgatgctgctgtccaaggttcagtgtgaaagttgacatattcccctcaacctaagagactggagtagcagtgtatacatgacaaagttttagatacagtaaaattcatatgtgctttcctgaatctttctacctagccatcaactccttacctctaccaagagtgcacaggtgaggacttgacatcttaagcacaggatacaaattggcagccagaaaggaaagggttaaagaagtgaagtttgtgacacagctgggagccattaacaattaagttcttggacagaaacgcagcaggaagctgaagaggggctgaagaggcactatggcctctaaaaagcaaaaacttgattcagaaatgaatgaactgcctttactagtgagcattcaggaaaactcaaatttctcaactaagaatgaagagcagaaactggttgagtctatattatgcctacccataaaacaggcatcttaataaggaagacaatagaaagttaataattcttagaaatttatattttaacaatacataaaataggggaatggtactggcctaatttaaaaatcctagttggtgagccagcattaggtaccctaggatcttccaccacttgcatcacagtttggtttatttttgatggcaagaggtttgatcttagtgatagagtagtaaatacagtactttagtgtgatatattatctcagagttctgaggtcccatgctttttgccttgctttctccctgcttctgctccctttacattaaggatctcatcttcctactgatttctgttgttccctttctaccccaccaggatccatactgtgcattcaaggttccctaatctcctataatggaactcaattcatgacaaatgtgtaaatacttatgggctactttatgtagtctctcatcaatattctgtgagactttttctgaaaaattctagccaatcctcatttgtcctaccacctggagttctcacgtgtatgttccagctctgccatgcctcctgatccaaacaaataatattcagtttggcactttatgttgtctttgagtcattccattgtctaatgtataaagtattaacttctactgaagactacaaaccacttgatgtcagggacatgcgtcataattcatttttgtcttctgtactgctttgcacagtgctatttacacaataggtgcttaaagggcagcaagtccttgcagaactgaaatgagcacctccacgagaaaactgcgcaggctgctttggaaggtagtaaacagagaaggagcaaaagcatacatatgtttacatataaaatagtaggcctgctcaagcaagtcttccctgaacaggacccttaaggaacataacataagtcaattggaagaatatacagccaacatgatttatatggctttcataagatttaacacaaaatgaacatgagaataagaactctttccccatttcatcaccatctccaccgtctagcacaacatgtgacacagtaggtgttgaatgaatgaaggtatgaaaatgctcagtacagggtcagggataatattaatagttggctggattaacctgggaatatttcccagacaaattgagaaaatattaattcaatgatgaaaaaggacgtagtttgaggcttctcagagtgagactgctttggcaaagttatggattaagaaatcatagggaagaagagataggaaaagtctttttctttttaagaaggaaggttaaagaatggtatgggaagggtgatcatgagccccagaaagtgtgagcattgtagaggtgaataaaaaaagagcaaggtagagaataacttaagtcagtggagtcaaaagtttgagaggccatcaggaagttacagcaattaggtgaaagaaactcagacggattatttggatagtcctctaggagcagacagatatttaaaaaaacaaaacaaaacaacaaaaaaacttgctttggctaatggctaaatgttgttaggaagaatcattttctgggacctagtcatacagatttttgtgatgttaagctcaagctgataagtccccagaggacttggaagacattttattgccctcatttggaaggtgaagccattgacctcaaaccctaggaatgtgttactttgttcttttaataatcataacgaacttttccagtgcaagccatgtacaaatgcaagatgcttggactgagttgaaagtgctctataaaaaagatagtccaaacgatgatgggccttggaaactggtgccaatgagaccaacttctacccagccaaacaaagtcatgtgaccagttttcgaggctaaatgagagctgaaaaattcagatgaagggtcccctgctgattaggttgtgtcagaagcaaagaactagataaggagccacatttcactagcaccaggaatcaacctcacccttaacttctttgaaatgtcaattttataagcagacataaaggaagaggaagctatgctaggcaaccatcaactcatgatcgatggtcatgatattctggaagagttgtaagtagtgcatacacaccacttctgtaataaggtttttattctttttctgtgaaatagcccctaagttagcacaatcttaactgttaggaaaatatgaccacatctttatcaattttgattcataataattttttctgtaaattttacacacatttttcaagaaaaaaatgctttcacagaagcattttttaatgttgtaggtgggaattgcctgtgctttctaattagacctataaaaagccagttcccacatgcatgaaagttcccttgggttaccaatagcgggccttgtacgaatgctgggaaattcaggcagtatctttggggccaatctcatgccatctgctcagcatcctcaaaaatcctattccagaaggcagttcttcaagttcttaagcatctttttgacttgactcagtgtggctgataaaaataaacttcatattttgaatcacaatcccttgcacactttcctgaaaaattggacaaaaatttgtcagtctctctagtctcagttactgtctatttcacaaactgtacttagccctgacaccagtctcctgtcttaatgactgtctattaagagacactgtcatcttgttaaagagcatgccaagtggatatctccctttgattacttgtcctctgtttctatggacctagagtcaaagcagtctctattatttgagtgataagtccacatctgctgaatagagtgcttggtatcaaagtgagagtgatgtttttaactatttattatctgctttctataaactcaactcaaatatagaaggaggaaagcagagaccaaaatgatgtcttgttaagattcatagtgttttctctgaaaagaacatattctttatcaaggaataagaaagtatcctcttcccatttccttcagcatatgaaatatttacttgttagaccgcctctgaaataaccattttccatagagctctcatggcccagcccattcgtgtgctggttaattaagtgtgacctaaaccaacttgacttgagctctgcattaaatgcacaaaacccatttgagctgaccagcagcagaagtggtactcagagaaattggaaaggatttctcccaaatgctttctacttacttacagcactcaagtaatggttgaagattagcatatgacatgacagattacattaagtcatgtctttccagtgctttatgacagcactatcacattagcttcttagcactggcacattgaggcatgcaaatgttttcagaccctcttattcaaatctacaagctgacatggcagccctgatatgattattagtcatttgagagactttaattcacgtcatcagataacaggttctgctaaaaggttagagaaactgtctgcttttaatgaagctctcaagaccctcaaaaacgctgttacacaccaagagcctgggttgactttattgacaagacccctctaagaatgaacttaagtggaataattaaataggcatctagacattggaaatattgtctcttttgctgagaaaatcatattggatggttgtgtttttctccttcctcactgcacttccccctgccccgttctaatttgtgccctccagaacagtgtgggtgactctcagacatttttacaatctgatatccaatataagtgtaacaagcaaaaggataattctttctggaaccatcattacagtttgggcataaggtttgccatagttcacagcaatgtgttaatggtatcaggcctaagtggtgatgtgattaaagatcatgagactttgcaattcatagtttgtttgctgtaaatcagtttggtagtcaaatgttttgtttcatattgtggtgatctgcacttagaccccaagagaaaccctgtttccaaaatgcttccacatgtctcagtggagtttggcacagatgaagatcttgttggaatgaatgaaggaagatggccctaggagatatgctggcagaatgagcagagagccagagagagacctctgcaggtgaaaaaagcatttgatgaaggagaaaaaagaagagccgttttcctcaatctgggaaagtgaaggcaagcgcacattttgttttcttgtcttttctttttgttagcatccgaaaccatgaataccaaaacaccacttctggaaaacttcttaaggagcaaacagtagaactattgagctgtctctaaagcctgttttgttagtttgttttttaattttcgatgtcatcttgttcactcagatttctggagaaaaaaatatagttacagtttaaggcaaaataattttctactatctgagaaaatgttcaaaagcatttgatttgtggttgatgttctttctttcttgcatagatgttagtatacattgccttaagtgaattaaatatgaatttaatactattcatatttccttattctcttccttgtttctctgcaatttgacaactatttttgtcaatatattcttccatctattctatttctggccttccttatagcttttcttctaacctgaattataatggtttctaaagtaatcttggctgaaaaaggaaataagctaccaaatatggaggatataaaggggcactgataagcagtagtgtaaataagttcttatttaactaagagatgctctaaaaaaaaggtctgaagagaacaaagaaacccatcaaaaaaaatattagattataaaaatcagactattctcttacctcaacaagacaaagcatagatgcatgctgcgtgtgtgacagaagatggctctctggagaattttagtggccatcaggaaaatgctgccaatcctcccctctccacccattgcttcctactgctctgacccagcaagagtgggatctgggtggacatttcagttgaaccaaaacagagcgagtatctgccctaaaagaggtactccattcagtgctagaacaaaagggaaatggacagcatttgtcccctgttgccctatccctccaggctacagagcaaggaaggtgaaaaactttccttttctgcgagctgatttcactttgtgaaaatctgaccttcttcatatttgaaagcagtagcaggcctatccttggcacccctacactcattttctattgtggttgatgtctcttcctgcatttgaatgcttctgaacacatcttctttttcttttttttgaggaggggggacggagtcttgctctgtcgcccaggctggagtgcagtggcacgatctctgctcactgcaagctccgcctcccgggttcacgccattctactgcctcagcctcccgaatagctgggactacaggtgcctgccaccatgcctggctaatattttattttgtatttttagtagagacagggtttcaccgtgttagccaggatggtctcgatctcctgacctcgtgatccgccggcctcggcctcccagagtgttgggattacaggcgtgagccaccgcgcccggcccacattttatttttctactttccattagagctgacctccttttcactttcaatcacaccattaaaaaaaaaaaacttcctttcctcttttcagtgttttttgcttgaaaataacttctctagattccaagtagcccaaagatggtgtcagtgcctaattcatctttgtatgccgactttgtatgcacagtgcctgatatttggcttatgttcaataaatgtgtagtgatcgaatgaatgagtaaatagaaaaacaactttggaagctatcaatcataactatgcagagggctgtattctcattcctggtctccttctcctttccgtcttctagcaaggcagtgtttctctattgaaggtcccttttgcctccctgtgatcctcactgtatgtatgtaggtatgcatatttgtgtttatgtacatatgcatatattgcatgttgacttcagttttaatgttttttctacatcatacattatgagcataatagtgctcctaattttactaaaatccatagacaaatgtatatgaattaaaactacaaaattaggaattgtgtattatgagcacaacaatcatctactgttggtacttaatctgctctgccttcttggtgtagcagccagcactggaacctggatctagttacctatacaaactcttctttggtactggtactccagcctcctaatattgttgaaataaaggacttaacaaatgttcttggctcacctgcctcatctgtgggcctcagagacaaaatcctggatctctgggttccaaaacatataaagagcatacaaatactgttaagaatatcatttatttgcatgccaacatttaacatcccacaaaatttgccctggcttaagcaaatttcccagcacagtgttctcccatttctattcctcaacaactcagggttttaaaagaaaacaaacatctgcatgcatagattagagccctcccataaacacatgttcctatcaaaaccaatcaaaacggaaaaaagaaagaacagagtattatacatttttctttagagctgatgtctgattttcattaggtttaaccttatttcttttagatcctaggcagtgacccaatatttattttccttgcggggccctgttcttgccaatatttcactctggctcctggagactttaccgaaggagttcaaggcccctacactcccttttctcttctgctgccccttggagacacacatttgtcacttgtatcctttatttcattttacagctaattctgagccctttcttttctcctattcactacttcttaatttccccctttttattggatttatgactgaatactttaatttattcatcatataatgtctttagaactcttttttttttttagtaatttacagtggaccatatgctttctgctgttgcctcctattatattgatctgtaaagcttctgggggcaatgattagcatgaaagaagctctgtaaatgaaagttatattgtatcttatttgctttcttttgaacaaaatatatttcagagttctccatgtggtatcagatgttctttaattttgtgagatttcatatgtgtatgggtatacattttatatatatatatatatataaaatcttctaaaaataaaaaaattttaaaaaatggaacaatgacttgaagttaacacagtcctcagattcagtttactagctgtatttcatagaccatgcagatttacaaagtcaaaacttcacccaaaattccttataaaaggagcttgaggccaggcatggtggctcacgcctgtaatcccagcagtttgggaggccaaggcagcggatcatgaggtcaggagttcgagaccagccaggccaacgtggtgaaatcccatctctactaaaaataaaaaattagctgggcatggtggcatgcacctgtaacctcaatgttaaccttgagccattttcctctgagattcaatgagataattagactagattacagaactgcaaattctttatgaatggaaccctatatccaaatgcaacttaaaaaacagacacaaactgaactgttggggttgaaatgggggtgggtgtctaaagccttactcaggaggctgaggcaggagaattgattgaacccgggagtcagaggttgcagtgagccgagattgcgccgctgcactccaacttgggcgacagagcaagattttgtctcaaaaagcaaaaaaaggagcttgaaccacatagcaattagttgactttcagagggcattctctgttagacctgcctgatctgtttgcacagatcacatgagataaaatataggcaagttctttgttaactgtgaggatgatacaaataccaatgtaagaattgtactcaaggggtggcacgtgcctctctgggttctgattatcttgtgcataaaacaaagatgacattaatatctatccctagcaatgttatgagaatcacacgagaaatgaatgtgaaaacactttataaatagaaaagtagtgtacaaagtatagataaatattgcttaaaaagcaaaatataacatattcatagtctttatttttcaggcttcatagggactaaagtatgttcacttgaattccataaacaaagctttggcttggattatttgtgttaacaaataacatgctatatcaacttaaagatatcaattagccaaaattatcgagtgccactatttttaaacagatcttaaaatcagtggttttgtgtatgcaacaaaataatacaatcaataaatattccagcagctccttagtggtccttcataggttccaacatattgaatgctgagaattttgcatctctttgtcattttaggaataaactctaggtccagtccataacactgattaacttcctcaactcagagggaaactagcaaaggtaagccccagaggggagattatgacaactgggcctctaccatcagctctcaatgtttaactgagcctctaccatcagctctcaatgttaaccttgagtcattttcctctgagattcaatgagataattggactggattacagaacagtaaattgtttatgaatggaactctatgtccaaatgcaacttaaaaaacagacacaaactgaactgttggggttgaaatgggggtgggtgtttagagccttactcacatgagctctgcccataccatgtcagcttccccacttcagcatcaataggccaccttagaaaatcactggatgaaatgatttgtcatatccctctggcttcttcctagaaggcctttttaactctgtgttatgtcatccaaggccgaactcaaaggtcttttctatctttttacctctaatttaaaagtttcttctcaattcttattatttggtagagatgtggtctcactcagttgcccaggctggtctcaaacttctgagctcaagtgatcctcctgccgtggctcccaaagtgttgggattataggcatgagccactgtgcatagccctcaattattattttgagaaatttaagagataagaaaaaatttttaaataacaaaacaaatactcatattcaagctatttaatatcagtaaaattttgtcttatgtggtatttataattttaagaaataaaactttatgtatatattatacaaaaatatatattgcttatttatttaattaaatgttaaataatatttatttgtctttctccagaggcaatcatcatcatgaatttaccgtgtttctttcccattcatattttagtacagacacaaaacaaaacttatatatgcttccacaaaaaataagtaacttttttggttataaatttataacaggtataatgttatgcttcttgttttttcacccacacttagggaatgagtaattatgtaaatgagatactgctgggctgattatgtttttaaaacaattgtagtttttcttcatctgaatattccacatttatttatacattttcctatcaatgagcttttaggtagttttttctcttcatttaagtaattctatatgtgtgcttttatcactctctctatagctgtaagggtcactctacattgtgcacctaaaaatgtatggctgaacctaaaggtatttactttagacaattcctgtgcatcagtaattattttaaaataaaaatttaaaaatattagatactttttggagattcttaatccatttttcaaattttttgtctttttgtttcatttctctatatctgtgctcttttagggaagattttctctgttctatcttccaattaattaattctctctttagctatatcttttaacctatctctttagtttcttttttttaactaaccacatttatttttggttatctccatttattcttggttctttttcatgtctacatagctgcttgtgtttcataacctcacttttctgatttctctctcttatctctaattcccttgatgtagattttcccctttgttacacattgcacctcactgacagcagaatttctcatactgtatgattgttttctcctatgtatggcctagattgtagtggcttactatagggtggttttgtaatcaggtcctacagttttttaactaatgtttctgatctgtgtatttccacaccacatgattcaaattcaagtgccattctcaaatgtagatttgcatttcacagattactacttatatttgtggacccaagtgggcagctagctttatgcttcaacctagccagagaacagagatattcaaattcccctttatggaacttagcttcttcttggcttagactttagactgtgatctctgtttcgcctctttctacatactggttgcagtttcaactattgtcacatgtggatgttaaaaccccaccacccctaatatcttcctaaataagtcccttgacctactacagtaggtctcttttttcctttctttttttttttttttaagacagagtcttgctctgtcacccaggctggagtgcagtggcactatgtcagcttattgcaacctctgcctcccagattgaagcgattctcgtgcctgagcctcctgagtaactgggattgaagatacataccaccacaccagctaattttttaatattcttagtagataaggggcttcgccatgttggccaagttggtttcagactcctgaactcaaatgatcctcccatctcagcctcccaaagtgctggcattacaggcatgagccaccatgcccagcgtacagtagatttcttaaacttacctggtaccatgaagttttttccctttcttaagagcattcaagttcagctatatattttgaagagaaaaattaactattttctttggcacttctaagcccttggatcagaagagaagggtattttatatgctcttaacattaccagtttgtcccagaatgctgctgctgtatgttactgtctaccacgtattcctgggtttttatgaggtctcttttgacttttaaggcatagctcatcaaactttgaatcccttatgacacccataatatttcctggcccagagtggaatcttgttgaataaaggcattaattaaaggattagatgactggacaggattttttctgccacaccctacttttggtgaatatttctctctatctagacagatagctcatgcaagatttattatctctagatgtctgagattctgttaatcaacttgtctagtaccacagatggataatgctgaataaaacacaacaaagcattcaggaaggtattaattctatctgcttccaagtctataccatggttcatactggctccatacttgcttcctgatggcagtctagggagaattttgcttatccactaatagcagtgaaacattatgtttcacagttagacaaaaagaggcctacaaactaaaaaaaaaaaaaaaaaagcattttgtaaaaataaaggagacatggaaagcaacaaaatgaagaactaattctgtttatttttaatggttgtgaaatttaacttgaacaaatatctgccagtgtgctacattccctggagcctttccccctctcaaatattcattttcaggaattgtactaaaaataaacccaagagtttcgttgtgacagcatgccgaagttctcatcctttttcaataatttcattacgtataataaaccttagttggctcaaggttattctggctcatacaagcccttcttcaccttactcaggtaatattttcatctgccattcatcaaagctactctgttttctgagaattgtatagacaagttaggcatcctgtatgtatccatccttatgcatttcactctggaaaaagtagtgaaaatacttgtcttccaggaaaatatctacccaaatttcaaagttgactctcagtctacccattgttgctctctcttcctaggcaaagagaaaggtttctttgaaactctcccatagacttttgttaaggcctctaatttaacaactataataaaaaataaatttaacaattaaaatgtaaaataaatgttatagttctttcttggataatctacttgaaatttttgaaggtagacatttttagggtaatgtcaggtgcctagtagataccagaaaacatttgatgaaataaaactatttccagaagtgtttacacataaggacatttttccatagattctgactctctaatgagtagatgactgacctaggtgaaagcttagcatcagatccacttaatttgctaggaccactcagcttccttcactgggactctctctttgttgcctgatgcctgcatctgctcacttctgccttgtctgacctttgagtatttggcctattaccaaagtgaccgtatcatctattgcagagtgaaagaaggctctgttaataattatgccaagacaacaggtataaactggggctgtcctgagcaaactgggatatatgatgacttgcctattgattgcttaacctagtatattttgcctgatacttatagcccagtagttttctaagtgaaagtcatattctttaataataatcaccacttacagtgcaccccatatagactgaactgtttaataaactacttcttttttatggatagggaaattaaggctagtaagctaagtgatttatccaagaccacccagctttgaattagtagatataaaatttgaatgtgggtctttctggccacaagatatatctcctttttgccatgcagtccttatctattaccacaccaaaaggtcatataaattccattgctataggcaatttttacaatatagcatctcccttaacacaagtgaaacatttgctaggacttggaaacattttaggggattgaaaattttctttgatatgtaagatttaacttgtacagcttggattttcatttctcaccgtgccttttctacaggcttcacatctgtctattccttcctttctgtgtcatccttaccccttttatccttctttatccactttttccccttcactattaaaagtcctttgcatgactgagattccatgaatttcttattcagaaaaataagcttgggtgttgattcagctcttcagcatgttaatatatatggtgctcactgcaattcgacagtccacacccaacgaattctgaggttcagtgaattgcagttgttatgtttccctaggttattgtaaggtttaacacttacagacaggggtgcagcttcagggataagatgagtttttccagaggttagagaaccctggggcttggtcgagattagtccttcctgttggcagcacttattactcttacaaacagggcagccttcaatgccagagcttcccaccaacagggaaaagcttgggggcctgactcagtgaccacaaattccaggtgtgatgtgggagaatatctgagataagagacaataaaagtggtaggaactgtgaaaaatctattgtacaggaggtgaaaggggagagattaactcagtaagttgtcagctcattttcttactgtgctatcatgagctttaactaaaaaagaaaaaaaatctgtttgatctcctgcattgcagatgtatttcaaggcctgtatctgttactgaaatctacaaagtgtgcttcagctataaatctctatccttgaatgtacacatgcaattatcttagagagatctggcttccataaaaatgacaattttcattcctgatcttgctttctttcataaaaatataatgtttatgtttaaaaaataaccttcaattgataagtaacagagaaatttatgccattatcatattagatgtcaaacccttaaatgtctctcactagtcaggaaaaagcaatccttttacttaaactttatttctttcagcacagcagctctgaaaagtcatcagtaaaattactttcccaattaaatgtagttaagattccatgggttagaaacattatggatttgtgtgcatcctgactgtgatgttgcttctagttataagtataataatggtttgagagaatgaactatttcctccaagtttccacgctattgtccagaaattatgtatgtctgcaattgctgggttgagtttgccaaatcatcccacattcttactattcaatgactgtactctctatctgagaactgttttgtgcttttcaaatgtaagagcctaagctaaaaatgaacttaatcaatgttgtaggatctactagtcatggcaatcccccatgagttttacattcatgaaagtcaggccatggtttggtgggagcaggaactgttcctagcatattctgtggtacattgtaggtatttaataaacattcgtcaaataaatttgtaatatttattaaggggataataataatagataacatatattgagtgcttataaggcacaagaccctgttctcagtgctacacatgcatcatcattttttttctcattaaacctctatgagataaattttacagatgaagaaatccggtgcacagagaagtaactagctcaagatctctgctgaagcaggtgatagagtgaacacgccaatggccgtggtctaagtccaaagcttattctcttagtcactacattgtgctgaatgtatgttttcatatttgtatgttacataatttccagcataataattttggttccagtgttgaaggtaatagtcataaggggtggttgttatttttttgaaattgttattctgcatgtcaagcttatattatgtacttgccatattatcctttcactagctcagaggttgttgttattactctgatgatgttgattagataatgaactgtcagaggagtcagaaactagccccaggtcatataacaaagtaagtgccaaatagaaggtttgaactcaggtctaacacattccaaaggccatgactttcccaccatgacagtgaataccttacatgattggactaggcctatgtgaattcactaaatcctacaggtatgatttgttgttgtttcttatctgttgttaaaaccagttttataagagccaatcatcaagaaggccttcagatatgtacatcaacaatgtgattcagactaaatgtctgaggtgtattttcaggattctgcagagaaaaggaaccaatggaagatatatatgatttattttaaggaattgcttcatgctatagtgggggctggcaagtataacatctatagggcaggctggcaggctgaaaagttgacaggagttgaaacattgcagccttgagacatagacaatgggttgattataaagacctgacttaagtatccacgtaccccatcaaagtgcattcacaagagaccctcaaggactcacacagatggttttcaaactccatctagtcagtactgctctcagacttggacaagagaggctttgagccagggttctataccttagagcagtttgtcttggtggctataacccctgccataggcttatagcatgtaatctgtggggctgaggggatgtgtccaccaggagcctatgcctgctttctagaccatgatctgggtacttgggacccagaatttctctgaaaaaaaaaatggcctgaacctgaatagtcatttctcttaaattttacctcccaagggtgtactgcaaggctattttgcagagattgtggacaagatcgtggacggtgtttgtaattatgggtagggtgtccagagattacatatgaagtcccactgtgggccatggaacttggaatggtaagaaaagttggggagactgtgggctgggttccaagggcagagagccaggagctggtctttctcattccagaattttccatcacaaactgaggagtacaagaattctagatctaaacatagtcttctccatcattatgaagatatatttgacaaagtaggggatagaatatgttttatttaatgattgcttagttttatttataacaatttatcttaaatatttagacatatggtctccatttgtcctcttgccctgggctccgtaaatgttaagtaagagcctttccttcagaccccttgaggattcctcagagttacctgagaagaggaggaggctgagaacagagtttgagcttcccaattccatctttaattagaatagtacttttatttattagtttatcatgtcagactttgttgaacaaaataattctgctggcttaaaaataagtgtttgaaaaccacaggcttccaggcacagtggtgcacacctgcagtcccaaatactacagaggctgagacaggaggatcccttgagcccaggagttcaagaccagcctggacaacatagtgagatctcactggttaaacaaacaaaaaacactataaaccataagcaagtatcatattaaaatctgaagggaccttaaaagtcttctaaaaaaatttcataattttactaatgagaaaatggaggcccatggaagataagagagtcctagagtccttggctagtgctctccgcgatattggctatgatcatggcttgtcttcgccaggctccttgaagaagcagtctgagatgaaaatgtagaagagataagtttttcttaaagatatccagcatactggccgggtatggtggctaacacctgttagcgcagcactttgagaggccaaggcaggcagatcacgaggtcaggagatagagaccatcctggccaacatggtgaaaccctgtttctactaaaataaaaaaaaatagctgggcatggtggtgcatgcctgtagtcccagctactccagaggctgaggcaggagaatcgtttgaacccaggtggcggagattgtagtgagccgagatcgtgccactgcactccagtctgggagacagaccgagactctgtctcaaaaaaaaaaaagatatccagcataccttttggagcctccttgtgcctattacagtggctcaggtatccaaatttctctccttttgcactcatctttattgaagttttggcagaagaaggtgcaattgtttagtaacattataaattatctggtgccacttctggtggcaatggcattttaatctttttctctcattttaaaatgaattatttcttggtgattaaataagagaggcattgcaatttgtgtgtacattggagtcaagcagggagagctttagaattttgtacactacctatattttcactcattaggctctctctgaaggtaaagagttaataatgtaagcgatctagaaagagtataaatttttatatctttctatccttttagattgcagagagaatcaaagagcaataaccccatgtaacaattagcttagatttgcatgcccttgcccatgaaacaataggatctcgtttaaagatttctgggagactagaagaaaacctgttctacagtagaaaagtgtaatggaatcttcagcttcttccttggaagatcagagacttggagtccatgctccctggacagagcacaccttaacaaccacaactattttcaattgtccccggctcagacccccttcatggacttgatgccaatcctacttttcccaattctctttttcttctctctttcagagctttcagcatctattttctctctaccaccactctcacagaaggctgacctccaatttgtgcaaggctccgtgttgtttattctcatgatgttctctccattctgcttttatcattccacattcaatggcttagtttcatttattcagggaggtgatggaactaatgtggaggtgatgctggcattatttagagcttacatctctatatactgatggcctaaaatccccatggcctgaggctttggagacacagagccgttggtagatgacttttacagtctaggcaggaagctgtgccatgtttgactctaggcagcctagtggatgtcctagaagcatagtggaggaattctgcacggagcaatgtctctctgttgcagcaaacactacacataaagacaccctagatactagtttgtcaactttgggacattgtcttccaatgtgcatgtcaaatgtaagtaggcaaagtgggtctaattatgcatattattatattaagttggtgcaaaagtaattacggtttttgccattattttcaatggcataacccacaattatcttttgtaccaacctgatagaaaagtctactgataatgatgatgcttatagattcaggaaactaacaaaatgggggaagaaatggtaaagcatgattttgctgtgtaagagaaataatcattatagcaattaaaatgtgctctttggtttttataccttactatcatactattaggttggtgcaaaagtatttgtggtttttgccattaaaagcaaaagaaaaaccgcaattacttttgcactgacctaatattataataagtatgcatagttttcttatgcatagtttacatcaaactttttatgtttaatttaactatatactattttctctttgcttatttcagttttcagaaagtatcactcaactttttttaatatagcatgattaccctcaactctcaagaaacactatttataaaacctgaataaatatatctaaagtttagtggtaatataagatatccttgacaaaaacacatatgtacgtacatagtttgtatacacattttgaaactccatgatattttacctacatgtattataaaatatataatatgaataatatataatattaaaataacgcataatttattaaatagagaataagcttgctctctgaatttcaagtaggtttaaggatgagttagggaaccataaagactggtaaacaattggattttccgaccacattacagatggaagaaaacaggactgaccctcctagagagtcagctagcttattagaaacattgtaggtgtggtggtgaacaatgtgggctttggggcctaacatctggattcaaatctcagtctgttacttagtgaacaattacttgccctttctgtgcctcaatcttcttaactacaaaatgtaaataataacagaacctacatcatagggttattgtaaggactaaacctctttttacatacatacatgtatatatatacacacacatatatacacatatatatttatacattatttaacacacgtatacatatacatacaaatatataaaaatatatgtatatattaatcaaaccagtgtttctctttctcaaaataagatagtggagctgaaaacttatgtaataagaaagttgttggatagttctggcaaggaagtgtcataccatatttgtgatgagttataaactgagatccgtagaatctctcagaaagattaaatatctttaactgaaggctcccaaatgctagactcaatagctgtgtatttaccccagcaggctccaagattaagttcaaacttattgcaatgttgttttctatttgaacagaagaccaaagttggattcatctgggattattaacgattatatttatttgcacctaagtattatatttctttaagttgcacattatatatatatttataaatttggtaagcgttaaaataaccaaaggtggaagtaccaaaaagtgtcatatgtgtgagtatatgtgtgcataaattgtacacacacacacacacatgcacacataatggaagcaggtattaaaatcagatgctcagtctgtttgggaatcctacacagaggactacagtctaagcaccattattcacctggtgacaggtactcaagttgtagatgtggtatctgaaaggaaataaacaaccttacacatgcaaaccttgcaaacaaaacctaaaagtgatggctgttgtcacttccccagcaactttaacaaaattctttcattccactgaattaaacagaaagagcaccaggatcctagattctaagcccacctttgcctctgaacatctctgtggccttgggctggttccttcacctttctcagcctcagtttcctcacaaggacatttgaccagatgatttatagggcatcttctaactctaagattatgtgatgttgaattctgtccatgtgaggagtttgaagaaggatggagacaagtcaatttggacaggaaatagaacttgtatgattctaaaaatactgaaataaaaatataaactccagattaaattccttagaaacttgtaattatttaacatctttttagaatggtatgtattcctgttcagtaatttcaaattttatatacgtttttagcaatatgtgtaaaatacatagagctttgctaaccatgagcaattgttatgtctcataatattcactgcttctctgttttaaaattttagcgtaaaaggaaaaagcctttccttttcatgggtactatagcttgatagctgcaagtccaaaactatgccacaaaagaaaacaaaattttaagctttagataatctttaaatctgttctttgctttctgaatctttaaaatttctgggatttttgtgttcttcagatgctatttcttaataaccacacaagttattcaattttcatgtccaaaaatgttttatggcctcctaattaaaaagaaaagattctccatattgccgtgtggttactttattgtgttggatactgtgataaacactttctagatattgatttatttagtccgcaccacaagcctgttgcatgaggtaatataagaacccattttacaggtaatagaagtagacagtagaaatcttaattatgtagtttgtaaatgtcacagttggaattcaaaacctctgtcagtttgctgcaaactttatccaaattttaaaaaatattgtcaatgccaaggctataaatgctcagtttccagtactttatttcaatttgaatatttaccatggtactgaaatacgttgttgttaagtgaatttattgttaatggattaataactaaatatattaactatgtgaatgtatgtattcattccatctatgctgcttttgaatctgaccaggaagtaatgccctctaataaatgaccacatcctgagagtattttatttaataaatagccaaatgcacttattgtgtgcaaagcactaaccctttatagacatgaactcaattgattttcattctaatgcaatgagtaactactattattatctccaattgtactgatgagaaaactgagtcacagaaaggttaagacacgtgcccaccattgtatagctagtaaataaatggctaaaaccaaaacacaagtagtctgtatccagagtctgggattataacttagtatattttacttgatttctcattttaaaaaatgttttgatactgtcttcccactttgcagttttaaaggtttgagttttaattgactgctaaagctaccgacaatatttgccagctctcacagaactaaacagggagatcacaaagaaatgcccagaaacaatctccaatacttgagaatctcctgcaaactaggcactatataaagttccacagacaatacaagttatagaaacttaaatatggctgtatcattctttttattgcatttgatcaacatcacagatagttttgcgttgatcttacatagttttgtaatgacaagaattctaggaaagaaagcagcaagcacacagttcaactttgaagtttgcccatgctagtggttaagagttcatttctatcagcatctgaaaagttaacttttccaagcatggcagcttttctcaaagacgtgtacttgatgcttgagctcttgacttcagtccatagacgaactgcttattttagaaagctcagctaacctgaaggccatcggctcactgttgggtggggggtcctgaaaggtgagtaaatttggcaatataccaactatgtcaattacacacccccacttttcctaccccctaccttccttactccccacagggtgcataagaaaacaatcatgttatattaacttagctttatggaaaaactcaacaaatatatttaacacactggttataggttcattaagattgccttaaaaagttggccctgatactaagcaatatgaagaggaagaagcaaattgtattgaaaatcaggaatttccagctgctagaagggctgcaagggctgtggagatgtaatgtcttaagagtggagagaaggtgctgacgacattgcatttctgatggcacccacggttagtagatacgcaggtgatcctgatgagcttccttcacagttggaggacagatgctgtaacggtagtaatagtgggtgcataaagagaccccagcaagagtataagtgaaagggatgcagctttcctgaaaacatgaatatcaaaggcggatgctggtataggacacagtcaatcagcttggctggtgatggcaagctcctgctgtgataaaaaatatgaggcaaaatatgaggaaaatctgataaaaagcatatttttgaactgctgtgcttgagacagcatggtttaatgcttgggctttcttcttggttcagcttcaaactgagctggctctgagtagctctccttgcttgggaaggcagctcctccaagacagggcagacatttttggcatggtggtctggagaagtttgcattggcaccctctgggttgaaactggactctggataaacaaagtgctgcagttcccagtgctgccagacccttaaactccataaatatcagtattcatccccctcttccctccccagagaaaatgaaaagaaaacgaaactgcattggagattgcttcccttgaataaacaccaaacacactctaaaaaccaaagctgccctcctctctgatattaaacccggtaattacactatgaagcttaagcctataaattcaagcttgggaaggtaaaattgaggagaaggagaaacctagtaaatgtgcccgttccgcacatgtatagcccgttctcttttgaatgctcttcagtatgatataaacttcactctactgtggtgaaaatcattctaccccactgtttctatgatgtacctccctttcatgctcagaatgctttactcaaaagcataagcattccaggtagaaggaaatcgatgctcttcaatgtgttaaagtttattttgtgggtctgggaatttgtgctttctcctgtttttgaattgatgaaatctttgaaaatagatgccagagctgtgagattctgtctaataagcagttggcttaccaggaggctaagtgtctgcagagaagctgtgctgtttcaaaccaggcccaatttttggttgtctgtttgctcgggtggccactgtcatcctaaatgaaataatatcattcaggcctccccggaactctggttacagttacactcttcctctgaccactcagaatgaaatccaggcaacagtgctttggaatttacaattagatggaaacatggggaagatctgatttttgtcctcacctctctatccttactttccctcattctgaaaatggcattggttcactaacaatgagagaagaaccttgagtttcagttcagaattcatttatttcatttaccattttaatataaagaaagagttagaatagtttggatcattaaaaatacactttcttcagataaaatttttcttatgctttaaaaaaaataaagagcctcatcctgtttaatggattgttttataggtcagagaggataaagctaatatggcagcaaagtaaatgaactcttagcccagttggccaaatttatcccatacggctagatttcttaagtttatatttaaaggtaacttgactactcttcaggatatttctttgtgcttttgtcctttctccccaatctattctattaacaatatctttctctctcttcccagaaagatgcgattaggttcttatcttcctttcgtaatgtgtctttctgcttccttaatttagttcacagctccatttgtgccaaccgtggccttgtcctggaccatcttgccacatctatgggtgcagttgctggaatttcaaggtcaatgcctcctagctctatgtgaggcattcctttctgctgacccaaattggaaacaatttaaactttgcttttggccttttctttctcttctatgttctatttctatgtgttctcaagccttcttctcctcaggcaaagatagatgagagtcaccttttttttttttactgttgtggtgccacagggtattttattctgcagatgatagtctttcacacacctgtgaacacacagataagcaggatgatgcataaaaactcttttattaaaggctaagatataccagagacacagctctgtggggctgtgggctcccatcccaggatggcttccttcactcctgaaactgcttgtgtagtaaagtgtcattttaatgtttaatttgtataattgtttattaaattctaggctaaaatgatacactacagaatccatcttaagagcaaatgtagcacaaaataataagctcaagcataaataaaccaagtttctgagttgaatggcaaaaatagagcttcaagttttagatgggcctcatttatgaattgatagcaatcgtaacaagagctcaagtcatgtgaggatggaagagtagtgaaggttgatgcaatttttaagaactatatttgccaaatgacaattttatatttgaaagaaggaagcaaaggtgggttttcatggagaataggaattgggtaggacaggaggataatagagatggaaaaataagtgattagaaaggtccacagatgagttcagttcaggctttcaggtctctatgttacactgtagtcacttaatacatttctacttaaaagttaggtcattatgtggtgaggttaacatgtatacatggtctcatacacagataaagaaaacaacagaatcagttcacttataaatttgagtttggttggctggaaaaaagtcaaaataaagactgatgtcaaccatattcacaatgagagaaatatttcagaatgcctatctcttaatttaaaagagcagatatatttgataagattgcctttttaagctgtgtgggattgtcttccccataaaaaaaatctatttggaaaatatattcaatgagtaatgaagttgaattatgttaaaggttattgtcatcacgtaacggtcatgtgacaaatgtgctccaatagaatcataaacatgtgaagccagccataacaatgaatgactaaatttagagagtcagagtgtgctcactctcccagatactgctggatcaaaatacagctacatttctaagccttagcaggtttgatatgactgtatcacaggttatagttaattacatttttaaaagcatttgacatcattactctttagcttcttcaataggcttagcagtcactctggaatcattaacagccaatttaaaataacattgaggaatatcttctaacaacttctttctagaactctattcttgcatttcgatttggttaagatgaccttatagggtacgcacaaatttttaaactatgaattcttgaaaaagtaatttttaagaatcaagggaggaattagagaaaaattacaataagctgcttcttcccttgatggttggcagtatcatttgtttgatacctactctgggttagacatgatttttaacttcatatatgcacctttctttgatccttctgagtgtcttacactgtgcatcctagatgtccctcacttgaatccaatattgaaatatctcctactggctacatatttgtacagcttttacttgtaccagaaactggtatattagtaaattcatttaataactaaaaatcatgattcaagaaaaactagtcaatagacaaataggaagatgtatccagcaggaaccaaggtaagcttaaaataataaggtgtcagtatctttctaaagctgtggctgattgtgtggagttttcttaatcaaagaactgaggacaaataaaaactcccatttatatttcttaaaacaagaatgctcaaagtagccattactgtggtgagaaaggtttttaaatattagctactcttattggttaacttttgagtgtattagtttatattgctatttatttatattctctcaccaccagaagtagtattgacatgaccagtgatttacttataatttatttagaatttagaattttcagatgtttgtaaatttacctaagctgttaatatgtatcaatagagagaatactgtcagaatgtaagagtaaggacctccaaaattattttcctccatataaaaatgagaatattggcaacaatgctcaaaataaacttttcaaaagtgtggatactaatcaaggcttgcaaaaactctagcagtctttattgaagaacaactgttagatcacagcaagaacagtaagctctgtggtattataacctaaactattcccattgccctctcccttgctgcatgttagccttgaaaaccatcagtcttgtaaccatgataaccatgaaaaccagtagctgagcagccacaggaggtgacccacaagccccatctgcagagaattttgattgttagacctgtctagaagttccttggaaatacccactcacaggacttgcttttatttgtcctgactcagcttttactcactgagaacagactttttctaaagacatatgtggaaaataatcaatggcaattgtttgagatcacagctgcctgaaatcataacagctggagcaaataagaaactgaccaaaaaacttaaaacaaaaagctgggaaattagaggtctatagagggtttgaaaagctctgacattttcctggaaatctaaaatgcatgcacatgtgtagggctgtgcacctgctgccaaaaaacttgaaaaggctctaatgtctcatctctggctgaccttgaggctctgaacaaggaggacatgaaagttaagatacagttgtaaactctttgcccaagcattgaaaatgtaacccaacatacacacaaagccgtttagcaaaggctggaagacttatttgttcaagatatttaaggaaatttttgtccaaccaagctaactaaatggagactccagtggccaaaaacaataaagaaaagagacttaagtaattaattcaggaaaggaaagtcattaaacaaacaaacaagaataacaaaaacaacaacaaatattatcaaccaccaaatttggggaggaaaaaatctgatttcctgagttactacaatatactttaaaatatgtcaagttaaaaacaaacaaacaaacaaacaaacaaacaaaaaacaccttacaccaaaaagggaaaatcatggcccttacagaggagaaaaagaacagttaatagttaatagaaattgtcctttaggaaacccagccattggacttactagacagactttaaaccacctattaaaggtatgtttaaaaatctaaaggaaatcatatctaaaaaattaaagagaagcatgagaatgatgtctaactaagagggtgaaattgataaagacacagatgccataaaatgcaaccaaatagaaattctggagttaaaaagtacaataactgaaataaaaattcagtagaaactttcagcaccagatttgagctggcagaagaaagaatcagtgaactcaaagatgtcaatagagattattcagtctgtgtggtaagaaaaataaaagtgtttttgtaaaagctaacaaaattgaaaaatctgtagctagatggaccaagaaaagaaaaattcaaatttgtaaaattaagcgtgaaagatcagtcattactaatgatcttaccaagcaaaagactttaacgaaataatatgaaaaattatattccaacaaataagataacttacaaagacataaaatattgaaactgatcaatttttaaaagtctgagtagatttagaacaagtaaagatattgaattagtaataaaaaaaattatcccacaacaaagaaaataagcttagatggtttcattgctgaattttaccaaaaaagaactagctccaatcctgcacaaactcttccaaaagatagaacaaaaggaacaaaaggaaaatgtttctaactcatattattaggcttatattaccctgacactaaaaccagggagagattctgaaaaaaagaaaactatagaccactaatcctaaggaacatagtcataaacatcttcaataaaatactagcaaaaagaatccaattatgtttgttttaaaaaggattgtacacatgaccaagttgattttaccccaggaatgcaaggtagttgaaataagtaaaaatcaatcaatgcaatatactatattaatagaataagcttttcacaaaatccaacaccctttcatgataaaaataatcaagatattgaagatggaagtgaacttccccaacctgtgaaagtcatctacaaaaaaaatacagctaatactatacttaatgacaaaagactgaaatatcaggagccacacagggaagttcactcttttcatttatgttcaacattatactaaagtttccagccagagaaattagacacggaaaaaaaactaaaaggcatccagtttcaaaaagaggctatgaaatactccctttcacatatatcaaaaacttatgtatagaaaattctaaggaactacaaaatcgtgattagagctaatgagcacactcaataaaactgtaggatacaagaaaattagacaaaattcaattgtattttatatgataacaatgatccatgcaaaaatcgaattaagaaaacaattaatttataatggcatctaaaagaataacatattcatgaataaatttaacaaaacacatatacaacttgtacactgaaaagtagaacataatatttaaatacattagataagacctaaataaatggaaagacatctcatgttcactgatcggaagacttaatattgttaagatgacaaacaatttccaaattgagttgcaggttcaatgcattcctcattaaatccctattgccttacttgacaagctgatcctaaaattcataaagaaatgcaagaaacccagaataggtaaaagaacctttagaaaggaagaaaacaaagttggaggactcacacttccaatttcaaaacttactacaaagctacaataatcaagacagcatgatactagcagatgaatgaggcacatggttcagtggaacagaattgaaattccagaaggcaaccttacatttatggccaattgattttcaacaagagtgccaagatagttcagtgggggaaaaagaacagtctttacaacgaatgatcctgccacaactgaatattcacatgcaaaagtttggagatggaccattagctaacactgcacacaaaaattaacccaaaagggatcatagacctaaatacaagagcaaaaactataaaattctttgaagaaaacaggtataaatctttctgaagttggagtagaccatgatctcttaaatgtgacaccaaaaccacaagtgtcaaaagtaaaaaatatttattaggcttcaaaattaattgaaatttaaagtcaaaattaaaaacatttgtgtttcaaacaacgctatcgagaaaatgaaaaagcccacagaatggaagaaaatatttgcaaaaaggatttttatccagaatatatagagaaatcttataagtcaagaataaaaagacaaactacccacttgaaaaatgggcaaaggacttatatagacatttctccaaagaagagatacaaattgccaataatcatgtgaaaagatgctcaaaatcactaatcattaggtaaatgtaaatcaaacccataacaagacaccaattcccatgcactaagatggcaataataaagaagacagataatgacaagttttgccaagaatgtgaagaaattaaaaccctcatttgctactagtggtgaatgtataatggtgcacactctttggaaaacagtttcacagttttacgaaaagttaaacctagagttacaatataacctagctatcccatttcgaggtatataccaagagaaattaaaatatatatctgcacaaaaatgtggagaggggtgtttacagaaaaactattcaaaatagtcaagaactgtacataattcaaatgcccctcaaatgattaatggagctgggtacagtgtcacatgtccgtaatctcagttactgtagaggctgaggtgggaggactgcttgagcccaggagttcgaggccagcctgggcaacatagggaaacctagtctctaaaaaatataatacattttttaaaaaatgatgaatggataaacaaaatgtggcatatccacacaatggaatattattcagttataaaaaaagaatgccgtgctgatacctgctacgatgtgaatgaaccttctttgccgagataatgttggactaaattgataggtgaagagtgagaggttataaaatataataaaacattgtgaagtatgcagggatttcattagtgaaagaagttgaacaggtggtagagcaagaggaccaggtctatgagattagttgtagacagttctctttattatttaataagcactcactattgtcatttaattctcataatattcctatgaagtagatattagtattaatttccattttctagataaggaaagctaggcataaacaagttaagtaacttgcccaaggtcacacagtatgtgatatggttaggatttgaacccaaactctctagctccagggtctatgagtttttgtttttgtttttgtttttgttttttgagacaaagtctcactcttgtcgcccaggctggagtgcaatggcacgatcacagctcactgcaacctctgcctcccgagttcaagcaattctcctgcttcagcctcccgagtagctgggattcgagatgcctgccaccatgcccagctaatttttgtatttttagtagaggcagggtttcaccatgttggccaggctggtcttgaactcaggcgatccgcctgcctcggcctcccaaagtgctgggattacaggtgtgagccactgtgcccagcccagggtttgtgtttttaatcactgcactaagatatctactgtatactgttaaagaaatgaaaattagattacaaaaacaacagattattatgatttcatatgcatctgtgtatctcaaagtggtgttacttaacacctcttttattgcctttgacatgtctttcagtttttctgagaactttgtggctatattctgtctgtactggaatagattcctcacattttcctcctttgacttactcattcaaagcaacaagcagtcaatcttactcgacttcttcaatttacaaatatttgtggggggtactttctatgtgccccagttccaagcttggtgtttttcagatgagaccatgtttaagaaatagtttcctgctggtcatgagcctataggctagtgggagagatgaaaacaaaatatgataaactgaacgctatgcttgcaacataagaaagcgctgtgggagcagtggtggagaggctgggaataagctttagaagtggagacatgggcttcctggccctgttctgaagctgacccatgcaccagtcatgctataaactaacactggggacaatctgtacatggggggctctgaggtcccttggtcactctggggcccctggtcatggagactctgcctctcccctctccagagacaatcccccaagaatatctccttttagatcaacatcctcagacaggatctaaaaataaataggtccaccacagggagaatatatagggtggttttcatctaagtttattaatcatttgctagctcccagttaagaatcagacttgccctttttagaatcttttattttcaagttctctttggatactaatcacgttcttcttttctcctacccaaccccgttgtcctttactttaccagatgcatattcagtctttctaatccatccttccaagtcagtgccttcagactgatgatcaattgtttgcacttctttgaactcccattaatttatctttatcaggtgggtatgaaggtgttggggaataaaagcaaaagtagaggtgtggtgtcaccaatgtctcttgtctcacatataccctgcaatgacacccatatgtatgattaaaagggctttaaatgaatagggaggaatggaggctgtcttttgtaccaagttcattctgatttacaagctattattaaaactagtgttaaacatctctgtgctgtccagtgcattagaactaaaccaagttctatcaatgaaagatgctcttatttctctaaccctttagtttatttttcaactacaaacataatccatacccactgcagtataatttaaatatacagaaggagtaaaacaaatccagtcttcccctccttccttctcctaaactgaacagtttggtgtatatctttcacactttcttccatgtatttacaagttttcagaacctggaattacaccaaccacagcactctgcaactaactctcttcacctaacatcaaatcataggctttcttctatggcagtacagataggtacaccttttgctttccagcagctacatgtttttccattctatcgggcctactataatttatggcattatctgattcatatttatttgcagatacattgtggtgaaaactgaggattataagtagaaaactgtttaaaatttttaaatcttttctttgtattattgctgttgtcactaagatgaatttttctttttctttttgtcagcattgatccatctctttcatgtgttagttttcctcaactttctagttttccttggttgtgagattagtctcataagtgagttaccgctagttagtataggtagctggtgtaagtttccttttagatttgtagagatccatttcccagtagccttcatcgttaagagtgagggttggccatgagccttggattagaaggcaaggagtgttagacaaaggaagccactacaattccctaaataaggaggacttaccatgtggatggagagttcaatgtgcttgtttaattgctgggcagatgtggctctccttctgcccaccccacccccaccttgccatgtctgttataaaggtcaactaaagtgtcaagcttcactgtacttcttacacctccctacacacctactctgtgctcgcaaaccctaaagagatcatacattacatagtgagctgttctctttcttcctgcagtcagaaagccactgccctctgtgctctccatagcagagaaagtggtatgaatgaggcacaatttgctcagttattctaaatctttccttcagttaattcccctgctgtttaccctattacaaataaggatttttaagcctgttaataagaagaaaattcaatcaacaatatgttgccagtttttacttttcaagttgacaagaacaaagataaaatatgtaatgctgacaaaaatgtaggaaaatgagcttctgcatcgagttttttggagagtacaccgtgatgtggaacattttttttcctggacagtatgttggcattatttaataatattttgttgcatgaactctttggttctgaaacttcacttttaggaatttcacttaccaaaatatttacacaagtgcacaaatataaatgttcaatgatcattatagctgcattgtttgtattgaaaaatagaaacaacttaaacatccactatagtaggccaaacaatggcccccagagttattaggttctaattcctggaatctgtgcattttactttctatggagaaaaaaaaggacgttgtagaaataatttcaggatcttgagatggggagatgactttgaattatctaagtgggacctaaatgtaatcacaagtatccctataagaaaaaggcaaagggggatttgacacacgcagtgggaagctgggacagatagatctttgaagatgctgaccttgaagaccggactgatgtagccacaagctgaggaatgctgacagacatcaaaagctggaagaggcaagaaatgatttcttccacagagcctctggaggaagcatggctctgctgacacctggatttctgaccagtaatactgatttgagacttctggcctccagaactgtgaaagaatatatttctgttgttttaaggcatctaatttgtgctagtttgttatagtcaccaagcaaatacactcatcaaagggaaatggttatgtagattatgttgtgttcacatatgggaacttaataatgacaaaatatggtatgtctctatatttacatagaaaatgttctcagatacaattttcagttacatcatatttataccataatcccatttatatagaagagaaaagtaaacctatatgtgtgtacatatatgtaggtaggtacttgtctggatattattttcaaatgtgagtgtagtagttacctacaggaaaggtgtaagttacagggaaaaggaaggaaaattttcacagtattgtattatttatgtattttgcaacatgcatatatttctatattatatgtatcatatttttaagggaaaaatgtggtaggagttttccccaaactacatttttatagaccccaaatatctactttcttcgaatacttactcaatgtttgtctccttcactagacttaaagttccttgagagtaagagcctcacctgtcttgttcccttttgtctacagcacctaattcattgctgtcacatattatactctcaaaaaatttgtgtgaaatgaatgatgggctgtaacatctatcagcagcagccaaaggtgagcatccccatgaactgacagcaaaggcagtcagtaccttaagaaatgacagcacctgccttgtttcttcagggcttcaccatcaagaatatgacagcagcagcagcttaagcaggaaaatacacccaaatgtctcacctctgtttccatcagataactagctcactgtcataagcgtggaatatcctgagagggacccagctgatgtggctctgattgcaacgtcgaggatagtcttctccttcagaagcaatatggtgaatcaacgcttgcagacacagggcaaacccagaatgctatttgtacaaacaagtatggctcctctcctgcggaagtttccagtgcagatgccaatgtctttgccatccatttgcccttaaggaaaagggcttgctgaactcaggcaaagtagggaattgagcctgttgactgccttggatgcttagtgtcccatattccctgtggctagcctgggcagagtctgtgagggattagagcatgaaggctatagtgcataatgagtttaaggaaaaattagcctgaaaaaaatcacttagctccaaatgtctagtgatatttatagacgttgtgggttaaatttcacttcactgactttgtcctttacattgacaagctagataagatgatatcgttttaaataatcatttgcgtttaggtatttctctggcagttttgtattacagtttaaaaatagactagcctatgtctatggctcatgttggctatggtattttgaacttgatttctgaggctgctgacagcttttgaaagatttaacaactggcagcaagaaaaacttccatagaatctcttctctgaaattttttctgctggaaaaaagggcatcacttagcaggtaatatattgcaatgaaaatatggttatgaaataatggctcattaatatgataaaccataacataaccttttctattaaatgtaaaaagaaatttcttgaaatgaaggcattttccttcctgtggcatatttttccatagttgttgatttggaagaattttttaaaattattattcaaaacagtcattttgatttgcacaggagataacagttgttcatgacatttttatttctgcataaacagatttccattctggcgaaggttaatacagtaggaatttgtttttacttttggatataccgtgatacactagagcactttgttttgtatggaaccactaatttatcctttatgcctttacgatcttgtcagtgccgcatgtctcccttagtttttctaatctaaaataatcccagtgaaatcctttgattgtctgtttggacctgctccattcctaaagcaggaatgtaatgggctttatggcacttacttgggagtaatttatccagcagagtgactatagatacttgttttaataagaatatgctttatggtaagtgggtactgctatttaattagccaaagggaaagtagttcatgatacaatctgtcccaatcatcttggacattaaacaaaaagtcaggctaagttatttatgtgcatgcactttatttgtagttgctttgagcaaacctcttctttgaaactttatagcattttctgagtgagctgaattgtgggaggaggaataggggaagaaaaggacatgagagcattctataaaatttttgaaaaagaaacagaagctttacttattgctatcaaggttgtgaatacaggcataccaaatggaaaacaggcagggaactatgatttatcctctgctatttggtagtttgcatctttagtgcatagctgatggaagaatgttgcaggatgtcagtaagacattatgggattgtgtgttcctgtgtgtgtgttttccttggatttccattgctttcagcagcaacatgtttctgaagattcacaattatagtcctatatttttattataaataactaaatttaagaagttcaatgcatatccaattatttcaatacttaaagcaaagtgtaagcacgtggatacattttaagaaatcttcccttcctaataatactacaatgatgatataatgggggtaagtaatatgaatttctaattgtccaacagtttgggcatgtaagtaatattaatatatttatggatgaacggggaaaaaagaaaaagtgaaaaaaaaatgagacaatatccctagggtattacagccctggttatggtctgctcagtaattacatatttgttccctttcttaggcgtaaatgtctcagtcactgactataagtacaaagggcccagaagctggaatctgaagacaaacatggctccactacattttactctcattgccttgggaaacattacttaaaccagaagaatctattgccctctttacttcacagtgctacagagaggattacatgagccaatatttgtgagtgccctttgtaaagtgaatgtctagtgtaagtcagcacttgcttataaagctccttaagcataagattttggttatgaccatgtttgcacatgcttgcgcgggaccttctatatggttgaggcttcctaagtggagtctgggtgaaccagtcttctgtccgtgcccttcttgcatggtgcacaggcattttgctcctatttcttatacctctattattttgtctgtattacatatcttgcctttttcaaagttaccatgaaaactaaactcaaactaaagggctttaattcatgcagtttgtgtctgccatctaagtaacaaaagcactatcttttcacaattgacctatctctcagcagtggcacaaaaatgtggtgcatggactagagtcctaaggagtgcactgtggatgaaggactctgaatggccatccaggtggtcagtgttaagtgctaccctccctacactattgtgtaatctttgtataatttccatcttaccctcagctttactttgccatcagtatgctctctctccctctcccttctgttcacctgggaaatcttttaagctgctaaacaaaagccctaagaatggttgcatattaagttattttagacagcttggggaggttatgaaaagttttggagtcattagcatttcaacaattgactgccccactgtccccgtctttaggaaacacaggcagtgcagtcggcccatgaagtgaaagcctgggtgagcctgtgtttagtacttttaacgtaagaagacagaaaaggaaatactaaagaccgaactttccttcaactctgtggtctcacacatccctcagtgacttggaaacttttctgacatgagacagtgtgcagagcaagataaccactccccttcctcctcctgaagatgtgtaaacagctggtgcatgcaatccctctggctggagggaagtaaatgcagactgatgttaaacaaatataggccagtatcaggaactcagaaaatattacatatacaatgtgacaaggggccctgcagggttcatgatcattgcaggtattaagggtcaagagttggggtgtcagagccaataattttttttaaggctatgtatttgtttcttgtttggaattacgttggttcttttgctagagttttcttagcatgacatcacacaattgtgaagaatgttcatcactataaagctattataattcctcatttttttgttggctttaattctcaaattttatatacctacaagtcatgttactttaatcacatcttgagaaatcaatgagacgtcactttttccttcaacccatgacacttacgtgagctctggataggaataaaagtgagtggggataaaagcttctgttaactgtgcttttctcctagcaggcacatggtgttccaagttcttggctatttcataggaatcttgaatacacaattatgaactaattatcaatgcctgattcatcaagtaacactcatgacatgagtctgagtggcacacatctgacagcaagtggagtaaactaaacacactgtccctgtcctccagaactgtgtcagccttgctgatattaaagcttgataagccacaatcatctttgtcttgtgacatggtagctactcaatcaatcagttgacaaaactgaatgagaagtataaaataaaacagaaaatcaagcaaacataaagcataataggaacaaaatagaagggccaatttctcttttatcatcaactttgtaatgctggaagttctgcagtcctcagggtctaagaaaagtggagtaggcgtctatctcggtatcaggatttatacttatatttactattatggcattgaatggcttacttttgtctttctcaccagactccaagttcctgtgggcagatctcacgtcttatttcttcttttatccccacacattctacaacttctacaagatagatgctcaatcatggtttcacaatggatgaatattaaatgaatgaacgaacacagctcagtcaggagtagaactaatatgcagtaaatcctacttgtatttttcaccttagtgaggtcacttcacaccccagatggcaatctttcctatataaataagcttaaagaaaagaaaactgtgttataatcactctcagaagaaagttcagccaaaaattgccatattaagatgattagcttgtatgtaactgagtatcttaggaataattcatgtcctgtgccagttggtgagcttctattcttcttgcttgcagacccttattagagattttctaacattttttaaagggaaagggtgaactataaattatagagattgaaaatggtaatgattctatttgtattattattcataatcataacccaattcttaaggttctgtaccaaggattcacaatacatatgaatatatatgtacatatgcatatatacacacaatctaaactctgttctaaatgacttggtaaaacattttgctgtttctttttctgggagggcaagcaaaataagtcataagtctgtctgagaagctgttaggcacaatctttaaaagctttaattcttttcaaagcatacttgcatcaattacttccttcctctcatatcagcatggaaagtagacaggacaggtagggagcataacctccttttttctgagagaaaactaaggttcatgaacccattcacttggtcctcagcaaattcatatagggcactaactatgcataagctacaggagttgctggttttacaaagtaaacatggtttcccttcgagtaactgacagcctatttgagatagcattgcccttggaatcaggtaaccagggtctctgcactaggcactgagctttagaaggccctacctgccctctctgactgcaattctctccatggggcaaggaatccatggagccaaggagatatatatacccagactttgagcaatctatcttcccatctccccccacctctagaccacacactaggtacctgagactcagaattccccacccagtggggaagccctacttcctgggcttgtgaagcacctcttccccacttcaccctcccaaggacacacattcaccatgccaagggttgagagagaaggttggagagagctccaggcaaatgtagtaacaggcctgagaagaggagatagagaagtcagcaattacaatgctgcctgtggtgatatggaagtgaacagggaatgctagggaaaggcagaagggacacccagcccaaatgaggcatgaagaaggagaaagagatgggagcaaaggctgttgaaaaagaagctgagcctcggaggctgggtcagaactaccacatgaggttagaaaaagaaaggagggcattttagaagagtgaaagaaaggtgtacgcaaaggaatggtggaggattaatggaattgcaagttcttctatgtgcttgaagaaatgaaaaaagaggggtagaaaataagttgaaagggagagatggacaattaatgatatttgtcactattcattttactttcttatggcgctatgaacctgattttatttggaagtagtgacttctccccatttaataccattcggtggactaataatcaggtgccctgctttctccttgactagattcaagagaaatgacaaaaagactgagaatctctgaggtccttgggtttccagaggtattcctgcaaggaacagtcaagcagcatcaaaccttcagaccttctgaaacagcctggttcctcccagcactgggtctggttct

SEQ ID NO: 210 - DNA, 3086 bp, Homo sapiens
ggtgtttatcttctcatggagaaaggaaggctgtgtgcatacaagtgacatctgctgcttgtttcaagtcctagaattgtatgactaccttagcttcatgtgggcctagtgcctcattctgttggtcctgttctttgattatacaggctgttcacctcaggtacaggtacacatctattgctctattgcttcctccaaagcaaaatgcccttgatattaagttcacagagcctgaggcttttgtccagattttactgatttctccaatttctgcctagtagtaaagtctttgcccttagactaagccagctttgtccactagagatatgatatgagccatatgcgtcatttaaaattttctagtagctacatttaaaaataaattaacagagctaggtgaaactaataatacagtgtatttactccaacacatccaaaataatatgaaatgttattaagatattttgcattcatattttctaagtcttcaaaatttagaatgtactttatttacacttacagaatatctcagttaagcgttcattaaaagtgcttgatctgtgtttagattttataaaatttacagttgaaaaattagatgcacatacctaagttatttcaaatgtacaaaaacagtttccaaaagctgaattgagggtcaattttaaaatttaaatttaaagtaatttaagttaaattaaaaagttagtttctcagtctccctagccacattttaagtgcttggtagctacaagtgggctagcagctactgcactgggcagcacagactatcgtgaaatgcaggccctcatctcaaagcctcctttctgcttgcatgttacatcttgaattagaaagatgggactgcacctcacttcctgaaaataacactcatataccttaaactgacattcaaaactcttagtaacatcttgaaggcattgaaacagccaaggatctacaacttcctaattaaactagctaaaattaatttttccttattttgttatcccaaagaacttcttcttacctctgttttaggctttattccaataggctcatagtattttttactgtatccttggtgaatcgccatgtcataatcctaaagaacatgattcctaagtttagaaaaatctaggtttgatcccccgaatgcccatctattggcttgggcagttatgtcttctgagcctaacattccttatttacaaagtgggaataatacttacttaataatatgatgtagtgaggattataagtgatacagcctataaagtgctttactttgtgtcagagtttgtcaccaaaaaaattacaaaaataatgttagcaaatatttattgatctgtttctcactaaaatttaagtctttaaaggtgagggtcattgatctgcttgctaaagggacatcacctagcactgtgctgtgcatatggccgtatatacagctcagtcaatggttgagtttaaattcaaactgactgctaccactgactggattcagacttcaccctgcttcgcatgccctccttatctccatttgtatatctcttccagttgctttgcctctttgtcttcttggtctcaatagtcactaaagtttcaagcaacaggtgagaaaaataaaattaaaaagccctttttcataaggcaaaacagtcatggaatataaaggaaatttaattttagaactgcattagaataaagttggttaggtataaacccttaactcctagaaacgtattcagagcaacaggcatctccgccagctccctgggaccgggctacagtggagttgtgtcatagtgcaaaagtagtgaactgctgataaaaagcattaacctccatcagagtggctgccattaactgatgaaatcaattaagccagcagcactacctgctgaaaactgatctagcagaggaacggatggcagggtagaacagatgaaatgaaaaaatagtgggctgggttttcttcttgctctgtttttagaaatgttaagttccgtcagtgtgtttttttgcactgctttgaagaactctttccccggcgactccccccctgcttggcctcattccttaaactcactaagttattacagttaataccgtggttaatggtttctggaaagacgatatctatcagcatctgagtgtacacattttggcctaaatactgagaaatcgtaggtatgtaatacaaagcctgggtgtgcctgcctgtagaaagtagctcattaggattaatcttttatggagtgactaatgcaaagggaacgaggccttttcctccccaactcggcagaggttttgtccaaactttcaaacaggtttctttggaatacagctggtcactactgaagactttgctcaaacatatggaactttaaaaccttgattttttttttaacttttgtatactgtagcaattccctgaaaatcaaatggcagaacctaaacggaagactcactgccaaaacgcatgcccagttggggaaaagtgtgtggggaatcatccagcacacttcgagagcttcgagtacagcctggtagaactctgtattaccttctgttctgattcctgagctctgccagacttttgtttgaaaaagcatctttatgcagcagtacatttgttacgttgtatctgagaatactttccaccttggctcctgcttttaacgagtaaaatgacttcttctcttgctacaaagaccaaaaggacacaaggtacaaggcagagcttctcagcagagatatatgtttttttctgccaaaattagtataagacaataagttgtctgtaaaggtccggtagtcagataaaggagtcaagttccttttcagggtaatgtaattgttagtcctcataaaaaaaagtgttgtgtggtggggggagttgcggctttatcaataaaagcatacagagctgaatatctacataaagaaatgttcagtataatttatggcatttcatcatgtcgaactgcatttcaagtaattcaccctggcagttttattctcaaaatggaaatcttagtattttccttgccttcatcaaataaagagttcgtgttcaactg

SEQ ID NO: 211 - DNA, 3577 bp, Homo sapiens
gttcttaagatgacaaatgtaataataggtgaatcgaagccttttaacatagaaaaattaacagatactagattgctgactgcctctatgtacttctcaaacttaaaaattttgtcaaactcctagaaaactgaagttagaacaataattttaaagaaagttaaacttcagattgacttccttagaaactcaatgagaaagcagaatttatttctcagtgtttttggtttgttttttcttttggggctagaaattattttgatgttgtgaaattatatccagtctcatgattgtgctaataagctctactttggtaaagaacagatattttgtaatagcttgtccagaatcaccttagaaacgtgtgtagcaattactatgtgccagaccactgttcaaatgttttatatatattgactcatgtaatccttatacaacctagaagtgggaggtgacaacgtgctagcagccctcactcgctctcggcgccttctcggcctcagagtccaatggctctggacgcgcttgaggagcccttcaacccgctgctgcgctgtgggggcccctctctggggctggccgaggcaggagccggctccctctgctcacggggaggtgtggagggagaggaacgtctgggagccagggccgcaagcggcactcaggggcctgcgcgggttcgggtgggccgggctcagaaggccccgcgctcagcgcagccagccggtgcctgctgggcttgatcaggagatgagttccctctgggctgccagagtgcctgggctaggtgctgcaaagtcctatagcgactgccattgagaagtgaagccggctaggcttctgggtcaggtgaggacctgaagaacgtttctgtctagctgaaggtttgtaaacgcaccaatcagtgctttgtcaaaacggacccatcagctctctgtaaaacggaccaatcagctctctgtaaaatggaccaatcagctctctataaaatggaccaagcagtaggatgtgggtggggccagataagggaacgaaagcaggcctcccaagccaggagcggcaaactgctgggatccatttccatgctgtggactctttgtgctttgctctttgcagtaaatcttgctgctgctcactttttgggtctgcaccacctttatgagctgtaacactcaccgcgaaggtctgcagctttacacctgaagccagggagaccacgaactcatcaggaggaacgaacaactccagacgcgcggcctttaagagctgtaacactcaacgcgaaggtctgcagcttcactcttgaagtcagcgaaaccgcaaacccaccagaaggaagaaactccggacacatctgaacacctgaaggaacaaaccccggacacaccatctctaagaactgtaacactcaccgccagggtccgcggcttcattcttgaatcagtgagaccaagaacccaccaattccagacacagaaggttggtattcagagagcttgtgtaacctatccaaggtcatacagctaaacaggtggcagtgctagcatttgaacccaaatagtgtgcctccaacagctctagtatataaagcatgtcttgtaagtaaatatcctattttttgctttgactttcatgattgttttatcaatgtttatttagagatttgatgatcctcaggtgtcagttattcctctgccacttgaactcccttcccccttggttctcgctacctgcatttccagtctgcctgtcaaatagttaatgatctgcatacaaacactttcatgaactagtggaactcagcctttaaaagaatcctaggggaattctttaaagactcttttacagtatgaataatcatcccttagtttattcatctgtaaatttttggtttcacatagtacattttcttcaggcagggccaaccacattgctttttaaactcttagatagatcagctttgctttgtcattttgtgatccaagaaagccaattattttaatgtccacatcaactattctccttttagaatttatgaaagtgaaaaatatgtagcccaaaaactctttgttagagaatatttctcatgaaatgggaattttagcccttcttcttacttagagtacttatttgttcagtcgcaagacaatgaaaataaaatttaagtctccaaaatattatttctatccatttaattttatcaggccagaccaacttttctcagcagatcaaattaaatttttatatcgacttttcacttttatgttgagaaaatttgttattctatatccatagacttttgagcaaatatcacctaactctgattgctgtaatctcctctggctggtctaccagctctaagagacctgctttctagcaggttcagttttttgagatcaggacaaaagccagactaaagcacacttttaagtactttgagcaaaaattaaagacgccccataaggacagacattccatagtttccaccaagtcaatcaatgatacaaatgtaacttcatattgaaagcatgtaatggtttttgtctcagttactgaaccccaacattttggtttggagtactctcttcagaagtgttcaaggttcaaattgaggtcttctgttgtcatggaataactttctcaacaatggtaagtagtggagataagagttaatggggaatatcctattcacttttctctgagccctctgaaacagattttctaaacccttccatgtgatcccgaccatgttatgggtttgctaactttgcagtacattggattgaaacatcgtaattctttccatgacaacagtgtctgatgttacagatgtacaaccagtgaggtcaatagttgacagatggacgttgaagccatgcaattacacctcccaaaccattataaagaatgtaacagaagaaaggtggaacccagtctaaaacacaccaaacaataaaaggcactaaaataattgcttcacatttaatgaatctttctttaatatgacaaccaatccaagaatctttgaattccctttccctggtaaaagtcaaaacatttttgaggcggtggcagtttatctaaattactgttttttctccatcagtctttaggcttaatctcatttgcttttatggatatggtaacccttttgaatagcttttaaccttttaaaagtcgccttgacccgaagagcctaaaaatttttaatataatattgaatgataaaaattgaacaattgagtgcttttctgactctcagtctgcatgcagtgctctgggtcgtacagcagaatttctggctgaatgaaaaaaaattaaaatacctgtatatagcttgcttgtagcagaaaccttcagctctgacctccgtttcattggctccattgttccttgtgcccccacagtatcttggctttctcttttccagagaaagagtgtgttttatcctgcagcacgtcagcttcaaagggctcttacttcaagtgtccagcgcatcattctggtaaattaagaaatcctcggcttaagatcgtctctttcaatcacatataatgtgggtaacttcatgactaaa

SEQ ID NO: 212 - DNA, 252 bp, Homo sapiens
ttttagagacagggtcttcctctgtcacccaggctggaatgcaattgcgtgatcatagctcactgcagtctcaacctcccaggctctcaagcaatcctcctgcctcagcctcccaagtagctgggaccacagtccaccacactctgctaattttgttattttttaagagacagggtctcactatgttgcccaggctggccttgaactcctgggcccaagggatcctcctgcctctgcctcccaaagtgctgg

SEQ ID NO: 213 - DNA, 69 bp, Homo sapiens
accaggctggccttgaactcctgatctcaagaaatccacctgcctcggcctcccagagtgctgggatta

SEQ ID NO: 214 - DNA, 86 bp, Homo sapiens
tcttattaggttgctgcaaaagtgattgtggtttttgtcattactttcaatggcaaaaaccacaatcacttttgtaccaaccttaa

SEQ ID NO: 215 - DNA, 3036 bp, Homo sapiens
aaactttcctagcgtgttaaattctgctacctcaccaacgacaacttggaccttgacctccaatgtgtgttcgaccaaattcccttcgtagaggctgggaagagaggtacttgtttgagatccaaatgataaaatgcctggtatgggagggaaaaaaaaaagatttttgtgtgagagaaaagccagtcctaattgtattacgaacacaaggacataaaaaagctgttccatttctaaaatcctagagtggaatgagaagtccttacagtgaatttgcctcatcacaatccggtcatccagtgagtatttgcctagtatctgctgtgcatcagacattgcatttagcactgggatacagtgttggacaaaactgggtccgtgttttcatggaccatatattttgttgggagagacagaacgaacaaaggtagaaagattttagacggtgatatgtggaatgaaaatagttttcataccaaggaactgaaggtggagcttctaaatagcagttgctccatacttgttaaatgaatcaataaaggcttattatgggccaccagaggccccagaccacacgctgacaataaatattttcaacaatgtaaagagtagaaccgtatcaattgtaatcttagagttcccatggggcgcaagagaaactttattttcctgattgagtgggagtctggctcagagcattgtggctagagcttttaatatctttctatttcggagctacccagccacgtttgtgcacctatagcaatgtcataaaagctactccctgctcgcggtaatgaagcacagaagagttgtgttaggaatttatgtcagctggagaagggacgctggagtagccaacttataacaaaataactttaataaattttgttgactgaggaaagaaaggcaaagcattttatggatctggaaaacaaatgagtttagggctcagagctgggagaaagtgattacagaagagaagtcaaagttgagaatagaaagaagacgactgagagggagtcagaggtgtgaggagccaaacaggacaaaaagctgggttcatttgtactatggatcccctctgctgtaaaggaatgaaagtggcaataaaatattcacacgaaacctatttcaaaagccatagttcacaaaaaaccattaatctcactgtgatggttaatttaatttaatttaatttaatcttattttcgagacagagtcttgttctgtcatccaggctggagtgtggtggcatgatcttggctcactgcaccctccacctcccgggttcaagcgattctcctgccttagcctcctgagtagttgggattgcaggcgtgcgccaccatgtgcggctactttttgtagagatgggattttgccatgttggccaggctggtcttgaactcctgacctcaagtgatccacctgtcttggcctcccaaagtgctgggattataggtgtgagccaccacgccccggcctgtgatggttaattttaatacgtcaacttgattgggtcacagggtgtccagtttaaacattacttctagatgtgtctgcaaggatatgtctatttccagatgagactggcatttgaattggtgaactccatgaaatagattgcctttcccaatgtggatgggcaccctccaatcagctgagggcctgaatagaagaaaaagcagaggaaggagggatttggccccttcctgcctgctgcatgaagtgggatcttggtcttattctgcccttggactgagatttacaccacgggtccccctggttctcaggccttcagactcagactgggactacaccactggcttgcctgggtctccagcttgcagacaacagatcgtgggacttctcagcctccataatcacatgggccaattcctcatgccttaaattagaggcatttcccatttgtatgctttgaaaaatcaattcacagcaacagtgttagaattgtgaagtaccttctctttccctaatgtctgtcattctcttcttcctggcctaggtatatcgctttcagctcagaggcttacgttgaaagaggaagtttggagataaatgctctttttctcttcatgtcagtctggtgagatgccccttcaactctgtgaagccccttcaactctggcttgccctggctattgtactggcagagggactgccagggagatcttgtgacttatgttgagtatttattctctctggcaaaccagatggtcataacgaggagcctggcttctggatttgccagttaccttacaatgtagtggtcacatctcattacatctcaactcttacaccatggaattccaggaagttctgaagccccaggagccttcaacatctgaaagcatttggatttaccattctgtttctcatccccttgtttggaggcctcctataccttgctgtgattgtgtgcttgtgtgtgtgtgcgtgcgtaggaatgtgtgtgtgtgcatgcatgctttgctggtatgatggttctcagcacagtctactgccttacatccaagttctcccatttaagctggccctcttagtattttatcactgacattatttggaatttctggtgcatgctgataatacaatcagactgactcttattgtttttaaattctccaaaggccatgcccatgcacccctttattgcctgtacatagggctgacttcgtctaccgccttagggtcaaagtctctgcttggcggcatcctattcacccttcatgacccatcctgggctaggtttgatgctcctcctaccctgctttctctatcctatcacttatctgatatgtttgtttaaccatctgttttccccctctctattttaagggatgtggaagcagagaatgtgtctgttttgctcaccatcacatctgcggagcctagcccaatgcctggcatggagtcaggatgcaatcataatttgccacatggaggaataaatggttggcttgtcccgtgactggccactctctgtcttacttcctcatctgtaaaatcgag

SEQ ID NO: 216 - DNA, 990 bp, Homo sapiens
ccctgaattccaactgaccttctacagaaaagtgcttgactgccaagtggtcttcccagtcactggtgaggctcttatagaattctccatactcctcttgggtgatgtcatcatggtttctggtccaaataggcttggtcttgtttagttcttcctagtcaatgtatttctctttgatcttcttagttttcttcttcttatccttactgctgtcatcctcctcatctgaacccacatctttgatcttgggcttttcttcgtcatctttatcttcctcttctttctcacctttctcttcttctgcctcatcatcactaatttccttgtcttgttccttctccaaataaagggtgatgggatagcctatgaactgagaatgcttcttcactacttctttgacccgcctctcttctaagtactctgtctgatcttctttaagatggaggatcactttggtacccctgccaatgggctcaccatgatcagcatgcacagtgaaggaacctccagcagaagactcccaagcatactgttcatcatcgttgtgctttgtgatcacaaccagtttctctgccaccaggtaggcagaaaaaagccaacaccaaactgcccaatcatggagatgtctgcaccagcctgaagagcctccatgcatgctttagtaccagacttggcaatggttctcaaattatttatgagatcagctttggtcatgccaatgcctgtgtctaccaaagccagggtacgttcctgagggttggggatgatgtcaattttcagctctttaccactgtccaactttgaagggtctgtcaggctctcatagcgaatcttgtccaaggcatcagaagcattagagatcaactcctgaaggaaaatctcctcgttggaatagaaggtattgatgatgagggatatgagttgggcaatttctgcctgaaaggcaaaagtctccacctcctcctctccatggtgcacttcctcaggcat

SEQ ID NO: 217 - DNA, 19161 bp, Homo sapiens
agaacagagacctggaaggaagtggcctcccaacacaggacagcctacctcttaacttctcttacatgcaacaaaaataacctgctgtattgttgaagccactgctttttcttgtcaactgaagaacaacgaagttacaaatttggaaaggagagctttatttctcataaagcgttgcagcctgcaggcagccattctgataagctggcaagcgtcacctccagtcagaagccagaaataggctcttgagagtgggaagaataagacagagatatacgctgagcagggtggccaaatatatatatttgacagttataggaggagctatgaatattcacaaaggggaggcatgggcatgtgtagaggactaacatgaatacaacatgtgtcccatgttcactttggggtggaaacctaatgtttaaatgtattacaattaggccctatacatccaagggtgaaacagagcacacaaaggccctctgcacagcatccatagatggccagaaccactttgtggttggcggtctcttatcaggaaagaatgctgatcatttgttgtgtcaaaaccacaaaagggaggttggttgaatttagcagtggaacaagtccttccaaagggctggtttttgtttaatgcttaagaaagaaagcctaatagtggttaatgagggagggggtataacaaggcatgtccaaccttctgtaccatcatggccagtttttaaggtttttctggggtccccttggccaagtggggaaggatccagtcagttggtatggcatttaggattttatttttatttatcaatctcattttgtttttccattaaatgcagccaaacctaatttgaacgatatacttaacgaagaagaagagagcagaactcagggttttcttgacttatagtcaagaaaaacaatgtggctcagtcgatacttcttatttctaccaaacaagtgttcatttttattatgaacattttataatacctattttactctcctaaaatgaaaatcacagacactattgcctataggtataaataattgtaaataattgaacacacacaaacacattgctttaacaataggaaagaggataaataaaaggaaagtaagtcagcataaaatgacatataatttaacatgtaaatactggagtatgagcatcccaggagacttaaagaagttgtcaggagctagcactttcatatcgtgaataggcttgcatttaagggaagtaagaaagcacatttaagaatgtcaggtaggacacacaaagaatgtggagtgggaaactggactgtctcacatattacaggacatatggcattgctgtccattaagtgccagtagaacctcccaatcactgtcacaacaaaaattgccccacagatttccagactgaagccagtagcccgtcttatttgaagcctctggtctaagtgggctagaaacacctgggctctctccttggcacagagccttgagggtggccccttccttcctgaggccaaggcccggcctgcctgtcttaacagctcttagttttctctctttctgctctaatctccacttaggaatgccagatttagcaataaaattcgagaattcctggttaaatttgaatttcagattaaactatgaataatcgtttaagtaagtcccaaatcttgcatgagacctacactaaaaaaaaaaagaaaaaaaattgatttaactgaaatttgaatttagctggaacaccctgtattttacttgacaaccttactcccagtacacattgttcccctcagaacctcaagaaaacctatcttaagggtatcaattcagccgggagactttaagacctacgggcataatgtagaatttcccaaaatgggttccacggagtacttccatgaagtgctcagtaggaaaaaagagacagcctaccttaactcctcttagagattcgtaatactgtacatatctcctaggaaagcttaagcaggtcctgcccttacatttaatacttaacctggtatttcccaaaccatttcatctagcacctgctaactgtcccagacaccagtggtccagggaacacaccgtaggaggcaggtttgaggaaactatttctggagccccaaactaatcccacatggccacactcctgctgtggttactatgactctctaggcctcagtttctcatcagcagaagggtggagtcgaatgcaattagcttgaaggtccctggagtttatgaaatctggagattccactttcatacactgcctttcctcagagctctgtcccattattaccaagagccacctcaagccaaactcaaaagttggggcaaaccaaaggttcaaagctcacacagtgcatgaactgtctccaggagcctgaattctccatcctatttttagctctgacccatctcaggcccagcagatgccatagtgatgatcactgtaatttcatgggaaagatacaggaaacccaacaataacagcaataattcagcagcctagcagatgccagatctcatttgtgcttcacccttagcatgactgatgatacacactatcagagcaaaagaatgttcatctgtggcaaaagacctttagcacatttcctgtaacctccaatttgcaacaagttgagttccagttggtgggtaagttagcttgtgtcttctcataacacatttcccacagaaatgttcgacatagtctagacttcccggaaggccccttcctcaaggcccatttaatccattataaaactgtagttcaaggactactcctcaaagactcaacatgggaaggcatccattttgtccccttctctcccattttttctcccttgctttacagcccctcttatcctccaggcctcctacccatcagttgctttactagtgcaccaaagaaagaattttctaccaccaaatataataatttttgcagtaagagggagaagaccacacaaatgatcattcttcagcatttaagggaccccccacctctacccccagaatggtgttggtcagtaattcatacctaaggaacgtgcaagtgtgaagttctggagtcaaaacctacattgcctgaatgcaaacagcaaatctctgctttaaacgcataacatgggagagtcaatgtgttttcatctatgatggcaatggaggtaccagattgaacataaatggggccctctgtgaagatgcacgtgactgggtgtgtctctgttgaggggcaggacctcccagacaactggtggatcagaggccctggggcagcatagtgcttgtccagaacagtggttctcaaaatatggtccctagagcagtagtaccagcatcatctggggattatttcgaaatgtaaaatcttaaaccccaccccagagttactaaatcaaaaagcctggataacacccagaaatcagtgttttaatgaaaccttcaggtgactctaatgcatgctgaagtttgagaaccactggtgtagaatgtggatcctcctaccttaattttttatctgcactgcatagaaagaaggagctacaggcagaaggtggaggatatgttctcacagggttttgcatgacctagcagcatgatcatggctacccaggaggcaaatgtgacggaataggggaaacagtgttgcttcagcctggtgagaactccagaaagtacagctgttccttggtaccctgcaggttgctgatgtggccactagaaaaaggtgacccctccattccttggcatggacatttagactctcaagaataccactgaagccatgcagaggtgaggtgagtgcacagccaccctcagatggcatcttgatccccagctatgaaacccttatcaggagagcataaaagaactgttcctgaggtcacacgagatcccactagagagtatccaacactgggtgagactttgatggagctggagcttctgggccatgcattggtggtaaggggtggggggtgtgcaggggtgggggctctgatattttggctattcccattaatataatcctgttagactggggaagcttgagttacaggtgaaatagaaattcatccttactgtagggtttagcacaccgaaaacttcacctctctctgctgactctggcatatacaccaaagagagaaaaattggatttaaaagcaaagagagatagaccatccttactcctcagctttctctttcactctctctctctctcacacacacacatacacacagtatgtatgcacactcatacgcacaggtctgcatggcacactgcagtaagtaattcccaagtgcttcctggctgacaatgaaagcctacttgcccgaacagcaatcaaatccacagcctgccctgataattaccccgtcaactttagccccagtaaaataaatgagccattcaaagatttctggaaacttcagtcccagcaacgcctcctcagatacagtggtttggcagtttggggtctccttgtgctctcacagaaaggatatcaaatttctgaccactctccttgtggttgaactatttctcctcctttgaagatcataatttctgaaacattggcgtctcccttttctttcctacttgtttatcctcttgtaacttgaaggctctgaaggccaagtcatagaaattgttaattgcactcttggattttgttaaacaaaagaactggtgatgactctcactggggctgccagaaaatactgcttatttggctgggcatggctggagcccacactaaatgtcagctcctctatggagctatctccttctcacgatgtcagcttaactctcattacttttaagctactgagtatctgggcatttcattcttcagaaagtttttccagaaaattaacttgtgggggaaatcatgtgctgtattaattcaccccagacactatccgtttcaaagtgaaatctccaggctttagtcaatactggctctttgtaagtgtttcacatctcccagggcatcaagagatcagacgcagtgagacaaggatgtaaaattcttgtcagtgtttcagtgcccactatttcttgtctcctgtggctttgtgccactggatcatgtaatacaagccttgtcttgcctgctatctttcctcactgaatttcctataccaggtatcaggaaagtcagagaacacaaatattttctaatgccagcatctgcttagagccctgttcacaagacctgtcagagaacccaaagcaaaaaaaatctccttcctgtcatctgcctttcagtcatttggtgaggagtccttaatgctggaaaagtaactcaatgaaatggagccagagggagagagcaagtgagccacgttcactgtagagttcacaaacttcaggtatgaacctgaagaccccagagttgtcgtaagcagcaaagaccccctgcagatgcaacctacaccatctcccaaccatgtgactggtaggacatgtgtgtgttccaggtccctttatgtcaggtcagactgctttagtcctgccatggaaataaatccctaaactaggatcaggtgtctcctgtcaaaaccaaaatacaaagttagtaacaatggctcctttggtgttctggaaaggaaaggctgttggcacagctcacccatctccttttgtgagggacattgctccatcttccctgtttccccttctttcctccccttgtactgcatgataaacaaaccaagtggtatcttccatttcaccttgaatgagctctcttatccccatgtattgatatcactgacatttgattctgaggtactgcaataggtgataaacagccataccttttatagaggatctaaaaagaaaggacagtaagaataagtaggctcattgttgataaggtctgcaggtgcctcctggcaaggtggcctgttcaccaggatactttgcttcccttacaaatggacttgccaatctggcatggcacagtgacagaggtgggggaggtggggtaggtggggttttcatgtttgagagactttaatttaaaattggctaacatggtgttcctcaattgaaaagttttctggcctggtatcaatagcagtaaagttaagtaatgagctgggttctctttctatgtttatctttataatcaatcttaattatattttgtttattcatgatctcatgtaaccaaggggtaagatatacaaatcctttgctttcagcccaataatggaaatagttctcaaataatgaatatttataattacgactttcctggccccattttgtagaaactagtctagatcatttcctgtagcagaaagcttaacctcataagtaaagaagtgagccctgagccccaaatatgccatgatttctaccattaaactgtttggctggaaggccttgtagagtcataggaaggacctggacttcagagttagatctgctggatttgaatcccagctctacgactcactgactttgtgagtttgggcatgctgtttgacctctgtaaaagccagtttccctatccataaaatgggggcagtgatacctatcttgtgagaatttaattatctagtttatgttaaattccagacattctctcatcaactattgcacttcttgtacctcaattctattctatacttttctgtgttctatattttaatttgttttgtcaatgaacattgaacaggtaggacactatatgcttagaaacattttccatataaccccttaagttaaaagagaagaggcttgaagatacctaacccttcctaattttaataggttcctaaacataataattctgttcccttccatttgctgtcagttgactcttgaatctatatgcccaaaccagacctctcctctaaatgccagactcagtatatccaatgatctctttaacatctcaattggatgtataattggcacctcacacttaaatattcaaaaagaaacttctgctcttcctttttagaccacagtcctccccatctcaactaatagcaacttcatccctctgctgctcaggcctaaaacattagatttcttctgaatgcctctctttctctcataccctacatgtaatccaccaacaagtcctgttggctcaactttcagcagaatctaaagccatctcacaccttcactgccatcctaatttaagccaccattattctgtcactcaataattctgtcactgaataattctgtcctaacagatctttctgcttccatactctgttcccaatctcttcccaacaccacactcaaagaaatccctttaaagcttaatcatatcatggccttctaaatggctttccatcttactcaagtgaaagccaaagtcattacatacagctttcaatgtcctatttgatctgcaccctctgacataccccccagtatggctcattctgctctagctgatgctgggtttctagccactttctccaaactcaccaagtatattcctaactcaggctcttgtacatactgttccatctacctgaaacatcttcctcagatatgtgcatgcctcagtttctcactttatttcagatctttactcaaatactccatttccaatcagaacttccctgtccactctatttataattataccctattcaccatctctggagtccatttcatatctcttgcttgcttcctttatttttttcccatagccctcatcactatgtgaagattatgtgtttgacttgtttgctttgttattagtctcctctcattagaatgttagctctacgaggacaagggtatttttttttctatgcccccatcacatattaggtgttcagtaaacatttttaacaaattgaactggtgaatgaaatcctcagggtttcttcctggttcactccatacatattttacttgttcctttatacttcccccccagactttttcttctagccaaattagaataacagagaactaatttatacttacatcttataattatggtcaccaaagatatcaagttataatccctgaacttgtaaatgagaatttatttgggaaagaggtatttgtagatgtaattaagttgaggattttgagatgaagagattaccctggattatctgggtagacccttaatggaattataagtgtccttccaggatagaggcaaagggagataacacaaacactcagaggaaaagatgatgtgaaaacagaggcagagattaaagtgcagtgacctcaagtccaagagtgccgaaaaagccaccagaagctggaagaggtaagtactggattatctgccatttcctttggaggaaatgtggctctgctaacatcttgattttagatttttggcctcaatggctgtgagaaaatatatttctgttgttttaagccattcagtttgtggtaatttgttatagtggcactaggaaacagactcttttaaaataacttaacaaggtcctagaacaagttcaaaaacatataaagaaatatgaaatatccagcactcataaaaaggtaaaatctacactgtttgtcatccaatcaaaaattacaaggcatgcaaaaaatcagaattaaaactcataatgaggagaaaaatcagtgacttgaaactgacccagaaattatatagatgatagaattagcacatgaggaaattaaaatagttaatactatattttatgtgttcacagagtaagggaaagcatgagcacaagtaggagagatatgaaagatatctaactttggaaatgatgaatacaatacttaatatgaaacatataacatataaaaacagactagacactgtagagtaaaagatcaataaacttgaagacaataatagaaactatctaaaacaaaacaaggtaagaaaaaagaccaaacaaaatgaacaataacaacaacctcaagaaccttaatatacatgcaactggagttggctcagaagggtacaagtttggggggtgagggtggacagaaaaaatagttgagaaaagaaacaaatttgacaaaaagcataaactgatagatccaagacactcaacaaactgaaaacacaaagaacataaagaaaactacactaaggcacattagaatcaaattgattgatacaattgggaaagagaaaaccttagaagcagccaaagaaaaaaagacacattatgtacagatagccaaagagagggatgatggtagatttctctttagaaacaatggaagctcaaaggcattgaaacattttctttaaagtattgaaaggaaaaaaaaatcctttcaagtagaatactatatccagtgactagatcttcccaaaacagagggaaaataaagactttttaaatttataaatcctaaaagaaatcattagcagcagatctgctctacaataaatattagaggattgcaggcaaaaggaaaataatgccatatggaaatgtggatctatgtaacagaataaagagtactagataataaactcatgggtaaaatataaaatactttttccttatttaaaaaatctcttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacctgggaggcggagcttgcagtgagccgagatcccgccactgcactccagcctgggcgacagagcgagactccgtctcaaaaaaaaaaaaaaaaaaaaaaaaaaaaaatatcttggccaggtgcagtggctcccgcctgtaattccagcactttgggaagtcaaggcgggcagatcacaaggtcaagagatggagaccatcctggccaatatggtgaaaccctgtctctaccaaaaatacaagaattagcttggtgtggtggcatgtgcctgtaatcccagctactcaggaggctgaggcaggagaatcacttgaaccagggagtcggaggctgcagtgagccaagactgtgccacagcactccagcttggcaatagagagagactctgtctcaaaaaataaaaaaataaaaaataaaaacacacctctttgaaaagttggttgactgtttaacagcattcaagaaaaccagtgcactaaacacaactacaaccaaggaccctcacagagtccactttactgtggactgtaaagctgtctcttccagagcaagtgctggtgtccatgactgcaagacctgaagatggattacatcccaggactctttgcagacactccccagtatcctcctggagcctggtagctctgatgggtggctaaacccagaagagcaataacaatcactgtagtctgactctcaggaagctccatccctagagaaagggaagagcaccacaccaacagagcatgctgtgggacaaaagaatctgaacagcagccattaagccccaatctttcctctgacatagtctacccaaatgagaaggaaccagaaaaacaattctggtaatatgacaaaacaaggttatttaactcccccaaaagatcacagtagctcacaagcaatggatccaaaccaagaagaaatctctaaaatgccagaaaaagaattcagaggtcaattattaagctactcaaagaggcaacagagaaaggtagaaactaacttaaagaaattttgtaaaaagtacaggatatggacaaaaaattatccagaaaaatagcataaataaaaaacaaccacaacttctggagatgaaagacacacttagagaaatgtaaaatacactagaaagtttcaacaatagaagcaaacaagtagaaggaagaacttcagaactcaaagacaaggctttcaaattaacccgacaaagacaaagaaaaaatatttttttaaaaaaaatgaacaaagcctccaagaagtatgggattatgttaaacaaccaaacctaagaataacttgtgttcccaaagaagaagagaaatctaaaagtttagaaaacatatttaagggaataattgaggaaaacttccctggctttgctaaagggctagacatccaaatacaagaagctcaaagaacacctgggaaatgcattgcaaaaagtttataacctaggtacatagtcttcaggttatccaaagtcaagaggaaggaaagaatcttaagagttgtgaggtaaaagcatcaggtaacctataagggaaaacctatcagattaacagtagatttctcagcagaaaccccacaagccagaagggattggagttttatttttagcttccttaaacaagacaattatcagtcaagaattttgtaaccagcaaaactaagctttataaatgaaagagggaaagtcttttctggacaaaaaaaagtgctgagagaattcaccactaccaagccagcactacagaaactgctaaaaggagttgtaaaacttgaaacgaaacctcgagatacaccaaaatagaaccccctgaaaacataaatctaacagggcctataaaacaataacacaatgaaaaaaaaaaccacaagatattcaggcaacaactagcatgatgactagaatagtatctcacatctcaatactaatgttgaatgtaaatggcctcaatgctgggtcaacaatgaaagcaagatggaaattaaaaaattatttgaactaaatgataatagtgacacaacctatcaaaacttctgggatacagcaaaagcagtgctaagaggaaagtccatagcttaaaatgcctacatcaaaaaagctgaagagcacaaatagacaatctaaggtcacacctcaaggaactagagaaacaagaacaaacaaaacccaaacctagcagaagaaaagaaattacagtgatcagagcagaactaaatgaaatggaaacaacaacaaaaaaaacatacaaaagataaatgaaacaaaaagctggtttttttaaagataaacactgatccaccattagcgagattaaccaagaaaagaagagagatataaataagttcaattagaaatgaaacagaaagtattacaaccgataccacagaaatacaaaagatcattcaaggctactgtgaacacctttacacacacaaactagaaaacctagaggagatagataaattcctggaaatatacaaccctcctagattaaaccaggaagaaatagaaactctgaacagaccaataacaatcagtgagattgaaatggtaattcaaaaattgccaacaaaaaagagtccaggaacagatggattcccacatgaagtctatcagacattcaaaaaaacctggtaccaattatattgacactattccaaaagatagggaaggaggaaatcctccttaaatcattctatgaagccctaataccaaaacaaggaaaggacataacaaaaaaagtaaactacagactgatatctctgatgaacatagatgcaaaaatcctcaacacaatactagctaactgaatccaatagcatatcaaagagataatccaccatgatcaagtgggtttcataccagggaagcagggataggttaacatatgcaagtcaatacatgtgatacattacataaacagaattaaaaataagtacaatgtgatcatctcaatagatgcagaaaaaacattttataaagtccagcatccctttatgattaaaaccctcagcaaaaacaaattcgaagggacataccttaaggtaataaaagctatctataacaaacccacaaccagcattatatgtaacagggacaagttgaaagcattccccttgagagctggaaaaagacaaggatacccactttcaccacttctattcaacattgtactggaagtcctagccagagcaattagacaagagaaagaagtaaagggcacccaaatcagtaaagagaaagtcaaactgtctctgtttactgatgatatgatcatatacctagaaaaccctaaagactcctctaaaaagatcctagaacagttaaatcaattcagtcaaatttcaagatacaaaattaatgtacacaaatcagtagccctgctatacaccaaccatgaccaagctgagaatcaaatcaggaactcaacatctcttacaatagctacaaaaaccttaaaatatttaggaatatacctaaccaaggaggtgaaagacatctacaaggaaaactacaaaatattgctgaaagaaatcatagatgacacaaacaaatggaaacataccctatgctcatagatggatagaatcaatattgtgaaaataccatactgccaaaagcaatatacaaattcaatgcaattccatcaaaataccaccataattcttcacagaactaaaaaaaaaatcccaaaattgtatggaacaaaaaggagcccacatatccaaagcaagactaagcaaaaagaacaaatctaaaggcatcacattacccaacttcaaactatattgtaaggccatagtcaccaaaacagtacaggactggtataaaaataggcacacaaaccagtggaacagaatacagaacctacaaataaagccaaatacttacagtcaactgatcttctgacaaaacaaataagatgtaaagtgggaaaaggacacctattcaacaaatggtgctggaacaatcggcaagccatatgtagaagaatgaaactggatcctcatctctcaccttatacaaaaatcaactcaagatggatcaaagacttaaatctaagacctgaaatcataaaagttctagaagataacattggaaaaatccttctagatattggcttaggcaaagacttcatgaccaagaacccaaaagcaaatgcaagaaaaacaaagataaatagatgggacttaattaaactaaaaagcttctgcaccacaaaagaaataatcggcagagttaacagacaccccatagagggggagaaaatcttcacaatctgtatatctgacaaaggatgaatatctagaatctacaaggatctcaaactaatcagcaagagaaaagcaaacaatcccatcaaaaagtggtctaagggcatgaatagataattctcaaaagaagatatacaaatggacaacaaacaaatgaaaaaatattcaacatcactaatgatcagagaaatgcaaatcaaaaccacaacgtgataccaccttactcctacaagaatggccataataaaaaaattcaaaaaataatagatgttgggatggaacagggaacactactacactgctggtgggaacgtaaactagtacaaccactatggaaaagagtatggacattccttaaagaactaaaagtagatgtacaatttgattcagcaatcccacttctgcgtatcgatacaaaggaaaagaagtcatacaaaaaaagacacttgcacatgcatgtttatagcagcacaatgtgctactgcaaaaatatggaaccagcccaaatgcccatcaatcaatgagtggataaagcaaatgtggtatatatacatagtgtatatatacacatacacaccatggaatactacgcagccataaaagggaacaaaataaaggcctttgcagcgacctgaatggagctggagaccattattccaagcgaagtaactcaggaatggaaaaccaaacatcatatgttctcaatgatatatgggagctaagctatgaggatgcaaaggcataagaataatactatggactttggggactcagagggaatggtgggagggaggtgaggagtaaaatactacatactagatacagtgtacactgctccagggatgggtgcaccgaaacctcaaaaatcgccagtaaagaacttatccatgtaaacaaacaccacctgttcccccaaaactcattgaaattaattaaaaataaataaatatgctggatgcagtggctcatgcctgtaatcccagcactttgggaggccaaggcaggtggatcacttgaggccaggagttggagatcagcctggcccacattgcgaaaccacgtctctataaaaaatttaaaaaaggccgggcacggtggcttcacgcctgtaatcccagcactttgggaggctgaggcaggtggatcacgaggtcaggagatcaagaccatcctggctaacacagtgaaaccccgtctctactaaaaatgcaaacaattagccaggcgtggtggcaggcgcctgtagtcccaggtaatcgggaggctgaggcaagagaatggtgtgaacccgggaggcggagcttgcggtgagccaagatcgcgccactgcactccagcctgggcaacagagcaagactgtctcaaaaaaaaaaaaaaaaaaaaaaaaaaaattaaccaggagtggaggtgctcgcctgtaatcccagctacttgggaggccaaggcaggagaacagcatgaacccaggaggcagaggttgcagtgagccaagatcgtgccactgcactccagcctgagcaacagagcaagactccatctcaaaaataaataaataagtaaataaataaatatcggttgactgtttaaatgaaagataacaatgtattgagaggtatataacatgtaagcattaaattatgacaatagcacaaaggcagagaaagagaaattatacatgaaggaatatgttacttgaagctaggttatgataaattaaagttatatggtttaaaacctaaagcaaacactaaaacaaaaccaacaacaaaaacctatatgacaataaaaaccacagagctaagaagccaccaaaggagataaaatggaataatttaaaaaatgcaatcaatctaaaagaaggcagataagagaaagggaagcaaagaacaaatgagaaaaatagaaaacaaatataacaaaatggtagatagaagttctactatgtcaacaatctcaataaatttaaattgcctgcacaccttcattaaggcctgaggacatgtaagtcacgtgcatttgcagcatttgtgtctttagagcagtttccagatttaccgccttgacttctttcattcaggtttggtaataggctatttcaggttatgtagagctgagacacacttgaatatattgtaaagatatgaagagaagtaagcgaggcaggaaatggtcataactcccacattggctgctttaaggaaaacctcaatatcttttagaacaaagtggaaattgcaaaattgaaagtcacagagaacacaattgccattcaggagacaatgcagatctgaacttctggggatcttctaatgctcttctattctctgcctcagcaattactgctatgctaattttctatctcaggttcagactcaggagagaggtcccaacttgtataatacaagtcactgtcttacgtgaagtactatataagttaggcttagcaggagccacacaacccatgtcacatggtacaatatagtatattgaatatggacaattaattatggacctgtgggaagacccgaaaaggcaaacagcaagggacaataaggcaatccagagagccaatatcttgcctagggctgaagagactcaaaggaaaaagagttgttactagagcccagaagcccaggctgcctagaaagctcagaatatgtagtttgcaaaggtcagtcccatgttactgagaacagagaaagagaaaagacactagatctgagagtaaacgcaaataggcaaatgactagcctagttgctttactgggcagagtcttaacactaaccaattaaatgtggatcacatgcctatcactggtctcttggtctggaagactttgaaaatcatgactttgacatggaaatttccatattcaaactaatctcagatatgaaaatcggtctacatttggtttaaaatcctaccttctctctttatgtaaggaattctattgggatttctggaaagttttttttgtttgtttgtttttgttttttgtttttttgtttttaacaattctcagcaatgctcactgctaaaattgtattttccatcctatcctgccatgaggcacattatcaattgctcaattatagctcaatagctttctcttgattctatacctaaggcaatacttgtgggttttgttttcgtgcctcagtatttcaaagactgggagactgatagaattctgactgtgacattctgcaggatgctactatggatcatgtaatatctgacacactcagctccttttgtagagtgattttatggtgtgaaggtgatgactctgagtgctttgccatgtagctaggcatttgtgtgcaagggctggattgcttcccaatgttggtctgacaaatcattttacataatcacgctgaaagagcaccttttttgttttgtttttgtttggacagttcttggttaaaaagaaaccagttcttaatttagccttttcatagattgcgaatctcatttaacttagatttgtgtttaattttggcaatttttaaaaagggaagaccagggatttcttcctgtagaatatgttcttggttaatgtgttcataaagactttcattgatttgttcctttaactgaaggaaagaagtttaaaatctctagtgtgaaatactgctggcttaggggtcactaaagtcttctcatctgtgctttactcttctccaccagaatataaatttcctaagggcagggatattgtgttatgcactgccatatcgccactagctagaataatttttgacacagagtgagttatcttatttgttgactgaattaagtgattagcatcatttaacttaaagaaataaaccctgtatagtgactgggacatgagcatcaaaaaatacaatgtgtaatacggtagcttctttaagaagatggcacagtgtattagtccactaaggctgtcctaacaaaataccataggctgagtagctgaaacaacaaaaattaattttcttatagttcgggaggcaggaagtccaaaatcaaggtgctggaaaatcatagtgcttggtgtctggagaggcctttctttttggctggcagatgcaaccttctccctctgtcctcacatggcctttcttctgtggggtcaaagcggtgggatgcggaagctctggttagagctcctcttcttcttataaggacactaatcctgtcagattaggatcccactcttatgacctcatttaaccttaattatctctgtacaagccctatctccaaacacagtcacatttggggttagggcttcaacgtatacattttaagagggcacgagtataacatacagatttgtttgttttcttcctaggaaatgtgtaaaccagtgtgagtcaaatctatatatagcactttggaaaaatggaacatttaactgctaaaattattttctctaattgaatgttctctttatttaagcattgtagagactgaggttcaaaggttattttctcaaagttacagcagcctctgaggtggtggagggtggcagcaggacagtgagctgacggccaacccctgtgcccaagtgtgctgctccgctcaactccatgtgcaccagggaacagccattctctgcaggctgatttgatctggaaccacaattgagtctagttctggaatctcagacacatggagaactacaccttgtctccagttgctacaagtcaagtccacctgcatgcagacagctacaattgtcttgtaaaattagaaaacagaacagggacaacagtattatctatattgactatagattaattattcatttgcattctttgtcttttgtacttataaatatgaaatttgtatataaacgtgtgttttacaacataagatacagatctatatatatgtacctttgaaagattattctctctgctctttggcctaaatttccaaatggaatcatcctgtgtacagtaacctgtgtctgaaaatttctgtccacttagagtaatgaaggcatggggtcataatgagagcaacaaaaaagttacactttatactgtgaaagaccgtcaccttattgttcatttacttaagtttttcattttgtttttatattttgaaatgttgaataaaaaactcaaggca

SEQ ID NO: 218 - DNA, 693 bp, Homo sapiens
ggaaaaatctttatgacattggatttggcaatgacttcttggaaaggacaccaacaacatagatgaaaaatggaaaaaaataatacatttagcctcatttttccattaaaatcttttgtgtatcaaaggacacaatcaacaaagtaaaaaggcaatccacagaatggaaggaaatatttgcaaattaatttctgatatgggaataatatccagattacataaagaacacctacaattcaacaatagcaacaacattaaaaatgagcaaaggacttaaatatacttttccccaaataagatatatgagtggttaataagcacatgaaaaaaggctcaacatcactatcactaaaaattggggaaatgaaaatcaaaaccacaatgagataccactttacattcattgtgatggctatgatatttaaaaacaaaaagaaaaaaaagaaaacaacatgtgttggtgaggatgtggagaaataggaacccttgggcattgctggtgggaatgttaaatgggatagccactatggaaaacagcatgatgattgctaagaaaacattaagcatagaatttgatccaggaattccacttctgggtatatacccaaaagaactgaaagcagttgaacagatatttgcacaacaaggttcatggaagcattattcacaatagccagagatggaaacaaccca

SEQ ID NO: 219 - DNA, 54873 bp, Homo sapiens
cagcccacttgcatccgagtgaataaacagccttgctgcttacacaaagcctgtttaggtggtcttctatatggacacgcatgacaatatttacaacaaataccaaggaagagctaagagcacatagcatttcccaggcttattagactgtgggatcaacctctttaagaaagcattttgcagaattgttgttcacaggtcattctgcagtgtgaagttttttttgcaataagatccttactctagagttaacttcactaggaagtacactctgggtgtttacctttagagcttcagtttctacaagaatttggcaccggttgggtcttgtagaaatatttactgcatggagttgaaagaagagtctggactgggagaaggatgtatggataaagaacaaggtaggaaacttgtacttgcctgcttcttcttactgctttattcttggataatttcttttcagctttggttattcagcaattcatatttggaagataggatcataggaatgaatctagacatgctaaattataggctgcaataatcttctcaatcactgtcttgtttaatctggaacttcaactgacttgtcttaagtcatgaaacaaaatctttcttagttaagatttccttctccaacatgagtgaactgaaattaatcaatggcatagataatgagaggcaagtagtgtggcaaggaaagacaacttaatttacagaaaaagtgtggttttatagttagaaaagtttcatttgaatgctagatttcctgcttactagttgtgtgacaaaatgaattagatgtttgtgcccatcatggttccaaaacagtttatgatgttttaggaaaataaaaactcatatatattgcttgtgagaagaatatgcccaatttgtggcagtgaataagaagcagagacacaaagtgcttttgggggaacagtgattctctgtggctggagcacagattttgaagggagagtgtagaaagaggtaagaatgtaaaaatgcacagatgattgagtctggagatattttaacaagattgtggagggaatccaagccaggttcaggcatgtgtacctactgctgtagacaaggcatagctattaagggagtctgaacaggagaacaatatgcgaatgattttctttagaaaacacaatctgataatgcttgtatgtttgtgtcaatttgattggattatcaggatatgcttcccagcttcaaataggaattgtagcctcaagttcaggagcttttcttccttttgaatttgtcatgttttgcaatacataatagaagctaactataatccacatttgtttagagcaggcactttggcaccaggacaccagctctgtccctgacaagttctgtggtctaagttacttcagctcagcagttttctcatctgtgaaatgggaatgttaatggaactctccttataagggaagactaaattaactaacagatgctaccgtagtgcctagcacatagtaaatgtgcaaaagttgttggctcctatttgtactactatttttgcaatcctggaatttttccagtcaatcactcacatttttacaagctttcctctcatggagatttatcttccagataatcctttggatttgaaattcatctctaccacctcgctctcacagtcagtgttttgaaaaaaaaaaaaacattcccagaaatttcataattcctaagctttaaaaaatgtttacatgtaacttaaatatttttgtagtttttaaatctcctttttctcaatacacctttctttgcctaggcgcatgcattttacaaaattccctccacttctctctcaggacttcaggaatcttctgatttaggaaattaactcatcagtaattctcctgaccatggtgaggaaacacaaatattacgcagccagtctttattttctgaccctaaaccaaagagctgtgatttgacaattttccttggtctgaggcacagtatttgccacagtcctcttcttattgttcacgttgccgtttatgatgactatcatcagaaaaccacgtcaggtcactttgtggagacattgcttctgctgttcccctcctgttccacctccacctttctcaccaaattccctgggttgtaaagccccagattgggtggtccagaattacagtcaaaggtaagagaaggaggctgtgggtcactggtctgcagagctgtaagactttctgtacacctggaagtgcccagacaagctgtagtgggaattcttttgaaaagaaatgcactcaaagttaatgagataaggtattttcctgccttcatgaacacacttcccacttttcctgaaaagtccttaggaatatgttattcttgtgtttgagagttgtactttgtataacaaacctttccttcttatactcatctacaagggccaattctcatcatttcctgtttggactgttgagacccatcctcactcacaatctggcctccacatctcttctcttcctctccaattctttatttgtcattctgaaatttcaaatacagtgtgatcatattgctttcctattcaaaatcatttacagtttttccactaaaaaatggtaaaatccaagctgcctgtgtgacactggagattctgcatgctttggctttttcctaccttgcagattcatagctgcctcacctcccttacacttggtctggaaacactggggagcttttatttttccttaaaccccgcccccatctgaagcctcgcctaattgttaagccttcaaatgtgttgcaatctctgcttttcccttcgctttcatattgtctgggtacgcttgggatatagctgtggttcctaggctagctactggccctccctatggctccagagctcctgtgctcacacctgtgcgagcactggttattgtacgatttaattgcctgttcatgcaccagtctcctctcttgggctccaacggcagaggttgcacaagtagagtggatgttcaccctgcatcacatggcattgaggacctcccagtcttctcttgcttcctgccaggcctacaaatgtgtcacagattctcagtcacagcagcctgctctgtgtcgctgtacctctgtacctctccctgacatgtgaacatcaatgcacaggtcaagatgtgtcaccagggtaggtttcctaagggttttcatatagattccagtaaaaagggcttccttttctattcagcacatctttcttgcctatgtgatgtctacaattgtatctctagcatattattgctatcaattgtttgtgagtatatgtcctacttctagacttaaattgtcttaaaagacagaaatattcttgattttgctttgtatcttctgagcctggcaaagtgctaattaaagtagatgctcattatgaatgctgtgttaaatgaagaaatgcacaatgtaatattatctgttctgcctggggagtaattttgttttttattccattgatttggccatattcttgatcaatggttctcaaactaactgaacattagaaacagttggagactattttgtaaacatcctcaaccggtgttattcaaatgttaatgtgtgtaggaatcaccaaagattcttggactctgattcaataggtttagaatagggcctgagatcttatgtttctaacaagctcccaggagatttggatgctgctgagccagaatcacagtaagtagagggtcctggttctttgcatcagaatctctggggatctgatctgggaatactcctaagtattcctgagaatttcccaagtgtctgtgataaagcaagattgtcatctacattaggagttgctgtgagtgtcctatcacctatctcttacatactttacaatattattgagcaacttgccagaaatcatgctagaggctttggctatatggatgaagataagactgttcttaaccttatagaactcacagtctaatgagagaaacagaatatataaaatgaatccctatacattgaggtaaatgtaagaaaaaataatcaaggcactgatattggcaataaagatgaaagaaaacatctatatttaaactaagatttgaatgctacatttccactcctcatgggattagaggggcagtgatgttttaaacaaagttagagacatataaaatccctgagttgggaaaaaatgtggtgaattttaggatctctccaaagactcttgtgtctggtacagaaagtaaaagtgggagagtgtcatgtagtaaggagggcagggtccaagcacacacatgctggtggcctaacctagcagagcatgtgggcacaacaagagaaactttctctaatcaacatctagcatgctgtggagcttgacccggtctgtcttggttcctttgagacaagacccatctcaagctagatgcccatcaatggcagttgggataaagagaatgtggtacatatacaccatggaatattatgcagccgtaaaaagaatgaaatcatgtcccttgcaatgatacggaaggattggaggccataaccctaagcaaattaacatgagaacagaaaagcaaagaccaaatgttctcacttataagtggaaactaaactttgagcacatatggacatcaacattggaacaatggacactgtgaactactagaggggagagggaagaagagggtcatgacttgaaaaactacctattgggtactgtacttactacttgggtgcaacatatccatgtaacaaacctgcacatatacccccatgtctaaaacaaaagtggaaattttaaaaatttaccccacatctaaaataaaagtagaaatttaaaagaatagcagtgataatccttcaacttatctacaagcatttatatttctgaatttctggaaatattatttatgcataacaaggacaagatggacaataaaagctttcactttcacttttcaatgacttaatttttgtttttcatttctctaaaccagcaatcaaaaaatattcccatcaatttatatctggggctagtgtgttgaagaataaataccatctaactattcctacccttcctttctactacaaaagggaagcatggaatgtcctatctttgatcaggcaaatagaggtcatttcaaacgtacctgagcctccatcatatggcaagatctaggtctcttgagataacattaaaacaatgaagtgaaccaggatacatgcatcttcttttttttttttgtgatggagtttcgctgttgtcgcccaggctggagtgcaatggcacgatctcggctcaccacaacctctgcctcccaggttcaagtgattctcttgcctcaacctcccaagtagctgggactaaaggcatgcgccaccacacccagctaattttttgtatttttagtagagatggggtttcatcatcttggccaggctgatcttgaactcctgacctcatgatccacccacctcggcctcccaaagtgctgggattacatgagtgagccactgcacccggccttttgatacatgcatcttctaccagcgtatctcttgccctattttataagttgtggggagggcaatgcctagcccaaagaagtttttaatttggttttaaaaatgaaagaattcatgaaaacttatatatatataaatatatatgtatatatatgtgtgtatatatacatatatgtgtatatatataatttacatgtatatgtgcatataggtgcatgtgtatatatcatacacacatgtataaattatgtaaaaaatgacaaataatttttttatgaaaatagactttttagtgaaaagcttagaaattcagtattctaagaatgcattggttctatgtttatccctagtattctttttctctttgtttctttcctctagacccagaatccgtagccagcatgatgagttcagagacctggcccctaccctgggagtagcacattcagtcagagaggtttaggtggattcatccaaatactttaatcccagagctctgtcctacaaaaaccaacaggcttgctcaactgtagcagtcaacaagaattcatggtgcttggttggactgcatacatattatctttttcctttagaaagctgtgaattccttggctgttttatttttgaaataaatgtgtcaattccatttttctgccatttctgctacttcttttctctatagaaacctggatttgttactgagctttaggtataaaacaggtttattaagcttaattgttttactattaccatagtaaccattgtatttccgtcacagtaactctgaactgtaagccagtaagccattggtcctgatggtaaagatagaaacccacctccctgcacctcagattctacacctcagagaatttccaggctctaattccttcaattatgccccttctttctagcattttaagtgcccctctctgattttttttcaaactcacaccatggtggtcttgattcaacaatgaagtcacagtaggcattgcagtggttattttatgaatccacacaatttacagattgctcctgataaagctctaaagagttttcacaatgtgtttattctgaaaactactctctacatagcccagtatttttccaatacaaataaattttaaccaacattacaacaacaaaaaattttgatgtgcattgaaatagctagtcaaattggcctcacagtagcaataaaataatctgagataatagttttgtttgattttttatttcatgcataatttatttacgagtaagcaacatatattttacattgttcctcatgtcattgtatgttttaatactgtgaagtttactctgaactctttggatcccaatcttaaatctaatcaaatcaaaataaatatatagaacagctcaatatatgacacatagtaggcacttaataaatagtacctattttattaacatgattatttcctttttaatattattatgtgaatatattctagatagaaacttttagaatcttattaccaattatatgtgttaagtcaagtttagcctaaagatgcctccttccatattttaagttcaacctaaaagtttctctgtacattgtgaactataacctacacagaggtgtaaacagactgtagtctactcttgtgccaatcaatcactgagctttggttcatcaaaggtggtcaatgttcaaatcatgttcaaataaggcaaatgccgagctgtaaacaatatggctgtttctgtacctcacatccactttctgtatcactttcctttttctgtccataaatcttcttcccccatgtagctacactggagtctcagtgagcctgctctggcttgggagattgcccaattcatgaattgttctttgctaaattaaactttgttaaatttaatttgactaagcgttttttgttttgttttgttttttcctcatggtaagggcatagaaatgcagagggcaaacccaataaagagaggaatcagatatgggagaaaatagttttagatacaatgaaaaattgaaataatagttaactcttaacacttgaagttctcatagtatgacggtaggtaagaaaccatggagaggaattgttctgagggatttctcatcgtcattcatgtagccgttgaatttgtaaaaatgtattctattttcagatgctaaaactaaggatcagagctatcagggaaataaggcagccagtgaaaaactgaactaagtctgaaacagatttgtcttatgcccaagtccaaagcataacttagccctggagcaacagagtgagttatctgtgcaagcacctcaccatgtcaactctgggggcaactctgtcagtctctcctgcaaattggggcatgaggaagagtctgtttaatctgcaatagtatccaagaggcaatgattgggtacaaatcatcaatagtgacaattcctctctaaggtaggtttctagttggatacaacagcaatcagtatcagctgaacaatgatcatttacactgaatagtgaaacagtaccactggaaaaatcatcaggtttatagaccagcaagctgagtgcgtaaaatgttactgtaatgatccatgccaaagtctctctataatccatgccaaagtctctcttctgtcagttatctgtttgtctatatcactctacaacatattatgccctgtgggacaatggctttgtgttcagatgacacatgctcagccaaacagtgttaaatacgtttctcaacactgaaattctctggcatccttaatagctatatatccacaatgtgaagcaattttctaaattttgtgagaagaacacctgtgaaatattgttagaggatgtgtattcattgctcagaaacagaaatcctccttcaatatttgacctaagtgatttaatatttaaatctttcatttatgttacaattgtattttgtttagattctttctttgagtatattctagtaacaagttttgaacttatcctggaggagttaccctggatcacttcatattatttcaagtcaaaagggaaagacaaatgtagccaagataactgagacgatcaaaactgcaaattcaagaggcatttacttgaagttaagagttgagaacatagggccaggcgcggtggctcacacctgtaatcccagcactttgggaggccaaggtgggcagatcatgaggtcaggagattgagaccatcctggctaacacggtgaaacatgctttctactaaaaataaaaaaaattagccgggtgcagtggcgggcgcctgtagtcccagctacttgggaggctgaggcaggagaatggcgtgaacctgggaggcggagcttgcagtgagccgagatcgcgccactgcactccagtctgagggacacagcgagactgtctcaaaaaaaaaaaaaaaaaaaaagagttgagaacatagaggtcaaataagcacccaagctatagtcacaggaggtagaaaaacgatcaccaaacctttttgattgcatgttctataagaaaaacaagtacattcacctccaacatacaggtacttctgttcagatatattatgtatgcaattaaataaattaacaaggtttaaagttgagctaaagataaaataaacaatgtatattttaataacttgccattcatttttgctttctgttatcattagctagtaacttaagggcacaatatactcaaggcgatgtttattcttcataataatgatagaaaaaatatattttagtcttccaggtaattttaatacttagtggacaagtgacaatgatgagagtatatcagaaaagggagagatatcatcattgctattgtcttataatttacttgtgtttacatttagcacaagtaaatgttaagtacacttacattattgtttttaatcgacagtctcatagcagcaatctggtttgtgaagatttgtgtacatcagatacagtaatatgttctgcaaatccaaatgacaggacacaagcctctgatcatgatggaggcaggaggcagagatagaggctctaggcagagagagacaggttcctggtgaaaccccacctttaagccaaaaagcctaaaacctggggcccaaagtgagaacttctattcccgtttgcccactctctccagattggttctttgtgaataataccttttcaccaatcaaatgttgccttttccagaactacctatgggctgccccatccccaccatcctgtgcctataaagaccccatactcagttggtagaggggagagatggcttatgttcagagagaagatggccaggctttggggaagaagagacagcttgacttcggggaagagacagccagactttagggagaattatctgcccttcctgtcccctctccagctccccttacacggacagccattcccaccactcgataaaattatttgccttcaccatccttcaagtgcccccacaaaagcatttttcttgtacactggacaagtgctcaggatccaccaagtgtgggtacccaaaacaaggccgtcacaccagccctttgcccttgctggtggagggcagctgccccatgcaatgaggcaaggggctaactgagctgttaacacacagctgtccacaggcagtggaactaaaggagcattgtaacactcgctctgggtccttggggcaggttgcaggcattcgctgccctgacctgggcgctgccgccagagcttgctcctgctggcacctggagtggctggccaagtctcacactcgctcatttgtcactggtctggtcacgggccccgcagagaacttgctcctgtgtgagttccccgagtggccagccgggttctgcactcactcgctcaagtgctccctcccgcaaggggttgagcatggcaggcaaagtaaaagtttgcccccatctcaagtcccatgaacagcctgagaaaaatcctgcatcagtcaggaagggcgaggagggaactctggtgaagctgtctgtgccctggactgacttcctgctgggcacgcctcacccatcctgtgtcacctggcactgataggcaggagaacctgccagagtgccgttgtcagcccatgctaacccacttaagattattttctgctctataagttgacttaaactataaagtgctgttcaagtattttgttccaggacatcaataaataatcttaaattcttcctgggactctgtggcaggctgataatggctctcaaagatgggtctatatcgttatctcagcaatgtgtattaccttatttggaaaaaggacgtttgaggtataattaagttaaggatcttgagatgagactatccttaattctctgggtgagccctaaattccatcccttgtgtccttctaagagagaagctgagagagattaggcacatacacagaggaggaggcaacttggcctgaaaggcagagactgcagtgacatggccaaaagccaggtgatgctggcagacacctgaaacagagaggcaagggccatattcttccccggggccccagagggagcacagggagtcctgctgacagctcgatttcaggactccagcctccagcactgtaagataataagtatctgttgttttaaacctcaaaactaagtttgaggtaatttgttatggccgccacaattaaactcacactggcatcaagtgtaaatttagagtccctgatatagaaatcagtaaacatatatgtaaataaataagttaatatgggaagggaggggtctaatttagcaacttttaagtgggcaatcagcggggatgactttatggaggacctggcaagatgggacctgaaaggcccaagtaataataagcatctgtgcccttgggtgaagacgcaaatgcaacgaatatgtgtctaagatcatatcaaaaatgttcacgttttcatcatcttattttcttctgacaacaaacatcctaagattgatatacattcccctccttatggggaagaagtgcaggctcaaagatactaaataacatgttcaagatcaaacaccttgtaggtgcaggcttggagttgtggcctgggtctcctgattccaggtccagtgttcaaatgacataacatcaacagcccttggcctcctcttctgaaagagaagcagtatgaatttcaggtctccccaggcccattgcaaattcattttatggttctaaaatgagtgcataaatttgtggtaaatgcaagtaggaaaatgtgcttctatcctgcatggcagagtccctggcacatgcagaaactgagtgcaattggcattaattcttataagtccctatactgaaatgaattaaacatgtgacactgctctctcctccatgcaggaaaatgttagcacaatcccttagagtacataaacaaggatccctcaggtttttagtgtaatatataaaaccagaaatggccttgaacattctcagaagccaaaatcctttctccaaatcctaaatattcttcacaatgttttcatcttcgatgctcttttccagggacaaattcctgttatcctattagctaattagcattcagtgtgtttcttaaagcgctcaaagaaacattcaactttcattcatttatgacatcagataaagtcatcagaaaatgcaatccattctttcattgttctaaaagacatgctaggctgcatttcactgagagaaataggtgtagcaaagccataacctgctagtaatatcaatgacaccagagggtaagctcttaaattttttccagaactcatcatgcattggtgaccaaagattttgaaaatgcgtttcaaaggtaaaaataggtcttcttccctcaaaaccaggattttagaattgaaattccatctgtaaattggtccatcctatcctaaccctgcaccttccacaggcgataggaatgtggccccaacacacaaaggcatgtgccctgataattcctgtcctaagtcctttctgcttggcctgctctcttcctacatttgctcccatctggccttgagtctggttgtctctcctagctaaaggctgaggggcatgtcttcatagttggtgccggtgcccagtttctgtctctagtgttacttgcttctctccagggaccttggcacaaaatcacatcaccactgggtcttgcctcagaccagcctactgtcccaaggaatctgatttcttgctccaagtcactggtggggactcttgtctggtgacctgaccactctgtttgcagacgtttgtagtcctagccaaattgaagttcttaagggactcccaagctcaaagcttcttaaaacacagtctgccgtttctagtctatataatatactaaactatagcacctctcatgccccagagaatatacaatctagaaggagagacagatatgtaaacatataaatttggtgccagttataaatacagtaataagaaacacaggcatagaagttgtaggaagaagggaatgatcaactacagttaaagagcagaaccatctttgctgaagaaattaaaatcgacttagtctttaagcaatgattaggatgttcccagagagacgaagaagagaaacttatttacctaatttcaagaaaaaacagagttacagggccagaatgtgaaactggctgattgggcaattataaagcttcaggaattgctagaccagcaaacaaggtcatcaaagactgacagcatcagcctggagggcctcctgagctaggatcagaggtttcttatgaaggctctcagtagaactcatatcaagtataaagccattacaatgactttgtgaaaatgtttccaagctgcagttttcaatcaaaaatttttttaaagcttccctgtttctgagaacttgcataaatgggcagacaaaaagtgtagccctgtttcacaggctaggtagggatggcaggcagagctgtgttagcttttggcctcctctttgctccctggtaactcctggctgcagaatcctacaaaactgtaattaacaaatggaattcccattgactgtgcaggttctttgttgaaagtgtgataactcgatgtctgatatttagaggttagagactggccactgtctgtctttttgactgtcctcatatgtgttgacagcattgtccaaatctagtgtctggctcatggtaagccctaactatgtgctttttaacattcacgtgaaagataaatatcatcacaggtgcaatgcaatcaatgcaacatatgaatttcaaaattatgagaccacaacagagggaaactattttactggaaaatgcatgttctttggtgtcagctacacctagatgcaaactccaattctgcctctaactgggtgtgggactgtgagaagtgtgttcaacctttttaagttatcatgtcttcaaatgtaaaattggaatagacaccaacatacagatttttaccaattgagataaaatttagtaacaaatataaaggtcaacatagtccagtgatgcagagcacagagacttgagatatattaccaaggttcaaatgccagcactgccacttcctacctgcacctcatgtccttcatcttaaaattgggatgatgatggcatctaccttgcagagattgtgtgtgagggtacagtgagtcaatatgtgtgcatctctgttatagctgggtcatagtaattgctctgtcaattgtagccattaatattggaaggtacctggaatgtaagaaatgtcaataaaatatagttggatgatgatagagcttgaagagcttgagcaggtacttatggggcctgaagtgtcctagaagtgtcctcaaatcttagaattcataggtttgcacaagactgaatgggatagccatagaagagtgaagctgaactgaattcctggtcgactgacaagcaagagcaactgaaacaccaagtgtgcactatgggcagaaactgcagtgaaaaagcctgctatggaggccacataaaatgatgagaagagctttaggatgagtttcctaaagagactctctgaggcaacagagacgaagagccccagactgggggtaaatctgttttaaaatagagtatcatctcagtagaaagatgatttgaatcaactaccaaatttctcactatggacattagttactttttaaaaaatatattatcttttacaaatatggcactagtagtaatttcatcaatactaaactagataatgtagatatcaagtcctgtaggcaataagaatatttatttttccttaccatgtattcaactttaccgggctttgccatcagaaagtgatgttgacaagacttcgctggtgttctttgttataacaatttacttctttccttcagaggagagttggaggtgtaccacatgaagcatgaactcctcttcccttcctagattgtcaacctatgcaatacggatatataaataaaaagctgcagtgagtcattttccccaaggcttgaaaaataagattgcttttatcagaaatatatattctgtttgggaaatttttactctatattctgtgcagaagcatgagagaacgatcatacaaccaagcagccctcaacaggtactctacacatacatttttattacttactagatccacctctggatggtccaatgtcaaatgataggctttattccattctaatcagagagtagagcacattttcatagatcaatgtacactggcatctttattcaagtaaatctctgcctgctgttggctgcatctcttgcagaggattctacctaatatgacaggtttcttagactaagaatgagatactgtcccaacaccttgttgcattccatcactctatggtcctagaaaatagaggttaatgaagcaaattcttttttttttttttttgagacagagggaaccacgctcttctcttttcagcacttctgtataacttccacattgtagtcagatctgtgtgattttattttttctccactctatgaaagcttgctgaaagactgatagtctaaccaatatttatcttttaaaattgttattcatatagatgattatgcataatcatgacaagattgttaatttggtgataatgaaaattattattatcctcttaaaaaggagaaaactgacacccaagagaaagaattttagtagacaaaaggggaccggatgcagtggctcacgcctgtaatcccagctctttgggaggccaaggagggtggatcatgaggtcaagagcctgagaccagcctggccaaggtggtgaaaacccgtctctactaaaaatacaaaaattagccgggtgcggtggcaggcgcctgtaatcccagctactcaggaggctgaggcaggagaatcgcttaaacccgggaggcggaggttgcagtgagccgagatcgcgctactgcactccagcatgaacgacagagtgagaccctgtctcagaaaaaaaaaaaaagatacagaagggaggaagggaagtgctggatacaggagggcatggtccctggttagggctccaccaccatggatctgggtgaggacaggcatttcctgactaaatgttgcatttcccaagaccaccctggcctgccactcccccatactgtacctataaaagccccccaagactctagcaggcagacacacaggtggctggagcacatcagcagaggagcacacaggcagctggacgtcaagaagagcacatcagcggaggaatacctgggtgactggacatggagaggaacacactgacaggcactgacacactgccaggccacccacaggcaaagtagaacaatgcagaatttggctggggagttggaggacagccctggccggtgagtggcctgactccaggggaacatctccccattccatcccttctgacttcccctgagctaccgccactcaataaaatcttgcattcattctccaagcccacgtgtgattcaattcttccagtacaccaaggcaagaacccaggatacagaaagccctctgtcctgcgacaagggagagggtctaaatcgagctggttaacacaagcctatagacagcaaaactaaaagagcaccctgtaacacacacccactggggctttaggagctgtaaacattcacccctagacactgccgtggggttagagccccacaacctgcctgtctgtatgctcccctagaggtttgaatagcgcggcactgaagaagcaagccacattcccatcgcacaaccctgcgagggggacaagggaacttttcccgtttcaaaagtgccatgtaatgtaactagtagacagattttcagaaaaccccatggaatatcactggaactaagtagagtctctggattgatgtcaggggaaagattggagtcaagtggcccaggacccacccctggctcacccaggttctaactgaatccatggacattagagtcactgattaaaggagcattaaaatatggtagtgtttaagtgtgctagctcaggtgttagattgcctgtgttctcaccttgtaccactacctcaccaggtggacatagattcattttcataacctctttgccctctgttattcatgtgttaaatagggatggcacttttgctaacgctggggttcttggaaaaatggaataagataatacatgtaaaatatttacagtaattactgcacaatcataaggtctcagtgattatcaacagtgttattatctctatcatcctcatcattgttgattccactggcacccagatttccacctcctacatttaggaaaaacttaaactgacaagagcagagactgtgccaaggccatctatcacctttcttgaatggggaccttgatttagggtgactaactgtcccagttttgagattgtactggttttagtactgaaagtactcatcccataaaatccttgattcctgagaaactgggacagctgcttacccctgaggaacagctgaatctaacagattccaatgccccattcagtcaaaaaagagagactgaagaaaggcaagctgccctcagggaacaaactgagaggtgaagccagctgggcttctgggttgactggggacttggagagcttttctgtctagctagattattgtaaacgcaccaatcagtgttctgtgtctagttaaaggattgtaagtgcaccaatcagcactctgtgtctagctaaaggattgcaaatgcaccaatcagcactctgtaaaaacgaaccaatcagtgctctgtgtctagctaaaggattgtaaacacatcaattagcacactgtaaaaccacaccaatcagcactctgtgtctagctaaaggattgtaaatgcaccaatcagcactctgtatgtaactaaaggattgtaaacgcaccaatcagcactctgtaaagtggaccaatcagcactctgtaaaatggaccaatcagcgctctgtaaaactgaccaaacagcaggatgtgggtggagccaaataagggaataaaagctggccaccctagccagcaggggcaacccactcaggtccccttccacgctgtggaagatttgttcttttgctcttcacaacaaatcttgctgctgctcacttttcaggtctgcactacctttatgagctgtaacactcacagtgagggtctgcggcttcattcctgaagtcagcgagaccacgaacccaccagaaggaagaaactccggacacatctgaacatgggaaagaacaaactccggacacaccatctttaagagctgtaacactcaccatgaaggtctgcggcttcattcttgaagtcagcaagaccaagaacccactttgttgaagtcagcaagagcaggaacccactggaaggaaccaattccagacacaaaagctttgttttttccaacagggagaaaaagcaaagtttgctgcctcaagggctgtccaaccagtgctgagcaataagcttcctaataccaccaactagggaaatccaggccagggataccatcagaccctcagcactcaggctgctgctccttgggagacaggagcggttggagaagagtcagatcacttatttttaagggaggcccagtcttgactacagtcatcaaatggggacccacaattcatacatgcgtcaagatttcttcaactcatggctttatgtggtctatagatgccagtattaattgtggaattgaaagcatgagcatataactccaaagttacttcaaggcaattttataaaacaattatgaatgttgtgaccaaaaagtcatgccataaataaatcaatcctatattctacatgtttctttgcaaataccctatgatctccttgtctcttatctctttttataagataatagtcatgttctgtcctttcttgatacaggatataaaattcttccactttgcttatttgttatttcaatttgtacttcaagctgggtgtctttggcatgacatttaaagtaaacttctgttctttccaacaggatgtataaaatgtttgctacaaattataggtttggaggcagggttttgctttcttcatatggctctatacctttttgcctttctaatgttggctttctaagtctctggtcagttacctgttccctataccaggatggttgataaacccttctctattaagagaaaagagtatatttctgaccggggtttgagcaaaaggtggattctccctcttgacagagctgtgaacaaaaaagctgcttcttttatggtatacccagtgatagtaacaatgaggggaattttgtctgcattagcattctgtgcctactgtcatatgggattcatgagtgtttcttttcttatcctatacctgggaggcacccagtgtaatgaaaaaacatatttgaatttatatgaacagaatgaattctaagttaaaatatggttccctcctctgagaaaactctaaggggatttaattccaggccagtttgtatatctgatgcatgtgttgaaagcatgaaaggtgctgcctgccccttttccagcttctcatcaaaaaataaacccagtaatgttgcagcttctccttattcttaatttttaacccaacagttttacttctatacacacataaatttagagagagagatttaaaatatagttcttctaagcttcgaaactttgaacaactggagatgctagaaagataatattttcttttatttaaaaaatcaactgttattgagatgagactttcatacaattttaatttttcaattttgaactttggttcctaaattcaacaaaagttaagacaagacatagaaggacattgcagctgtcaattttctcaattcataaaataccagtaagaatggtatctgatctcaaagaaataaatacacaagaaagatgtgaattaccttgtcaaaagagcctgagcaatagcgacatatatagatacagcttagctaaaataaggcttagctaaaagtaccgggaaagagatacaataggaagtgttagtcatgaagtaaacctggcttatggcgcttttatgtgaaattttatgactgtgttagttaggcttttttggcaataagtaacaaactcagctcacacaagttaaagcataactgaaactttattggctcaggtaactgtgagggttgtcggggaagctcacaggaaccaagatagttacagttgccaggtctcaagtgctagaaccaaaattcaacatggccaggactctttctttgatctgcccttattcatgctggactttattttgcagaggaagttagttcctccaataaaaatgatgcttgggaacatgttctaggtaagtagctccaatggaatgaagttttctatgtcaatgtctgtccactaaagtcctgtggagagctctgaataggttctgtttggtttcgagatgtctactctggcattagtgtagctggtggaatggaagactcattggccaaggtgagtcatgtgaccaatgaatggataaggagaagaaattttgttgttagaactgtaatgaagggaaaacattctggccatctaaaaatgataaatgcttaagtgttttgctttaactttggacaagataagcttgtatgagtctcagtttccttgtctgtaaattagttataaaatttgccaactaagtgtaccagaaaaattaaaagtaacgtgtaaaaattcctagtaaattgcagaatttaataattcctaatacaattgcagtagttacagacttcaataaatgtgagttccaaccactatctgtatgtcttagtctacttgggctgcaataacaaaatgccataaaatgcatgttttaacaactaaaatttatttctcacatttttgctgtctgggaagtccaagatcaaggcactagcaaatttagtgtcttgtgagcacctgcttcctgattctatggacagccatcttttactgtcttctcacatgctggagatggcaagaggtctctcttggtccttttattttataagggcactaatctcattcatgagtattctgccccccacaacctaattatctcccaaagttcccacttcctaattccattaccttgtaggttaggatttcaacatataaattttgaagggattcaaacattcaaaccatagcactgtggtaacaagttaactgcccaaatttttgtagtttaacaaaatcaaagttacttcttgctctctaaaggtgtaactattgacaggtaactctctttcagtgacagagacgacttaatcttactgttccagtatcctaatcttggagccatttatacccaagtggtggaaggaaaaattgatagtaaaaaaaaagcacacctgctccctataactccgtggtaagaagtgacttgattacacctaaaggccaggaagcatggcaagtgtaggttctcgcaggtcagctacctctcagtgactaattcattttatgagtaaaagagaaacaattttgatgaacgatgagggttttttgtttgttttttgttttgttttgttttgttttctacagccaatactgcagcacttggatcaaatgatcctcaggttttttctttatgtgtgtagcattgagccagaaggaccaatggctaaattggtccttctgggaactcaaagttaaaactacttaggctatttacaaatacatcaggattctttggatctcaagctctgttttgaagttatatgacctccatggtacatgttctccatgagaaataaaggtcagggcaagaggtgcttcatctaccaccctctcaagatactcaagactgatcatagtaaatggatcaaccaacttaaaggagggataaataccataaaatgttcccactggaaacaagggttttgattaaaataagaaagatgatttactgaatttgccctaaaagaaataaatagagaaataaaagaaaaagaaagaaaataaagctcagacatgaggaattaaaaaaaacttttatctgaggaatatgagtccttttaaattattaggcccagagagatgtcaaatgagattgcagcaggtcatgtcccacttccccccttgagctgtgtgttcatttcttaaacctgctattgacacaaatagcaacacattaacctcataatattgctctggacactataaccaacaccctatagcttgacaatgtgtagccaatcactatcaatgctgtttccctaaatcaatgagaaaccctgacaaacaactttgtatcagctcgctccctcttcctcttttttttttttttttgtctttaaaaatctacttgtgactgctgctaattgaagggtatattcagggcaacttgagtctatgctcccaggttgcaatccacaagtttagtgcaaataaactctctacttttgttaactttgcctcagcatcttcttttttggtcaacagacacaagtttaaaataaaattcctgtgactcaagaaaccaagaaagccagttttcattcaaaagtatctgctaacattgacttccatcagcttctctttttaacatataaatgagaagaaagaaataaatcctacagccttcccagggtaaggagttcgatagaagagtgcatacaactgagactcacgaaaacttcgatcataagtgacaggtgaaaaataaataaccccctcatgcagaagaagacagcaaaaaacatgagattcttaaacttttctctaaagggagaggtaaaaaatctcagaaattcacaattaaactttcacatattttcaggcctgaatacatgtcacttgaatacaaactttttattgacaaagattattcaactgggtaagaaatcagagataaagaacacatttaagctagatataaaacatttattttgcaacatgttgtgttgtagatatgaatggtaaattgggatggagttttccaacaggcaattagatatttgtgtttataacttaaacaggtttgaagtgtagctatccatcagtggggtataacatctaaggccattcgaagccatgaaaagtagatgaagaattcgctttcaaaaattggtacactaattctgatagactcttcaactaacaaaactggaaaaagtggattaaattaaaaacagaagaaggaacaaagagagaatatctttcttagaatttgaaaggaagttatcacagtagctacagaagagggcttctgtatgtgacttgtgattttaggtagggaatttcagctgcagtcatccaatggtctagcagaaaagaagcagagaaggtcctgccaaccttccataccctgtcagtgcatccctttggaaaaatctaactgaaagcctggctcatgaagtccatagtatcaacctgttgagccaagctgtgaatcttgtaaggctattaaagaatattcagaaataagaaacaacaacaactgttatgtatacatatatatgtgtgtatatgtatatatgtatacgtatacacgtatacacgtatacgtatacacgtatacacgtatacgtatacacgtatacacgtatacgtatatatgtatatgtgtatatgcatacatgtatgtatgtgtatgtatacttatatatgtgtgtaagtatacatatatacgtatatgtgtgtatgtatacatatatacgtatatgtgtgtatgtatacatatatacgtatatgtgtgtatgtatacatatatacgtatatgtgtgtatgtatacatatatacgtatatgtgtgtatgtatacatatatacgtatatgtgtgtatgtatacatatatacgtatatgtgtgtatgtatacatatgtgtatatatgcatatatatgtatatataagtgtatatatgtatatagaacatatatatacacacgtacgctttttgatgagaagagctataactcattgggcaaataaaatggttctaggctgtcaaagaatgacattttaagaagttgagtttaagaatttaagaactctattagtctgttctcatgatgctaaaaagggcataaccgaggctgggtaatttataaagggaagaggtttaattgactcacagttccacatggctagggaggcctcccaatcatggcagaaagcaactgaggagcaaagtcatgtctaacatggtggccaggcaagagggcttgtgtatggaaactccccttgaaaaagccatcagatctcatgagacttattcactctcataagaacagaaatggggaatccacccccacaattcaactatctccacctggctctgcccttgacacatggggattattacaattcaaagtgagagttgggtggggacacagccaaaccatatcagtaacgaattagctttaattgctcattcactgatagggcagcattcaatctgtgaaatagaaaggtgctttgctgagcagagcaggggtggtggatcttataggcagaaaagactgaaggaaggagaaatgaggaacaaaaagtgaattggtggttcaaagttactttcctggtatgaattaatgtcagattatctgggcttcttataactgcttgctgtgaatctcctgttttcttttggaaaatagacccattcttaaattctgtttgattctgtgatatttagcataagtgactccattatgatttatctatcaggaccttgttgaggatctcagttcaaaacaatggctgctatttattttatttaaggctcccttgtgaaggtgagtccatgatccacagagtgagcactttctggggcacagcggtggccagtccagaaagagtccagagagtagcaccatgaatccagaccttgctgcaggtgatacacaaaaactgtgaagtagaagcaatctggcttcactgtccccaagagaaagccaaaaacaaatatttaatgccaagatcgtcatcagcaatatcctagaactcaaatctgtagctgagaaagtccccaggggcacaaagaggttaaaaactcagagaaatggtaatacaaatagaattctctatacacaatgcttccctcccaatctaccaggcaccatgcacagaaaattcctcctggacttaatggcttctacactggaaaaaagtgaaattggggctgacaactagcgtccccatcattttggatttccttgcagaaaaaccgtttctgcctcaacccaagagaagcattccaaatgtgtttaggtagaaaacacctaaaggcagctgtgaagaatgagaacagcaagaactaaaaaaatcagcccataaaaccctgctctttatcttagtgaaaggagatgctaaatcacagtgcctatgtactagcactatgctataggaggcatgttccatgggtcttctgggcaggcacctacaccagcctttccacatagccacatatccattttgcaattttcccttccaggatgggcagtgctcttcatgtttgcaagagccaaggctaacattgacttaagccaccatctagtactgataaggaaacagtgatctaggactaaggggactcataggcaactgcaaagaacctctaagtaaatatacataccttcaaaagacctaaacaaacccgacagcaaagactagaataaataactagaatacctcttcaatgtgaagccatacacatatatctacaataaacaagaacagacagggaaccatgacctccccaaatggaaaaaaaaaacaaggagccaatgactaaccataaagagagagtgatgtgttagttttcagattaagaattcaaaacgatgatcctaaagaaactcagcaaactctaagacaacacagaaaagcaattcagaaatgtatcaggtaaatttaacaaggatattgaataatttaaaaattaaacagaaatcctggaactaagaaattaatttattgaactgaaaaatacgttagaggctctcaataacagaaaggatgaagcagaagaaaaatcaatgagtttgaagacaggctattgaacaatatacaatcaggaaaaaaaagaatgaaaaagaataaggaacatctggaagatataaagaatatctatatttcttgcaaatcttaggataatcagcactaaagggagagtggagaaagagcaaggggtaggaagcttattaaacaaaacaataaaagaacacttttcaaacctagagaaagatacaattattcaggaataggaagatcacacatcactaaacagattcaacccaataagactatcctaaggcgtatgataatcaaaatctcaaatatcaaagacaaagaaaggattctaaaataagccaacaaaaagaagtcagtagcaaataaactacctttaattcatctggcaagagacttctcagggaaaaaaagacaggccaggagggactaggatgaaatattcaaagtgctgaagaagaaaaaaaactttcaagcagaaacactgtattcagcaaagcttttcttcaaatatgaaggagagacagagtctttctcaggcaaagaaaaaaaataccaaggtaattcgtcaccattggacttctcttatgagacatgccaaagagagttttttgtttaaaataaaatgatataaatgtgcaaaaagaaaacatttgaaggtgtaaaactcactgaccaaagtaagtacacagaatcaatactttaacactgtaattatggtgtgtaacccactcacattctagtatgaaacacaaatatgaatctatccaaaaataaaaataactatggaaaactgttaagagatagtcaataaacaaagatgtaaattaagacacaaaaatgtcaaaataggggagatagagttaaagtgtagagtttttgttatttgtctgtttatttgtgataaaagttacttgtcatctgtttaaacttacttattgtgtctacaagatgttctctgtaagcctcatggtaaccacaaagcaaaagtatatatatgcatatatattttagtgtataatagatacactgaaactagaaataaactctcaaaaacaatagattaaaatatactactagaggaaaccattaaccacaaaaaagatggtaagaaaggaagagagaagttataaaacaaccaaagaaaagtaaatcaataataacattgcatgtattgcatgtaaatggactaaatgttccaattaaaacatgtagtgaatgaataatttaaaaaaaagaaccaaatacatgctgcctaaaagaaactgacatcacatacaatgacacagagactaaaaatgaaagaatggaaaaagatattccaagcaaatgtaactatacttttatcagataatttagacttcatgtcaatgactgtaaaaagatgtaaataatgtcactatataatgataaagaggtcaattctgaaagaagatgtaagaattgtaaatatatatggcccaatgccaatgcacacaaagttttaacacaagcattagtagagttaaatggagagatggaccataacacaataatgactggggacttcaacaccccactctcggtaatggacagttcatctagacataagatcataagattaataaagaaacatcagttaaacaacactctagaccaaatgagcataatgatgtttaggaaacattttacccaactgctgcagaatatacattcttctcatcagcatgtgaaacattctccaggataaaccatacttttggccatagaacaagtctcaacaaatccaagaatgttaaaattttatcaagtatattttctgatcacaatggaatacgatgaggaattttggaaactctacaaatacatggaaattaaaacacatattcctaaatgaccactgggtcaatgaagaaattaaggcagaaatttcaaaatttcttgaaacaagtaaaaatggaaatacaatattctgaaatctatgagatacagcaaaaatagtgctaagagagatgtttatggccataaaagcctacaacaaaacagtataaagatttgacacaaacaacctaattatgcacttcaaggaattagaaaagcaagaacaaaccaaaccccaaatcagtagaatgacaaaaataataaaaaccagagcaggtgaaacacagtggcccatgtctgtaattccagcgctttgggaagccaaggcaagaagatctcttgaggccaggagttcaagactagcctagacaacacagggagacccctgtctctacaaaaaaaaaaaaaaattaattaattaacttggtgtgatggtgcacactcccaggctcaagcatttcccccacctcagcctccctgctatgcaaaaggaaaaaataaaaaaaaaattcagatcagctataaataaaatggacactaaaaaaaaaaaatcagccaggcgcggtggctcatgcctgtaatcccagcactttgggaggccgaggcgggtggatcacgtggtcaggagatcacaaccatcttggctaacacggtgaaaccccgtctctactaaaaaaatacaaaaaatttagctgggtgtggtggcgggcacctgtagtcccagctactggggaggctgaggcaggagaatggcgtgaacccgggaggcggagcttgcagttagcggagatcaagccactgcactccagcctgggcgacagagcgagactctttcccccccccaaaaaaaaatcaacaaaatgaaaggtttgtcttcaaaaagtccagcaaaattaacaaaccattagctagattaagaaaagagaaagaagagtcaagtaaaattataaatgaaagagagaaataactgataccacagaaaggcaattgaccaatagagactattatgaacaactatatgccaacaaattggaaaacctatcaaaatagactaataactggacacatacaacctactaagattgaaccatgatgaaatgcgaaacctgaacagatcaataatgagtaatgaaatcaaagcaataataaaaagtctcccatcaatataaagcctaggacctgatggcttcactgttgaattctacgaaactttaacagaagaattaatagcacttctattcaaactattccaaaaaatcaaagatggagaatacttttaaactcatgctatgaggtcaatattacccctataccaaaactagacgccaatatccctgatgaacacagatgcaaaaattattttaaaatactaacaaagtgaatccaacaacacattagaaatattattcaccatgaccaagagggattcattccagggatacaaggattgttcaacacatgctaatcaatgaacatgatatatcatattaacagaatcaaggaaaaaaacaaatcataaaatcaatagatggtaaagtagtatttgacaaaattcaacatacttttatgataaaaactgaacaaactggatacagaaagaacatacaaaaataaaggacatatatgacaaactcatagctgacatcagaatcaatggggaaaattgaacttttcctcttaagattggaaataagtcaagaatgaatacgttcatcactttaacatagtattagaagtcctagacagtgcaattagacaagagaaagaagctaagtgcctctgaaatggaaaggaagaagtcaaattatgcttgtttgtagacaacatgatataaacactacctaaaaactgttagcatgtataaacaaattcaataaagttgtaggatacaaaactgatgtaaaagtttactaccatttatacatgccaacagtgaacaactgaaaaataatcaagatagctatttcatttacaatagtaacacaacgtatgaaatactgtagaataaattaaatcaaaggagtgaaagttatctccaaggaaaactataaacactgatttaataaactgaagacaacacacacatacaaacaaaagatagcctatgttcataattttggaagaattaatattgttaaaatgtcaacactatccaaagggctttacagattcaatgcaatctctaccacaacaccaatgacattcttcacagaaataggaaaaaaaaaaaacaaaaaacaactaaaatctgtatggaaccacaagagactctaagtagccaaaacaatatggagcaaaaagaacaaagctggagacattacactacctgacttcaaaatatactacaaaggtatagtaaccaaaaaagtatggtattagtattaaaacagacacatagacaattgaaaagaatagaggactcagaaataaatccatgcatttacagccaactcataattgacaaaagcgccaagaacatacactgaggaaaggacagtctcttcaatatatgatgctgagaatactggataagcgtatgcagaagaatgaagatagattcctttatccaccatacacaaaattcaaatcaaaatggactgaagtcttaaatataatacctgaaactatgaaacttctagaagtaaacattggggaaacacttcaggtcattggtctgaataaagacttataggagaagaccacaaaaacacagacaacaaaagataaattagacaaatggaagccataaaaaggagactatgttatttgccacaacataaatggacctgaaagacatttcactaagtaaataagtcatatgcggaaagaaaaatattgcatagtctaatatatatgtgtaatattaaaaaataacttaaatacacaaatatagagagcaaaatattggttagcaagggcagggggaggtatggagaggaaatgggaagatgtaggtcaaagggtatgaaatagcagctacatagaatgaataagtatagagatctaatgtacaacctgaggactaaagttactataattgtattatgttaagaatttttgttaaataagtagattttagctgctcttgtcacacacaagagtaactgtgtgagataatagatatgttaatctgccacactacgtaacaattttactatgtgtatgtataccataacatcacattgtaaacctcaactatactttctttgagcaaaagtgtatattttttggaaaagactaatataaccaataactagtgaaactggtagtgaaaaacatccagaaatttgtaagtgtacatcatgacagatcctgcaaacattaaaataagaatattatttacaaaattgtctactatgtttcagaacataaacggacaaattcctagagagatagtttacaaaactgacagaaaaaaaagaatgctaaataagtctgtatctattaaaaataatgaaacaatatttttagaacttcctataaaaaaacttcaggcccagatgacttcattaatgaattctagcaaatatttaaaaaagaaatgtaacaatcttaaatttgtttttgagaattaagaaaaaataatatttccaacttgtgagaaaaatctgtcaaggccatcataagagaggtaaatggtatgttacctttttgcatggagatagatacaaaccctttaaaaatttgcagacactcagctaactatacaaaaagaaaataaattacaaccatggttgaatttactctaggaatatgaagttagtctaatagtcaaaaatcaatagttgcaattctctatattaacaaaatgaaggagaaaaatcgcctcaatacatacagaaaatcaagtgatgaaattaaaaagtcatcaatgataaaatctcctagaatcctggggataaaagggctcttctttgacacactaaagaatatttcctaaacacctccagcatgcatcatacttcatggtgaaatattagaagcattccctctgagactgggaactagataaaatgcttactgtgaactgtcaaagtggaaaggcaaaaagaaaaacagttgaaaagtattaagaattaggtcattaattatcccattctattcaggtttctagatatatgaagagtcatgataaagaaatataaaaagtggtaaagtgatgcatcactgtgtatataggctgcagaacggaggaagggattccatgtgatggtgatgaaagggagagagtggaggagaatcaatgaggcagctggagacacagaagacaaagatcagaacattgaatattagagcaaagttttagagatgcattgctttttgccaggtgagcattgtattcacaggctaataggtgccctacctaggaagatttatggattcgaggagctcaagaatctttatggttaggcatttattcagttcacccatatggattttggagttgccctttaaaataacaggagtttgagagaaaaggaagactgtggcaaattcaagttttctgagaaatgtgggaagaactaaaagttcagtacacaattgttcacaaggagacataataattgcaatagctaagtgaacttaaaaaataatttacattgtttgttttatttcaatagttttgggggaatctgcttgattatacagataagctctttagcggtgatttcttatatttggtgcacccgttacccaagcagtgtacacatatccaatgtatattctttcattcctcaacccccctcccacccttccccttgagccaccaaaatccatcgtgtcattcttatgcctttgcatcctcatagctcagctctcattttagttttagtttttgaatatgtaaaacatgtatatagttctaaagtaaagattatatacacagctatactcagaaaatttgtatatccatttctttctttttcttcttcttctttctttctttttttttttttttttttttttttttttgagacagggtctggctctatcacccagactgcagtgcagtggcatgattttggctcactgtaacctctgcctcctgggctcaagccatcttcccacctcagcctcctgagtagctgggacgatggtgtggaccaccatgccccactatttttttttttatttttcttagatatgggatttgaccatgttgcctagactgggctcaaactcccaagctcaagatatctacttacctcagcctcccaaagtgctgggattacaggtgtgagccaccacactcagcttccattcctatccaacttttttctcacaagtaattgttatcttcagattctggtatatacttcctgtatttctttttgcaagaaagcatgtaaaatacctacatgtatacaaacatgtaagtatatatcctcagtgctccttcctttttacatagaggtagagttacttacaatacgtagtaatgtctacttgcttttttcacttcatgatacatccagtaaatcacactatattatttgatagaaataaatcttatttcatagttgaaaattactcttttttttaatgacacacaatttattcaaccagtaacctatggatgaacattaaggttgtgtctaatacgacactattgctacaatgctgcaatggataagcttataattatttaactgcctttcttacctctgtccacttgtcactctgtgatgacaataaagcatcagttgcctgtaatataactagagaaatctgaagaaccttagagaaaatggtcattaggaagagctgtcctgaatgattgagagaatattcattggacacctagctgttttgtacctgaggttgataatgtgatatttctcaagaagccccaaatggctttggaccagtttataataaatgtgctttccttcagtcatttcaacctgttccctgggatcatgtcaggagtgtgagctgtgctgacctgtataaagagacatcacaacaggtcaacagagatgaaacagagctgaagaaacaagctagagatgatgaatagaatcagcctacacccagtgctcaccccgagacaggctacagccaagaaatctccatcacaaacccagtaagtgccaggaccttcctcagaaagggcagcctcccagtaatcagaaagatatgcaaggctgcatcctacctgtcgcaaaccacccaacagaagtagtgtgctaccaggcagaggctgggggcctcttgagagtgtgtcactggcaatgggtgggtgtctaggaaagccaggattttgcgtaacagggcaacgagcatcaggctctattggccactcatgtagagtatggcgctagccattccagccttccaaaacagtggaagccccagcggattcaggaagattctggaagaaccatgattactcagctctggtgtctacagttcagctttaagactttaggcttaagactcctactaacaacaaaggtcctctgtcatagctgatctagagcactgagcagaaaaaggaattgtagaatgccttgtgtgggtgtggtgacattgaaaaggcaaaagtatatcagctggggttcaaggacagaacaaacatagtgaaagcaaggaagacagagataaatttccaagttgctgagctgagattccttcatttgtctttggcttgcagtggttgggcagcgctccatacactaggaatataatgagtatttctgcttgttagaattagagggaccgaaggacaggaagaaaggatcaatgttagaaaagcaatcatgagttacagagcagcagactagagaccaatgtgaccacagcagggacaaagcaagtttccagcagagggcagaattaaccaggatatctggatgctgaggccatgggaggcaagtccagcatgaggagtgagctgtttagaacctgaaagtagaagtggatgggcccattcacaacgcatgcaagtgttgacaggactgaagtgcacaaatgcagaggcagagttcagagcagatcagtatggaccgtaagtatttccctgacttttattttttcacaggcattaggaatgaggtggcctcttggggtgcacatctccatttgggagttagagttgaatagggcataattgtctgtcttctcttgtttttttgttttgttttgttttgttttgtttccttgattcttagcctattaatggggaagagacagtctgaatgcttcctttaaccaatgactcaggaatgatgcctttgtgcatcacctcctcctgtttttaataaggccattggtccagaccaggagactgaacagtgtaggtccccatggatttctttcaactaaaactttgtatttttaaaaagcttaattgcgatcttttgaagtgcccaattaaagatttaaagaaataatgaatatcctgaggtggtctgtctgccctggggttcctctgcaaatgagggacacatgtttctattcaattacaggaaacattttaaaactggctcttttatttcctgctcctcatctccagttcaatttttctcttccatcattttctgccctttcaccctgcagctctgaagtttgctctgaccagcactagaccactgcttcctccttttgttctctaagaaacaactgagcctttgctggcggaacaaacaaacagcagcattcttcagtccaggggtattttgaatcctccagaaaaaagctggtgtggttacccgtgagctgactcaggacatctgcaagacagaggttttacacagccaatccatttgaagtggtttacatcaagtgtcaccattccaatgattaattttagtcctgagggtttaaaatgtaattggggggttaaccttccatccagccctgcacttggtacagagtgggcagactccttttttgctcagtggtggttctatgctgggcttgacaccaggctctgttccctgtcgccagccatacagcaagtcccttgagatcaggtcctatgcattcacacattcattaacttttgctgtctgcaaacacttactgagtgcctccatgtgctgggtactctgtcaggtgctggggattacccgaaaaagccattaccaaaggaggtatggttcttacccacatggagctgtacagacttctgggaaaagagacagtcaactgttctataaatgtctaactataacactgtgagcacacagtgctatgagtgtacagtttgatgtatttgggaggtcaaaacattcctatgaagtagcaatttatccaaggtctacatgttaagtaggaattaacttggtaaaagagagggtggggatagcactggagggagaaagagcagcaagtgggaaggcctatggtgggatgactcatgcactccaaatgtttctcaacagagacattattgggtggaattgttacctacatagaaaaatatttggcatttttaccttcatctgagaaaggctaggatctgggtcccaacttctaccctgcttcttatgacaacaaaatgattcccacattttgaagcatctccaagacagctttatacctccagttaggaaccactacattgggctctaaaaagccctttgtctttgaaggtgactggcaggattgtaaaaaaggaattggtatgaaataacttggaaagaatggtggtacccagatctcttagccctcttagggagtggataagtaggtcagttcttcagaaattgattcctagagtcaattcttctaaaccggtgagccacttacctcacaaccagttggactgatcactgagagttttagtcttgcccctgtctctgtgtttgttcttcgctctgctgtttacctctgtatatgtttcggatctgctgttttgtgaccatgaacaagagctcacaagagggtaggggcagattcaaggtcaaatgacaaagaaggaacaaacagaaaatagaaaactacaaaataaatcctcataattcagcaaatggcttttgatgaactgatattcagttaactgacccagaaccacattgtctaccatcttaaagtgggcatctttctgataaaagcaatgggaaggtggaaggaaaggtgttaactcagtaggttagttgcagcatggaaaatggactggaaaaagtaagagcagatccaagaacaccagttaggaggttagcataatagcacacatgagaaacaatggtagcttagaccaagttgatagatagagaagtggatgaattccatagacatttagggggtaaaatggacaaaaatgggtgatgacatgagggtaataaagacaaatgtgtaaagcttggtggtagtgacatggacgtagagagagaatactggaagatggccatatctgagtgggagatatcattaatttggttttgcagatgtgttttaaagtatccaagaaggtatatcttgtagttgtacaacacagtctagggctcaaagaagacagctggtttagaaacataaatttaggtagcccctgcatatagatgatgtattagcttgttgggcctgtcttaacaaagtatgaattgagtggcttaaataacagatttacatcctcatagttctggaggctagaagtccaagatcaaggccttggcaggttgattccgaggcttcactcctaggcttgaaactggtcatcttctttcagtgccttcatatgttcttcccttggtgccgatatcctctttttataaggacagtggtcgtattgaattagagccaacccatacaatctcattttactttaacttctcttcaatgcttctacttccacatacagtaatagcctgatacacttgggtttaggatttcaacatatagattttggtaggatacaattcagctcacaagagatagcaattaaagctggagatgtggtgtaattttgcttagaggaagaatatatagtaaaaggagagggtctaagacctctaaagtttaattttcaaaaagaaaatagtggaagataaatccctaacaaagaaatccctaggtcatggaagccaagggaattgagtgtcttcaaaagtaggcagttgtgaaactgtgaaaatttgatgaaaaatcatatagaatgaggattgacaaggaatcctgctttctgtcttatttactcactgcctagcttggtgactggcacctagtgagcatgtagtactaaattaattatgtattgccatatttgagtatacagtggggagaagaaaaggagagggaatgttgggtatcacagaaatggctaaccacatctgtgccaacttgaataggatgaacatctcagatcatcagtcccaaattatataaaataagttgaatgatgtctatctcacagggttgaccgagattatatgcctgacgaggatatcaaagacacattgtgactattattcaagcttcccattaaaatacattaactttaggctagaaaattgtctcagattggctagaagtagaaaaaaacagaaagtgaatccatatcaagccacattcttactacagaacaaaatggattagatctagaaaggctgttttcacatgtgaatttcaaaatgcgtcaaaggctgagacaggactctgctgcagtgtgagagaaggcagacaatagcaatgagacaagaggggacatatggacaactcactgtcactaatgtctgtgtaggagagtctaattttacaatcacatgaaaaataaacatacccagaaatgaaatatctgatttatcttatttatatgtgtgtgtatatatataaaacccagatatgcatgtatctttctctgagtgaatactctaaccccttgataggggaacagtctcatgtaaggacaccagaagcaaaagggcctcttgccatgttgctttatgtttaggcaaaatttagagtcacatgtcaattagtaaactgattataaagccatagaagtctgtgacccttttcctgtatttctctgccttggtgtcaatatttccacatctgggtacccagaatactcctgacatccagaataaaacaaaatgaggaaagggagaaaaaaacaaaataggaaagggagaaaatgttacttttttttttttgagacagaatctcactctgtcacctaagccagagtgcactggcacaatctcggctcactgcaacttccacctccggattcaagcaattctcctgcctcggcctcccgagtaagtgggattacaggtactcaccaccatgcccggctaatttttgtatttttagtagagacagggtttcaccatgttggccaggctggtctcgaactcctgacctcaggtgatctacctgccttggcctcccaaagtgctgggattacaggcatgagccaccatgccctgccgaaatgatacttttgaatctttattataggtcaaatactatggtgagagttttcatataataccttatttagtcttaccatcaatatttgaggaaactttcctagtctccactttacaggcaatgaaactggggatttgaaatgttaacttatcccagttcacagaataagtcagtgtgacctcgatatggtgatgtgctggggctggctcctgccgactctccaatttgtgcttctcttcccaaatccacgttcaatggtcactcaacaatggcctaggtaaaagctcaaaactggcctaggtaaaagtgtttataccatgaaaaaagaaaatgctacagatgagtgttttttttttattttttaaatttatttttattcatttattttttttccagagagctggttactaagcatttaccagaatcccctgactgagattaggagcaaatccatgctctcgccaatctattatcattgggggtgacaaggtggaggctttttctccacattattctattagactgaaatctgccctgaggtggcagagactaaagcgtcatcatcattacttaagaattgaattatctgctttatttcacaatgcccacatttgaattaactgtcatctcttatatgaacttttgcaggtctgtgccacactctaaacctacatagaatcaatgaaactcaccaaccttaataaagtgtttgttaatggaaccagtttactcgactcaggacctaggttagataggtgggtgaagactcatgaatgtggccaatggaaagtcacccactgaaacaaagccagatggcaagaatttacaaaaaggctccaagaaaaaataaatcagaatattaatagctgacatttgtgaaacacttatatggcagaaattattccgaggaatttacacaaattaacacatttaatccttgcaataatcccatgagacaaatattatgaaactctgtcttacagatccagtatctgaagcccaaagagcacaaacagctggcaatgagctcagccatgatgtgtgctctcagctgctaacagagatcctggcacataggggccctcattgatattaactgaaatgcacacaaggccagatgtgcagcacaggtttcctggacttttcttctttgtggcagtttctgcagtatattttccaaagggtgattttcataaattaatttcaaatctctgcttgtcattctaatctgacccatcttaagatggcatctgataaagttgggaaagaaacatagggataaagtatgtgatgtttcttgtaatacaaaagaaaataaacaaaaatatttaagcagatctgtctatctatctatacatcaatccatccatatatatatctgcttaaatatttctgtttatatgtatatctatcacctatctacctatctatatacatatatatgaagagagagagagaaagacagagatacttctcagatatttatttatttgtcatctgttgtctcttactgactggcatccattttcaaaatggacctccacaaaagtcaaaattcagtacattggccttgcaaaatattgtgatacaaagccagtcctcaaggaatggggcataactgcccactgggaggcacagggcttcaccatgcatctctgaactactgacttgggtcagcctcatgaaatataaaaggaaatctttcagttggtttagcccccaggaagagagcttcaatgccaaaaagcttctccttctgtgcctgctttgagtttcctctttccagtgagtctaagaggctggggagtggagtttgggtgatacttcccgggacctgcgataagtccctcccttgatctgggtctccacttcctcatctttagtagacttataagaaatggtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatgtctctgttttggtaccagtaccatgctgttttggttactgtagccttgtagtatagtttgaagtcaggtagtgtgatgcctccagctttgttcttttggcttaggattgacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaagaaatggtgataagataatctctaagatttccttcaaatataagattttataattcaaagagtctactatgctgtccatgcggaaatgttagttgttgcctgtaagcaatcgtgttgccttggcctaaacaggtctttatttccaggaatatcctcaccatgacaaccatcgatttcaatgtggctgatgggctgctttcttaaagtccagtgattttaggacttcagaaattaggtgataagctagagtagacatcgaccactgcctttgttctctaggagccctggtattgtagtagtgtttgtaaaagtctgcttgatgtctttaagaaaaatatcaatccctttttcttctagcactactgatatttttctccaactagagaaaaataactttatatccaaagttacatcatgagaatgccatctttgctggtaacaaaccttttcttgcttaattaggacagcctgaagtctgtgtgaagaagaaagtataaaataaccaaactttttttttttttttgagacggagtctcactctgtcacccaggctggagtgagtgcagtggtgtgatcttggctcactgaaacctctgcctcctgggctcaagcaattctcctgccttagcctctcaagtagctgggactacaggtgcctgccccttgcctggataatatatttttctttttttttttcgtattttcagtagagatgaggtttcaccatgttggccaggctggtctcaaactcccgacctcagataatccgccagcttcagcttcccacaagtgctgggattacaggcatgagccaccatgcctggccagaagattttgatttctgaaatattctctcttcctctctcaatcagtgtcccactttcttcttcttacatcttcacactttcccccacctatccttatttctctttctcatctttgccttccatctctctccgtgcctctctcactcctgctctgtttgcttatcccaaatcctcttaatctctgtctaatctctttcttcttcttatactgactgcttcttttttcttttatttttcatcctgtttcttcctgccagctcatgtttaacaagaataacccctgtaacatgacattctttataagtgaagtgatttaaaaaaaactttcttagatgtagctcattattttgggaaatcatgtctataactcgcaattcaacaaggattgagtttgtgcagtatgacagagaccatgttgagtgctgaagttttatgaagacaaataattcacagccctctattaagaatctgaagcaggtggctggggggacatatgtaactgttttgattgaggagtcgaagtgtgtgatggataattttgaagagtttttatttttttcagtagcatccacaattgtgctctgccagtctcccttttgctgctgaaagttagactcatttagtgtcatgtctaccccatagggtttagttgacatttattgctttatattttctaaataaaagccttggtactaaatgttttctcagcagttgcagattcattcaccataacaatgcctgttgtaccatgatggagacatttccaattttaattcattttgaaccaagcatgagaaaaattatatgcaagagttaaatatgttctgccattcaactgctaaaagttgaaaagagctataacctaatatctccatgcatacgaaatgaattcacagatttgcacgtaaaataaactgaaattctgacctttcttctcagtctataggttgtcttctctgcctgggctatgctctcttatgataattctttatattaacgcattaagcaatgagcccacagggtgagttaggtttcagcctaggtcaactatgtcttacaaacatacacaaattttgcctgtaaataactgactggtagatgcatgcctatatataactcagtatcgtattggtatctaagacagacaggctggaaccaagttttgttaccaaacccattatcaatgtattagtcagagttctccagagaactctgtattagtctctctccagaggaagtgtcaataagcactgttatatgtgtagtatatatgtatatttattgagagagacagaaaaatatttattatgagagattgcttcactctattatggaggctgagaagccccacagtctcctctctgcaagttggaggcctaggaaatccagtggtgtggctttagtccaatcccaaaggcctgaaaaccaggagagcaaaaagtgtaagtaccagtctgagcctgcaggtccgaggaccaggaaaatgatgtccaatgataggaaaagaaggaagtccccgctcaggcagagactgaatttgcccttcctctgcctttgtgttctattcagaccctgcatggattggatgatgtccgtctgtattgatggggatgatctttactcagtcaactaactcaaacactcatctcttctggaaacaccctcatggacacatccagaaagaaggtttttcagctacctggtcattccttacccccaggcatgtttacacataaaattaacgaccataaccagtcattcagcgtgtacctggtatgtgcttcctgcaattgttccaatctgaccatgtagcctacagcacatgctatatgaggccttatggattgcaagctcttggacacttacttcccattcgatgtataaaaacccaacagcccagacatagggaggctgctggcatctggcatctctctctctctcttttttttttctttgatctttcaacgagtgaatagtgttaggtgcacattggttcttaaaataagatatataagtgaacaggacatgacctgtgacaaaacaggctgacaaaggtttttatggaattacgaataagcttgtgcaggaggcagagaagggtccctaaatgaacaaggtggccagatgtgatacctattctgattataacagggaagagggaattatacaaaccaaaagacagaaaatacatttcagaaaactgaagcaagtgtgagaagaggaggaagagggggcgactaataatatttgagtttgaataaaatagatcctgatacagagactcaacgtcagattattttcctctctcatgattatagatagatatagggataaatatatttccttaattgggcaagggatcatgttattctatactcactgacaagaaaaaaagaaataaaagtaactcttcaggagattattctgtgagagcaaccacccagctcacatcccactagacaaaagtgtttctctaaatatcatcagctcccaatgagagatgttaccaagggcattaaaaatgagaaaacctatactttttgataagggccactgggcatactagcttcatcaaatttgaacttcgttgtgtagcttttttggagaatgggattcctgaaaacagccatacacagataatttaatgaaccaaattcatgtccttcaagtacctgatttgaaatctagtgttatgcctcttgcatctgataaatccttccctctgtcacaaccaattaatttcaggaaggaactccttccttgcactggatagcagaatgcaatgccggctatcactcaaatgttattttttttatgaatgagatcaataaccacagcagaaagggtaatgctagggcagctggtttggtggggctaaaggaagatctgggacaaatagatcgtacactcttgttttcctttgtccttttctgctgctgatctgacaggtggcagactcggaagatgctgagtcttgcttgcctctgggtcctgctggattggcagagataatgaagcatgttctttaccattgttcatcactagactccttaaacatgttaatggacttctacattcgctgaatatcctgtgcatatctcttgttataggaggacatgaggcatagaggattccaatacaccaaattcatcgaactgatattttaaggcaagcataggcaaaagtttcctaaggacaagatacttcttatttactggaaaatctgaaataaagactgaattccatttaagaggagaattgttggtgtttatgtgtgtggatgctgttatcagtggaggagtttaatatccctccttctggtcgtatttcacagatcacggtagttcaacaaaggagtactaaagaatagaacttatgtagcatcaggacagtgggtgcaacagtaagtctgggaaacaaaggcaaaataaattagacaaattttttttgaaagcaatttgataatgtgcatcagaaatcttcaaatgattatgcagtttcattcagtaattccacttttggaaattgaccttaaagaaataatcatatacaaaaataaaaatgtaatcacagaagttcattatggcattatttcaacaaggaaaattgaaaataacctagatcattttaacagatttttttttttttttttttttttttgagacatggtctcactctgttgcccaagctgcagtgaaagggcataatcacgactcactgcagcctctacctgcctgggctcaggtgatcctcccacctcagacttcagcctcccaagtagttgggaccacaggcacatgcaaccacaccaagctaatttttgtattttgtgtagagatagggttttgccatgttacccaggctggtcttgaactcctgggcttaagtggcccaaagtgctgggattacaggtgtggatcaccacaccctggccaccaatataattttgactggaaagagctagatgtaaatttgtgcatgcagcgtgtgtgtgagtgaatatgtgtatgtggagacagagaatgcaaagaaatgcatcattataattttaccaacaatattctatgagtgcttgattttggcttcttttgttttcctctgtagcctttttacccctaatttacaaatcattaccataagtattttatagttttacacttagataaagtcaacagtttggcagtatttgtccccatttacctgctgttcttgcctaagagtgctttacttccttgtctcatgggtgccatgtttgggcatgtgacacaccttggtcgtgggatgagagcagaagtggcccatctcactgttgagaaggaactctcatagcctctagtgttctgctgtgtctcagttctcctagacctgacaacagcatgcgtcagtgtccgagagaggtgcattgcctttaacctgtatctcagattaaagaagacatggagcacatcaacaggtgacccccactggaagacataagccatcaatgggaatccagcctttttgttgtaagccactgggaattgaggattgtttgttacctagcccaaaaaaagatacctaactaatatggtctatttagatatatttatataatattttccattttaaaaattaagtaataattaattagctgtttatctgaagcaattaattatcattaatatcacagacctgaatatagacaggttcatatgtcccaaaagtaaaaaaaaaaataagcaaacaaaactttgcctagtttttcaattttcctgatcagatacatgaacgaatactgtttatgctctgtcttcactttttgcctttatttctcaattcctgtaaatgtaacttctgctcatgccaatatagtctatgattttgtattcatagttttgatattttgaacagtataggcaagttattttgtggaatattctttgaacgttttaacgtctgatttttccttatgagtggatttgtttagacatgttggtaggcattccaataaaaactgatgccgttttcttctcagtgaatttaattaggaggtacacattgttggtttgtcctgccgccagtgatgttgactttgatccttagttaagatggtgtttaccaggattctccactgtgaagttaccagctttccctttgtaattaatggatgactttcagagcatgtacatatcctgctcctcatcaaacacccattagttcttgtatatactgtagctttgtctaaagttataattgtaagatggttgccatggagacagataattttccagctccatcctttattttacatttatagttgcctttatactgtaaagaaaagctttgccatcttccccatttttttatttattcctaatttttatccaaatggacacgtgttttcatttcattgaattatttataagccattatagtcattatccgctttaatgagcaactatccaaatttggccaatgagagttccttcaatctggctataaatccttctgatgtgccccgtcattcttgagatatttcctatttctgacccagaagaagatattcaaagtgaccgtggacattccttgtcctagacctgaaatcagccatttcccaaggagcccaggttccttttcatggagaagagtatttagaaaccaacatgtgggcttctgatgtcctccttgctttgtgtgccactgtttctaggctcagtggagctaggaagaattaatagatggagagatgaaaatattttgacttctccatatatttatctctaattgtctaaaaccttgtctacatttcaatatctccaattccaatcaaacgccataggattcactatacttttattcgtttttcatatttgtaagcccctcaaccctgggagatctgatccctgttacattcattatactttgttttttacttaaatctatcagaaacagaaggtagtttcggaactgctaactcatagtactggataaagaaacctaataacatgaatacaagagtttggggttcgtccacagctaattttgtttgcagtctgagggtatatagtcaaagcacttcccttaaaagctacttaagttataactgatttttttcagagtagttatgatatttgtttgaaattaagttatgccattttcttttgtttgaattccatttatttcgttttaggatttttcttcttcccaatgcttaatgattttattttatactgtagaatgtgtaaacattaactttgcattctaagtcaaaactatacaaaaatataaccaaagaaggatgctgcctgcactttcaacatttctactccattcctgtttacctttcataggtcagaaatctcataaacatatggcttaattttacagtgtttcttagtaatgatatgttcacaacacaaatatttttacttatcaaattatcttacataaaataccatatttttaattcccttttaaatttaatttttttgacttagcaatatttcctggaaatcattccataacaggtgtatgtatcagagtttactcacccaatctcttacatatcgtcatttatttctaatatttgtaatggcagataatgatgcaattaataatcttgtgcatatgtattttgatattgttggtgatttgtcttgagaatgcattcctaaaagtgacagtactgggacaaatgctttttgttgttgtttgtttgtttagttttgtgaggtctttcttaattctccttcataatagttatgccaatttgtgcacctaccttaagacttatttgacagtacctgttttcgcaaagccatgctctggaatgcatccttggtgttaagcttaactctctgttcagtttttcccctagaatttctgttatttgaattggaagtttggaagaagtgatacaatgcgtgagctcagtccactaaagtaatcagaaatgttcatactaaacagagcgcttggcatgttacagctttgactgcattatgatcacgtccacattgcactcagtagatctgaacctcatccaggaagaagattagggactgcttgggttttcatccactgtctagcatagagttctatattggtgttgcacaaatatatttatttaactagcttatttgttttaaagagacgggtaataagcaatgggaccctgaggcaaaaataagaagaaaatagacagaggccatgtttttaaattttttgcttttgtttattttttctccttcacaaccatagccgcactccttctagattgtaccatgcctttctttgtttttataatcttgaaaagcaaatcaaaaccgaaacctaaacaaggggtcacaaagtgaagggcactgcaagagcccatgagaaattacccggctacttgatgagatatttggatgggaaaatgactccttgatgagtctgaaatacagtatgtctcttttcctgggctctccatttcctgctgccatttcttacatcaagcccccaagacaggagagtttctcagggaatttaaactgacagctccgtgctgattagaagccataggacagggcatctccggaatgagatcaatgtcagagtgcttttgcccacagcagccacagggggagaacatataaaatcaaccagttctttgacacattgtttattagaagaaaatataagagttaggagtgtgaggaagaaaaaggaaagggtttcacatgatgtcctagaaaaacttccagcaacgacaatgggagacagacttttccccactctgaacagtgtgaataaaggcctagatatccacataaaagagcaccacaacttgaatctccagatattcagaagtacccggcatacagttagtcttttgagattgttttctgtttctttccttcacagcagattctacctaattggagtcttcaggacgaagcttagaatatcatcctatttctacaggtgtgccccaagaatgggcttttacacttggttagccaagtcacaggaaaggtgatttaatattttctagctctgggaaagggactgggcagaacagaacacacctaaattaaaagaaaatgcttgcctattttggactcatttcttcttcgttattgccagcctgctctgcccaaaatgaaagtcctcatccagggtgagaaggaatatgctggttgagggagaggtttttgttttttgattggtttctatttccctaaacttggcagagttctctgaaagacttaaagttccccaaaatttgtgagtaaagaaatataaattaatgcaaaataatttaatggtatggtcacctttttgtgtgatatggatagtgatatggaaaactttatttagaaactttattcttatgaggaagaaaaaaatgtaactaacacctcaaatacagctcagtgataacaacattgaaacattcaagattctagactcagatttaatgtcacctcttccaataagccttccaatgacatctgaaagaattgagtacttgctcctattattctagaaatcttttttataatatgaccattttatataagtcttaaaaatgtaaagcaacagtatatccttttaagatatatgggtatagtaaatacatacaaatatgcatgtgaatgaaaaacctcagggaggcacattggatgaggaaatgtgttttgccagaaatgttctctaatgactcacgttgcactggaaatatgtatctatttattgtccttctcttctgtgacagcagaaggacagggagattattttcttcctctctggatgctcaggaatgagcaacagactttgcctatagatgtttaaatatgcatattgcacaaatgaataagtggatgagtgaacacgttaagtcccatgtgggctgatcttgagtataatccatcacccttatctgtgataccacacgccaacctgatttccatctatcctgatgtctgcctgtccagttaggtaattttgtttctttggttgagaatgttgatacctgttgaagcaaagtaatgagtgtgtggatgtggatgtgtgtgtgtgtgagagagagagagagagagagagagaaaagcatttggggttgtgaatgttttccgtattgaatactatattggtgctttcttttgaacctgtttcagtagaaatagagtctgagggctgggtgtggtggctcatgcctgtagttccagcactttgggaggctgaggcaggtggatcaccagaggtcaggagttcgagagcagcctggccaacatagtgaaacccccatctgtactaaaaatacaaaaaatcagctgggcatggtggcaggcacctgtaatcccagctactcagctactcgggaggctgaagtgggaaaatcgcttgaacctgggaggcggaagatgcaatgagctgagatcaccccattgcactccagcctgggcaacaagagcaaaactccgccaaaaaagaaaagaaaagaaaagaaaataaatgaaacagagagtctgagtagagtctgagggcacttatgtttaagacagggaaggagaatgctgctgtcaagagaccacagctttggcatagcatggcagctggatgttgtagggggctggccagggggcacctggagggcaggaggattgaggccatgaagtagaaggtcacaacctgataatctcatgcaccaccaatgaacacattttaagatattatctttgttgaagtacaattaagcacactgtatttgtgcacatactcaaagtgtacaattgtgtaagtttgacttacatatatgcctgtgaaatcatcacctcaataaaggtagtgagcatggtgatcatagccatcctcttaaagagtgtctttgtttctgcaatttcttattcttattcccatccctcccgttgtcctagggagccattgatctctgtcccagggagttctctctcagtgtagaaaattttgcattttccattttaaatagatggaatgtacctttgttttctctttgggagtctggtttctttcactctgaatatttctttaaaattaattgtattattattagtaataatggcgatgatcagtctcttaaccaggttatttatatacatactcatttaattaatttcatttataatgttcagccaaactgaattattaaaaggatacttaaaaagatccttgtggaaactgatttgtttctgacaaggacaatcactctatttatagaggctaattcttttactcacataaaagaaacatggcattgttcttatacaagtaaaaaaaaaaagaggatgtaatacaatgattatctgtaattaattccatatgggaaagaagagcacagtttcctctcatatacaagacatttttatttttcagaaattaaaaaatatgcatcctagccttaaagttctgtataaaatgtcagttctaaaagttttttttttgtgaagctctttattaactggttttatactttgaaaattctctcaacgatctctaagtctggcttaaaactaggactggcttcatttccaacaaaaacaatagtattaggggaaagaaactaggctttcccgtaaaatttcttaattgaaaggaagacaggagtttcaggagcagacagagtttttagaaagcgatattttgaatacaaggaagaaatatccatttcacagacatttaggaggagccagcatgacattaatataacccttatttcagtgaaagataacttagttcaacaagttttattttttaattattttactttcagtattgtggtcgaaaagaaagtgttatgtgtcaatggaagtatcaaagcaatataatcctctcctaccaaaaaaggcttctggtattccaaccagcactccatcagtcaacaatatttgtttcttatgtgcttcattagcaagatgctgtgctagatgctgtgggcaatagagcatactttaaggcaccatccctcctctcaaggggatgaataaagcaaacttttgatagataactaagaatacttggtggtatacaataagttttcaagagcacagaggagtgaaattcctctgataacagagaagtggtcagaagagagactcattggtggctgaattgtcctgagaacctcaggttggaggactggaagatcagtcttgaagtgagcagggttagatgggtgatggagggggttccaggagagagttcctggctggaggaataggggaactgagatgaacagaaaaagataatctcaaagaacagtagtctcttgagggaatgaggaagatgagcaaagaagcagaaacgtgtcaaggtgtgtgaggtttggagaacccagaaggaagcctggcttttgtcccaggtctctgaacagatatgcctttgcattcttcagataactctgtaatgtccttatattcttatcctccctaaacgccttgcaaaacttctatgctaatattcatgactaaagaggaaacattgataggagttgcagaaactgactgcacctagcccactgttagggggatgggaaatgattagcctctggcagttatctagaaagtccagaaatactgactttttttgttgatgttctagatgccagtgttctggggtaggtggagcaggtgttgctgtccacatacctgagcctcagaacttcttccgggattatgtgactcataaatccagcaacaagaactgacttttcctggctgtcatttcagggttcttttcagaaaaccaagcagctactggatactgaccttattctaaaggccaacagaagtggaataaggtgcaatttggaattcaatcaatattgaaggatgacggtgacctttgggaaataggattcagcgatgtctttttaaattctgttatttgtacataacgcactcttacagattttttaaaaaatccaattccacatgaaaaacttttacactgaatttattacatttttaaaaatacataaactcagactttattt

SEQ ID NO: 220 - DNA, 7886 bp, Homo sapiens
cctttaaaacatacctctgacagctccttctctgggcaagtcgcatgagcctctcctctcaaggtatataggtacactctacactgccactcagcacatacctatcataacatatgtgtggttttggaattacttaatttagattctcattttccatattatcctgccagattcttgagggtagtaattgtctcattagtctaccagatcaatgtttggctttaaaaaggtgctttgtaaatattaacatggcttcatcttaaggaaactatattggtctctccaagtatgtgcccatgtgtgaagcccagtgtcctctggtcaacatttccccaattacattctctaagattatggactcttatggtgctcttcccttccagggcccatcaaggcaaattggcatattctcctgatgttttgcccactgtatcccacaggtcattaggtgaatttgtgttattttttcacttgtctaaaagtgcttattaagtatagtccagagttatatggagattttttaccattcaagaatggatactggtgggtatactgagagcccaaaggaaaatagtaatataagatctttgctgtaagctgaagtcaaaatttcattggcgatgttgatgctcctgtgtctgctaatatctttgtcaaataccatatgatgtaaattgtttgatcatggtgagagggtttaggggaaggggtagaaacatgctgaaatagaagaatattacaaaatgttgcagttggagaacaatttctaaattaacttgatctatattttctttttagttaggcctgatgcaaacacatttttcacgactccactggaaatcatgttgctaattaaaactcctgtgctattggaaacccagaattgtccttttcactgtatactacacaaaaccccaggtgcaatagcaatgcaaatattgttctgggagagataatagtttgttgaatgaatgagtgatctagtaaattactgagctgctaaaaacagtaattaactgtggatacacatgataaattttatttctacctctcccattatatgcctacatttaggatggcatttgtgctgcagagcagatactcaatgaatgtttttatttagggaataaaatcatttgccattgtatatgtgcactttttaagtcctctaccattagaagaaaatctccatgaagccagaaatctattttgtagtttctattttctgggaagaatttactgaagcacagacccacagtgggaggccagttattcattgactgagtggatacttggatttaaaagaaaagcatcaacgctggactatggcacaggatgataacaaattcatcaatgtaacaattttgctgatttctaatggctacccgcctatcacagttccaatcagattgatggtgtaatgagctaaatttgcaccaaaataacagtttgattattgagtggttttgtaagctaagttgacaggaatgtagtcattaaatccattgtttatcacttgctttttatttatttaattggaataggtttcttttgaagccattcgacagatgtttgattacgataagatttattttggcttgaaatgctcaattaaagggtcactgattatatcagtcagggttcaactaggggagcagaaaagtcagacaggtagtcaggaagggagggtcacaggcaagctcaaagccacaagcacaagttgaagctgtcatccacacagtcaggaagagaagctcagtagcaggactggaaccccatggggatggagcaggctgctatccacaggtggaatctcttccccctcccagggaagccacagtcttgccttggcacctttcagcagattcagtccgagccatgcagttatccaggataatcaccatgacttaaaggcagctaattggggctttcattacatccgcataatccattcaaagcagcacttacattattgtttgactgaataacaggatatgtagcagagtcaaacttacacgttaaaaaagccgtcacatctttctccaccaggcctaagattccactcctctacacagagacagaaggtcagggaacaataggagaaggattttgccacacacacacacacacacacacacacacacacacacacacacacaaaatccatttcatgaagtgttctctattccacacaggcagggaagatcctaccaaaataagcaagcccctagctcactaaatattatttgtcccctgcagactggagactccccttccttgcctagcagcagcaggcacctcaaatatggaaatgactcctgccctccaggaaggaggcctcagctgccagcaaggaccagtgggagccccagttgtttgagattgtcaagttttttctaaaatttatgtgaaaagatgtgggccctaaaatagctaaaatcataaaagattaaagtgggaggaatcactcattcagtatcaatgcctactctacagctgcagtgattatttagccacaccagttttggtaccttctgtctgttatgctcccaagctgaccaaagagataattaaaaatagtatataaatcacttctgtcttagaagttgactaatgttgtattttttaatacaaatataatattaaatgatttccaagttttgttaaatgtaatttactaattgtttctgcagtggtgtcacctttcaaggacaatatagtattctttcctttataacgttgtaatgagacttttaaaaatatgaaaaatatttgttggtgttttaggtgtggctctgtgcttcatgatttacatgcaccgtcattaagtcctactacagcttattggcaagtattatttattccattttacagatgaaactggagctcaaggtagaagttagatgagtcagaatttgaattaagacattttgagtaaaaacccaagttctgtcattgtgcagactccacgcccccttcaccaaaaaagaaaaaaagtcattaattacacatttacatatttttcctttaaaaaatgttactttgggaaaatgcatttgttcatatatttgaaacattttcaaatatcgagccccacttttaacaggattttagagccagtatgccagcagcaggaatacaaacacaaacaaacgaaaacagttattactttatagtcacatttcatttttataaaatatgtttcatcaactttgtaactggtctttttctctagtctttctaaatgtcatctatttctcatatcaaactctttcataatatttatctgtttaagcaggcatgctactgattctgaatgcagttgtaaacaggaattccaaaattaattttagttatagaggcattttgaaataagtggataactcttgtgtttttttttcaatttatactgaaaatattacagtatttaatatatttaggaaagtagaaaaacaaaacaatttatgtatcatcacatcccctcagtcctagagtcaagaaaattggctttttatctcagttctgctatttagttgtaagaagttcagtggctttgaggaaagaacccagagattcttttctaatccccactttcctaattctagacattcatgcaataattataatgccagccttatgggttattgtggaataaatgagaatgtatgtggcatgctttcattgattgggcaccgtatcctaggatagcctatatttcacacacatattctgcatggctgcattcataatatgcactgttttatgatgggagctacccattttcaaacatttgttatgaagttttgtataaaaagtcacatgcatggatagatgtgaaagaattttcattttgtttagtctcaccaggaatttaagagtaattcccaaattgcttctgggccttgactttctgtcatctattcaaatgtcaaaaccttttcctggaagaatgtgctacacctgctgcaggtatgaccaccacgtttttggatttatgtgccacctattggcttctgaagtttgctcatactgaataaattctgatctaagttctctgcattcctggaaaatggttcataattcaatgaaactgttataggtaaagatgaaacagagaatttaagtgacatgtagtagatcttgtgtttggttaaattcagaactagaattttatgttcatagaacatttgtttttagtgtcctcccattttctcccatccccccataaatggacagtgtttagattgctgtcatttcatgagatgaagtgagggtgctgctgtttttctgagtcagacctctgacctttcagggtgacgctaaacacgttctcatttcacatttacagcaattacattagagattctttactcttgaattgctctttcaaagaggacttaattcattgtgtattttataatgaatttaatcagttacttgaatagccaatattcattagaaataaattattaaattaaaacactattatttgtatattatgtcatgatgtaccaccttcactcctgtttgaccttgacaaggtaaataaacccacaaggtatatattatcgtttctaatgtgttatgtaaatgagtgagcataggctcagaaaatttcagtgcttagcccagagaaagaaggtgacaacgctgaattttaatttctgtggcacaattttatgttccctttaatgtaccgtaatatcatgtaacctccaattaagcaacgtgaatgagaaactaaagtcttttaatctattgtttgatatatcttatcacgggcttttatattttctctctttttgtgtcacacagctccagttatgcccttgataaaatcagtcagaattatttgctatacaagagtcattcattgatttgtccatcctttctataagcatttcctgaacatctattatgagcaagataccacattggatgctagataaaaagaacagagaaataaagtctattcttaaaggcagcacagtcaagggaggtatggacaagtgaataaagtgtgacagtcactgtgatgagggctatgctaaaggtaagcacaggtgcttgtgagaatgcataagagagaaaaggagaaaagtcttaatatcaatgtcaactttttttaagactgcttaactcacaaactaaattaagcaaacaaaacaaagtgagcctcacaaaagtataatctaatttggcataaattacatttaagagtaaatcattgaatagaaacctgagttactctaagttttctgaaaatgaagatcacagattgcatgatagggcttattctgtaacttgaaagaagaaagactttgtattgtgaatgtatagctcaacaatgggctgttggtgccaagcaagatagcataggaaagtgcaaatgcacaggagtatttatgccaaatcccattgctgatatatgccttttaaaatgaatccttcaggaaaattccatattggctctaaggaaaacttcccttaaactttgtctttggtgcactttccatacgcaactatattcttttgacaagaagatgaatgttaattttttttatcacaacagtttttcttatgcttcatctcctgcttggaaacctttctctatatttatctaaatgtccccaacccataaaggcttagttttaacaatcaactaatattgggcaattaggtaatgtgccaagtacttcagtagatgcttgaattagaaaggcaagtaagacaggtttgtcctgttcctcatagaacatttttttgtgtggtggatttaaacatggcacttatttcacagatatctgattacaactttggtaagtgctgcggagaaggtgagggtataatgagagggtgctaatatgctgctgaatcacagaaaggagatggtggtgcttgtggctgactctaggttataccaaataagtagacgcaaagttgtacatgatcttcttgactttaagggtacttattgaaatttaagttattattttaaacacatttatattttatagacatatacttgtttatggaggtaaatacaaattgaaaggttgatgtcacaagaccagacaagagaatatttctgtaaggcaagagaaaaaatcttattctaggctagcatgttacagaggagatggaaataaattgatagaattaaaacatattaaacaaaaaagcagtaaatattcattgatggaatataagaataaacaagagatgagtgaaaagcatctaatctacttgttggcttgtgtgactatggtggatagaacacagatagctagagaaaataaggttagagatgaagatcatgagttgacttttcagcattgagactttgattacctatacgaaaagtctagatagatgtattgagtagaattttgaagtatggaactaagaaagcaagtctgaattagggatccaaatgtgggaactgtaagacagaaatttgagccatcaggatggaaaatgtacatatatgtacatttgtacgtatatgtaccatttgtacatatatggcaggaagggaagaatatctttaaacagaaaaccttgagaagtgcttatacatttatcaatccagtagaggagattaaattggcaaatacaataaattaggtatgccttagcccaaccaactccactcaatccagataatttaaactgaacatgagataactctgctaacacctgcccttgaccttgcccaaacaatgtacttagtaagtaaagaactttttttcttcatgtgcaaggctaattccaagaactgcctctctcacgccatcctggaattatccatcatctcagcaaattaaaatatttgaatacaaatgaagttcatatgagaaaatatattatttacaataatggaagccacgtttcttctgcttgagaagttctcaaaaagtacaaaacaagaaggtgaaataccaggggagtgagcaacaagtggctcgggctcagacccctggcagttacttggccagaatccctgcccctgttttcccctgccccgtatccagggtaggaaggaaataaagctctctccatcagagaagggaattacaaacatataaacaggtagggtgaaaaaaaaatgaattctgtgacattggagtgaagttgaacatatcaatattagctcagacttaggatagaagatagatgatagatgagtagatggatagatagagagagacacagagagagagagagagagagagagagaagaaagatagatggtagattttctaattctgtcagtttagagggcctagaagcaatgaaatccctgtatcaatgaacacatgcagcacccagattttagttttctaatattctccactaaagggaacaactgatctttttgagaaatagcaaattccagactgtgtatgggaagtgtatatgagtctcaaatgtcttcttgttccagaaggtagaagattgcttaaaaaatgatgggaacttattagaaggacaaaagaacctatttaaatgacttttactggtctagtatgggagaaactcatcataaaataagtaatggtagtaatgaatcataatctattgaataaaataattcattagtctaatactgacatatatatacatttatatatacgtacataaatacataagataataaaattcttccttataggagaaaggcaattagtaaatgtagaagaagaaatggaatttgaaaatcactatttggccaccatcatggtaataattgcttgagtcaagaatcatcagtggatcattctaatgggtggaagtttaaccactaacaggatatttcatggtctcaaagcctcttcccacaagatgtttataataaaaaataaaaagcagaaacttcagagcaa

SEQ ID NO: 221 - DNA, 35482 bp, Homo sapiens
cttcggtatcatttgaggggaccacgctcttcactcccctgcactccgtatcaataattcctgcttctggccaggcgcggtggctcacgcctgtaatcccagcactttgggaggctgaggtgggcggatcacaaggtcaggagatcaagaccttagtggctaacacggtgaaaccgcgtctctactaaaaatacaaaaaattagccgggcgtggtggcgggcgcgtgtagtcccggctactcaggaggctgaggcaggagaatggcgggaacccgggaggcggagcttgcagtgagccgagatcgcgccactgcactccggcctgggcgacagagccagactctgtctcaaaaaataataacaacaataataataataattcctgcttctctgattaaatgcagcttggcctagctgtctcctgatattctgtggggttttttgttttgggttttcttggttgctatgctagttattgccctctaagcagagcttctcattttccacaagttttggttatagcatttttattttcaggtagtgcaagacagtttctaatttacctttgattcatgagctttttagaagtttactttttaatttttaaatatatatgtgtgtatttttatttccattttattttaattatgtatttttaacttaattacattgtagtcagaaaatgtggttcttataatgcaaatcttcaaaatgtattgagagttaaagcacgtggaaaattttgaaaaataatatgtttataaaaatacattttcaagttattgtgtaaaacattttatatatgtttgataaaggttattttcctactcaaaaccttaaacttccttctttttttattttttctttttctttccttttttttttcttttagtcaccctgaggaataacttactgaaggatatttgtttaaaactcattatgtaaaattttcaattatttttgtagcctaacgtataattaatattgtatatatcccaagccttgcttttagatatatcaaggtctgaattgttatatcttccttttacattgaatgtatataattatagactcatttactttaactatatatttttaaaatatctatcttatctagctacacggcttttcttctgattgatattttcctggtatgctttcttatcctttaactctttacataattgtaattgttttgtcttgagaacaatagataccttttcttgcttttatttttgcacatcctgaaatgtagttgtattttaactgaaaatttggtttatcctttttttattattattagtatatttgtatctatctctaacattaagtgcttcctgtcaacctggttttaaagttttctttacctttgattttcatttttggattgttacagccttctttatctttattctcattatattttatttcctctgcttttttggaagttacatgttctttatttattcttatagtggatagcctaattttttaaaagatatataatatagtataaattaatcaaaatctttattttcttttcaatagaaccttaaaatattttaattttcattacttcttttatttcaaattacattattttccatttttttattttttaatgtttattctgtcaccacccctaccacatacatacacattaggaattaccgtttttaatacatcaatgaatgcttagattatattctatataaaaatatatttaactatatataatacattaatgcctaatataatatattaatgtctatacccataatgtctttcaaattctattttaaatcttttgagattctatttctgccaaatatatgtctttttaatttttcttataaaaatctgttgatggtaaagttttttcttccccaaaagtattgttttcatttttattctaaaaaaccatgcagaacctggaattctgggatagaacttatttaattccagcacatttgagataatatttccttcttctctggcattaatagtcgtttctaagaaatcagatcactctaaataatgttatcttctggtcgacgatgtggctatgagtagaaagctatgatactatgatgtggctaggagtagattttttaaattttcttttttctgtttggaatttattgggctacctgaagttgagtttagtggaataaataaaatgagatatagggcacagtagaactttacaaaatgaaagagattcattatacacagagcaacataaatgaaaattgaaaaaaaaaggtaagataaaaaaaccctaaaatatataatgtaatagcatttaaatgctttaagaatttaccacccaaaacaatataaaatcatgaatagttatgagtaaagatgtacaaaaccaacacttaagaatagtcacttctgatgttggtagaaaggggaataggagtatggaataaagataaagggcagacacagcaaataaagcaaacaaaaaataaacaaattaatagaggggcgttgtattgaccaatatgataacatacacttagctgagaagtattacttacttaaacctttatatctgaggtccaaagtatatatttgtataggtatatatatatatccctttgtacatttcttaaccaaaatctttaatttcaatgtacttgagtttattactttatgatttacactttgtgtttttcaagttctctaaaaagtccttccgaaattttcattcaaaatgatattctcctgtattttcttctattaaacatacacacatgcgtgcgcacacacacatacacacacacacacaccccactatacaaatgcaaacttgtatatattttttataattaagtctctaatccacctggtgtacaactttgtatgaggtattaagtgagatcttattctggttttcctctgccaccaacagtaggaatttcctggtcaagtctcttttatttaaggatctactgtgcctttttatttctccccatgatgtccttccaggtatgggctctagttgaaaactgttttacagcagcttacaacacacagaaagatgtttccttcagcctgaattatttctatgatagccataattgaaatgcaataatacagaaaataatcatacaccagccttgagcaacttctcagtcagggcacaagattttggcataatcaagtctatgatatttcactagtgtccagataaaaattgcaataaaaataataggcataatgtcatatagacataatgacaaaccagcaagttttccactgcagcaggaatatccacctctgttccattatcatttttatatcttcaaggaatctgttccctccataaacccagatgattcctattagttccagtatagttgcaatcaaaatgtcccgttcagtacagaagtggccagtcagatgagccactaaattccagcctgaaccacacgggtgacttctctctctttctccctgtttctctctctcttttgctccttcctctcctcctccctcctctagtaggtggactccagacatactatccctttgtctatcaagactactgtgcctgtcttcacatatctaacactcatacatggtctcagctttaagatttacttcgtctggtctgtggcaattctaagtgctcattaagctccttgtgcttgccccatgagagcattcatcagtaatatgtaactattccagggtacatggggaccattgctttacatttgcctggcagcatttctctttccacttctaatattagacccctcctttctgatcctaggcatggcccatgtccctgggaacagtagagactgaggcctgggtctcagtggcatcaattagagcctttccctgggactgatgtacgagtgtctctttctgttggcatctttaaatgagaagataaaaatccaggttatcattagccacattcactggtcaagaaaaaggcctctgcagaacacagctgagcagaaccacacagaagtggaagaagcaaagaggtttccagaagactgtgagtacttgattccaatctctgagcttctatttcaggcagttcttcctttgatccttcccaagttctataaatagaaatttccacttttgcttgtgttaatgaattgctctttatcatgcgtaatagagttctgacgaatatacctgattattcatctgtgtgtctttcagcgttgctcgacaggatagcagcatcagccttgcctgagaatttactagacatccaattcccaggcccatccacagacccactcagctcagggtagacacacatacacacacacccctctatacaaatgcaaactcagggtaggacctgagattctgcatttgaacttgtctttcaggagttcttatgcatgctaatgtttgcgaagaactcaactagtttataaaataagagagatccaaccacaacaatcagcctgtccaactagtttgccaattccatagagacgttccatctcttattcagtcttatattcaccacctagaaagtgcctagcacacaaattggtattggagcatattgaacaagaaacacaaaggcagagaaagcaaggtaggatggcaaaactcctgcattcagcatagaatcaggttaagcaaggtgtttggggacatggatctggggatgaaaggcctagagctgagactttgggattggagactgggaaatgacacagaataagaacaggaactctgggcaagttcacaggctttgagactcacgagtatggaatccagcccgtcatctttctccttggaagtgtgttattaacacatttttcctcattaaaaggtagacaaacaagagaaacctctttctatagccacaatttctccattggctctcaacgcctgccctgggaccatcttcactgctaccctggttggactcatccctgcacccaccacatacacacggtagcaaaagcaccgcatatcaaattccctttgccagataaatggggtctctagtctgtacacggacctaaaagtttgggccagaggttggcgcatgaggaatggtgggtgtcttttttctgggagccacggtgcctggtgtagcaggacctgtcctggagtcccatccaaacaaggagggaggcaggttactagcacgcatcacagaacccaaggtagagcagaaagggacttcttgatataaaacatgctagcatattatcaagtctagttatttgtttactttatattatccctctgtggaatgttagcataacaaaggcagagatattatttatattattcattctatatccttaaaagagtgtatgaacagagaaaatgcccaagaatattgaataaataaaggaataaaacagacatggcagagaggaagacactttaggcagaaaatgagaggcaattaagccacatttgaacaaataaaggctttttgtttgttttttaagatggagcctcactctgttgcacaggcttgagtgtagtgttgcaatctcggctcactgcaacctccgtctcccgggttcaagcgattctcttgcctcagcctccccaagtagctggaattacagacgtgtgccaccacacccagcaaatttttttttttttacttttagtagagacggtgtttcaccatgttggccaggctggtctcgaactcctgacctcaaatgatctgcctgcctcagcttcccaaagtgccaggattacaagcatgagccaccatgcccagtcaataatggcttttttaaggaaggctcggacgagccatggggagggatgggctaaagagccaaaccagcaagcatgcacatgttcagcgtaaactgtccgtgagcccagtatactgggcaagctgagaaataattatgtcctccttccttgatcttgcccaccaatttctacctctcatcctactgtggtatccactcccagtacctgtggactcctatcgcatcatcacatctattgcctggcttcacagatccttcagtccaggccatgtagaccctcacactcaggtttgccttcctttggcacagtctcacacccctaactcttctacttatcaccactataaaaaatatatgacctctcacaatgctctatcctcagagctcagagaggtgcttcgtagacaaggacactgcggaagccaaagggcacagtacagtttaagatgcattcccagctcataaaaaattagcaactaattgataatttatctaaggtcatttgcttccagggttattttgaaaaattatacttaagagaacagtaatttaacccaaaatgaatgcctcagcagtggaatcttaaaccagtcacaggctgttgagacatttttggagtagagctgggtgatggggtgaggcaggtggtgccctgcaaatcacatctgaaaaatgtcagttcttggccacacccccagaagtgtgatttcccttttgctgcagtcatggttagaactttagcatcaacatagtcccaggaaaacatggacatacggtcttcgggtgttttctcctctaggcgaaacactgatccacataatgtttatgtgaatattagcacttaccttttcattcgggataattcagggatatgtagaaaaagagacacaaaatagacaccactctaagcattattctggagctgaagcatgacattctgcttttctctctcttatattttttttttttctgagactgggtctggctctgtcgcccaggctggaatgcagtctccgctcactgcaagctccgcctcccgggttcacgctattctcctgcttcagcctcctgagtagctgggattacacgcacctgccaccacgcccggctaattttttatatttttagtagagatggggtttcaccatgttagccagatggtctcaatctcctgacctcgtgatccacccgcctcagcctcccaaagtgctgggattacaggcgtaagccaccatgcccggccgacattcaggttttcaatagctccccatcttaataatttctatgaggcacatgccatcacttccagaacttggtttcatcatgcaccattgttgacgtttctatctggttaaatgtgcaacactgtgtttcctctctctggaagttacctttcttccatgtcttcctccagacttagatttttccatctctgatagttgcttgatggaatgagtgtaaatttcataggtaaagaaatagacatgaggttatattccgagctcctaggacagttcctggaaggaagaaggtactcaatatttactggttgaataaatatgatgcatgtctcttttgaatataatttttcttcacttctcatgcccagtctttcaatatattttcagctgagcctattttctcacaattcttgtaagagtaaatcactggtaccaaaaggaggataaacatcacagttcccattgctcactactcaccctttcatccttctcctgacactccctccttaggggaaaagagtcactgctgtaaaagtgagctattctctgtgcattttttaaaacctcgtcatttcccccagcaaaatgtcaagagctatttggctgggaacccataacttggtaggtaataaaataagcatagatttgaaaatcatgtcttaggactaaaggactccaaggaattttaaataaatgatttatctaaatgagtgattgtattaattgctatatctagaatttagcttatctgttaatacaccctggtgaattcagtaatatggctcttccccaaggtgcctgtggccatcaggatgtcattcagacaggacgaaatatccacccccaaggctaaatgagaaacattatctcagcaaagctgcattctagcctggaaacatatgggcagagaagaaattaacaatgggagctggaggggcaataagcatatgacattatcactaagaaaatccatttagatatttaagttacacactctagtgtcaggctgtttaaatggacctattgatctttcagtttcagtaaaattgctctcattttgattatactgtttaaccttgaagaattgtaggaaacatcttagttccagaactttcctttctccctacatattacattttaatcgtttcttactttccagctctctctcttattctctttcctccttccttccttccccacaaccctaaagcttatgatattatttaaggcgtcctgagtatctactacattatatgaatacaaaaataaagattacacaatattcaccacaatctagtgctgtaattttagccaattcttcaattttctcactaaaaaatattttatgatacatatgatatgattattatgaagagtaaatgagctaatatgtataaaagttataagaagaattagagcaaataatacgctgtatgtaaatgttagttgttatttaagtgcagtgacagaaagaagggatatgaggcacataccacttgtaggatggagaagtgacatgctagaagaccatttctaagtgacattatttgaaatgggaacttaagaatttgtgtaccagcgtactcatttattaaatatactgagttattttaataggccaaggcctgtgctaagcacatgtgatgagataacgtgtgtgtgtgtatgtatgtgtgtgtgtgtttgtatgtgtgtgtgttgttgttgttgtcatattccttggttctaggaggggctcagctgtgtagatctcacctgggacttttcatatgtttacaatcactggagccacagtcttcaggcttatccactcatccgtgtggtacctgagccaaaacagctgaggtgtcaggggctgctcaggcatctctctctccatgaaacctctctgcatagctagtttgagcttcctcatatcctggagatccttgggtgggtgtactacttatacaatgaatgtcttcttccagagcaagcatttccaggaaaacagacagaagttgccaattctcttaaaggttaggcccagaacttgtagggatcccttccactgaagtcattgtttgaagcaattgctagtcaaaccagcttcaggggatgtgcttttgtaatcaccccgtgggttcttcctgccccctgcacaaagtccattcactgagaccatggcattgcagtagagaaagtttaattgatgagagtctggcccatgcaagagaaatggagttaacactcaaatcattctctcaggcttggagcttagagtttttgtagacgatgtggtgggcagggagctatgaaatgggtgctactgattggttgaggatgaaatcataggggtgtagaaaactagcctggtgtattgactccacctctgggtgggagcacaggacaagctgagtcatgagtcatgagtctgggtgaagttagtctgaaataatctaaaaaaaaaaaaaaatcttagttttcacaatagtgatgttatctatagggccaattaggaaagtcacaagtcttgtgacctccagccacatgactccttagcagtaagggattacagaaactgactacatttcaacagagttcaggcccctctcataatcctaatcttgtggcctttagtcttacaaaggtggttttcagtccctgagcaaggtgggggttagttttagggaaggactattatcatccttgctttcaagttaaactgtaaactaaatttctctcgtggttagcttggtctttacccaggaatgaccaagaacagcttcgaggtcagaagcaagatgaagtcaactatgccagatttcccttactattataattttgaaaaagcagttttactttcagggaagtacagaattgatggtggccattttacaggtaagtcttcaaagtaatggcttactatcctcattctacagaaaaagaggttgaagttaaagagaaacccgtccaaaatcaagccataaagtagcagaattgagatacaagcctaagtttgaccccaaaactttatgcataaccactgtgatattcctttcctgggatatgatgaaggaatgagaaaagtcctgggttgagatctgatcccagcaccactcctattttgctgtgtgatgttgggtaagtctcatcccacctctgggccttactcttctcttccgtattgtgaggaggttagactcagtgatgctgcaggcagtctcagctctaaaattctgcaggtctgacaatctttgctttgcccctttggctatggattgaaagactgtctccttcatttatggagaagcctcaccatgtcaacttcacgcccatgtgggttatgagcctctctgattccccttcaaggaggacttgctgctgagactttcagggatgctgccagacacttcagggtctgcctcagctgcagagagctgcttagaccaaggttctgcacttctagggtggcccacattcaagggccagtcaaggcatgagtgtaaagacctggccatttcaacttaacagaggaatagctattttaactttagaactctcctggtaggtaactggggttgtcattaggcctcacatctcagctttggtctctaacaaatcctgcttcctccttctccccaagggcactccctaataaatatcctttaaggaaacttcatctctgagcctgcgtcccaaaaaaacacaactaagatcaactcagctgatcactaagatccacctcctaacataggttccaacaagctggattttctaagaataattgatgggaagatgggaaaatacatattttccagtgtccccaattttatgtgtgaaaaaaactcagtcttagagatgagaaagggctttctcctataatagaggaagaaatgacagagccagcgttcaaattgtgttcacctaacggcaagacccgtgctcatcccagtattcacagagaaaatctgaaattttccaaggtagttttgatgtaatataattgggtttctgcaggaactaagtaaaatgtcatgtttacacatttttaagcatttagatttaaatgcttcttcaaatcagagaaagttctttcatactccaggtgtctgaaagttttccacagaaaatgtaataaacataattcacatgtgggacccactgtttatattttccaaccaattctatatttatttgcactgtttttccctatttatgatttcttatatatataagaaatcaatacatatgttaatcaactattatctgatattccttactggaggaaaatggtttaggtcagtgcttctcaaacatgacaacactgtttaatctcctaggaagcttttcaaaaacacaaattccagaactctcttctcccaagccaagtaaatcagaatcgctggggaagacacataggcattttatgttttgaaatctccccagaaaattctgaagttaggattagaaataatgggttttgttgttgctgcctaatacacattatattagcttcttttaaagctgcataatagcttatattaagactataacattgatctgtccacattcactcctttaaaaatttttttttgcctgaaacaaacatttcctgagtacctaccatgtgccaagcctttagctaaggcttggggattcagtaatgaaaaatacagcctttcattttgaggagtagagtttatagtgggagtgagccaggttagagacatgtaaaaaagcaatttgacttcagtaaatgataagtttgtgcaacaaattaagaaggcccaagaatggtagattttctaactcataatactggcttagagagagcattcatacacaggttgtacttgaaattacctaatagaaagcgtaggaattatctatggagactgaatgactgaatgggtgaggtgttttttgttttttgttttgtttgtttgtttttgtttttgtttgagatggagtctcactctgtttcccaggctggagtgcaatggcacgatctcgactcactgcaacctccgcctcctggtttcaagcaattctcctgcctcagcctcctgagtagctgggattacaggtgtgcaccatcacacccagataatttttatatttttaatagagatggggtttcaccatgttggccaggctggtcttgaactcctgacctcttgatccgcccgcctcagcttctcaaagtgctgggattacaggcgtgagccaccatgcctggccaagtgaggtgttttaggcaaagggaacagattcagaggacaaaacactgtggtttttgaggcaagtagggccaattcaagtaattgaaagactgccaaattctgagatcatatcttgcaaatcaaaagcaaagtattagtttatcattcatggcaatttatatctacagttcctacaaaattgtagaaataagatatctgctgctctatgtgaattcaaatatttattaaaatgtttacatggggggtagtaaaaaacagttttacaaaaatcaaatgctaggcagtggcaccaattttgaacgatgtttctacctcaaggatgatgttagggctttacatatattattttactcaataattctgtaaggaaagccttctcatccctactttttatgtgagataaatgaggctcagagaagataaagtacttaaacaaggtcatctctcttaggagtggtaaaactaggattcaagatcacagtaagaatacaaaaaagtaaaaagtagaagtgcttgcatttttctatcctcagtcttatttttacaatcatgagcttagaattctgaaaaatgctaaatcaaaatacatgtaaaatagaaggttgctcaatggtatcttgcaatgaagatataaatgactgtgttatatgtttattgtgataattgtcataaacaatgcaaataagatacatcagattatctgactatagttgtgcacaataggtggtagccattgttgttgttgttagtgccactaataacttgcaatcatattttgtaggaaattttaggttagatagtgctttcaagaaagtcaccttttgttatattacaccacctctataaaatagactatccttattttacagataaggaatcaaaaatatcttctgcttaagtaactttcaaaagctatagaattagtgggcaaaaagatgaaattcaaaacagtatcatgcctctttcttacaattataattcatcagtttttatgaagccaaccctcccaccaggagcaagtggggaagccttgtaacccaaacacacatccatgcacatatgtgcacacaactgtttcaaggcttcaggggattactaagaaatataggatttaaggagttaaaatctcacaaaaaagagaaaggtgctgatgtgaacctcatgtttcatctggcctttcccctccaggcattcgctggttgccaaactgcacaggactagcgtctaaaaagccaaactaaagctgctccaaagaagtccaaaatccaaacaaaatttttgacaattacatgggattggagagataaaacttagaattcaaggttcccaaggaaacaggggtaccagaaaggagggaagaacacagcaggtgagctcaatacacagccccaggtttctgttaggggcatttgagaagacgaaacactaagcacagctttggagagcctcacagtgttacgtatgcaaagaaatatgggtcccaataaggagagttcttgtataagctcaaagtttgggcttttggaagagttcacactgggagtaggtgcaaaccagaaagagaacatgattaagatatagaaactcaatctttctacagctggatatcagagagcggtgttggaatctgctccttctctagctgcctagcaaaaattaaatcgaatgaagtcatctgtgaaggtagagaacatcattcagcacctctataacttgtccatatacaaaagttaggactcaattataaattaccattctgaaactgaaatagtgccaagaggaaagaaaaaaggaaagagaaagtagcaatatactcacagatgattcagatattgaagttcccagaaatggattctaaaattgctatgacttatatgttcaagaaagtagatgacaagatataacattttaccgcaaagggaaaagcaataaaaaagaagcaaatagcaattatagaacccatagcttctgcttcagaccagattggagtaaaaggaatcagatttgacctcccactggaaacaaattttaaaatgagtaaatatatgagaaaatatattttcaagacattggagatcaataaatgaagaacagtaatccctaagagttatgaatgaaaataatggaagctctacaattgtccatattatctctttgagagagattctaggctgtggctcaggaaagggaaactcaggagtccaggagactagggttgaaagcctagggagaccaagtagattgagtttttagggcaatggaccaggaaaggtagaactgcacacagaaagaattataaataggactctgggtatgtgaagatgacacctactttgagtattcaataacatactaatcaatgaatgcatgtgagaaaaccatccaaagtatctgggaaggaataacatgaaagaattagaaagttgcttagagtttacgcaagggcagggaatagtgcctgtttccactcaacagactggaaaatctactgagtcacagggcactgggtccaaagcaagttcactttgcactggtattaatcccagggaaagacccaaaaccccccacccactgcacgctgagctatgacagtttctatcacttgcacaagtctggtgacccagaacacttgcatacaacccttcatgaagtaggtttattacttacagataggcagcaagggacaacagaagcctagaattcatgacaaaccagtcccccaagcttcaggaaagctacccagggcagatggaacctatgcgtatgtgccccacttgcacttcagctgaggggccctggaaagcagcccacagtggattctatactccggggattatatggttaccgggctaaagcgctgtaggacattctgttctaggaaggacttggagcagcccctggcctgttctagccaattccactatatgtcagaatgttgcattcccagcacattctagttattcttgagaactataggcaagaaaaggggagaagacagcgttggcccaagacacctggagaactgtcctgcgttggatagaatactcagaagaaatttgtcgaagttgtaggaagaattcaccctagactaaaggctgcaaacaacctatgtgtctatcaagacatgaatggatcaacacactgtagcatatccctataataaaataatgcttagcagtgaaaagcaatgaactattgattatgcaattacaaaataatcatgctgagtgaaagaagccagtcaaaaaagagtacagactaattatatgtataattattatgcatcatttaaaaataaaaaataaaatagaactcaaattagctaccattctcatatgcaaatattattgcaactctttgtaagctttttgcatataccaaaagataatttacaagttaaataccagattattttttatttgttaaaaaactcttcaaaaaactgattgtatagaaactaataacatataaggttagagaattacaaatatcaatatagtttttcttattaggataaaaaagtccctttaaatcaaaaagcatataattgcaatagtaattgcatgttaattaatgtaatacaaactgactattaaaacatggattcattttttactattatatggaataagagcatatcaaagccttaggtaattaaaatttacattgatgagatgtccatgctaagcttagtgcagcaatatcaggcttataattgaaaaaacaattatatgcatgattatatatgtatagatttatgattattgtttacatattataatccacaataatcataaatctggtgtggggggaaaacttaggctttacatgtaatgtagaaagatgagatgtatcaggaatgagtggacttttatataaaccttaaaagtcataaaagtgctttttgaggccttttgaaaatcagttgctccaggggagggcatgatggtcagaactttggtaattaaagggtagaaaacatgcagaattggatacacattttataactctatttttatcttcacgatttttgctagcaatcatgtttcaaggtagccaaagggcttttgaatcacaatttatatccaagtcaacaggtttatattacctccaattgtaattagaaaatgataagcatgaaatattttctagttctcttaaaattagtaatactacatgtttttctgtgtgtccttactccaaaaataaaatttaccaaaaaaggaagaaaagtcttcccaccccatcatcatgaacatgttaacagaaaaattaaacgaggcaacatatcctgaagacatttatgaacttaaagtgctatatgattatgtaaatgtaattaataacctatatctttttccatagctagtaatataacgttttagagcaggagaaacttaagaaattgccttgtcaaatgctgacattgtacaagccaggcgatcagtgctttgcttggtgagtttacctatccaagactccacagcctctttgtggcagagaaaagtccaacctcttagcccctagttttaactcatgtgttgtctctccaccaactccaacttctcgtgctgatttataagtgaagttcatcgtagattctctgtagatatttataaccacgcagagctcaggtcctcgctcctgagcaggtgctgctcggctgcttgccatgactcctctccttgcactctgaaaacaaggtcattttgttcacaggctgagtgcagagaaccttgtacagatcaggggttttaaatatgacaaacaggagtgtctaatgctgaacatttcagaattcattaaatgttgctgttttagtaatcaaaaccattaattgcaataaataaatttacccattccccatgtaatccagggtgatatggagtaattagtacttcatttcattgcttggaattgatatcaattaatttacttgccaggtaatttgttcaacctgtttaagaatttttccttgtaattctgttattacctttgtctaataatgtttaaaacataatgtaattaaatgataactaaaactactgtaaatcatatttagtgagtacagtgattgaccatctttttttttctgtcagtgcagtaatttttttcttttttcgagacagagtctcgctctgtcgcccaggctggagtgtagtgtcgtgatcttggctcactgcaacatccacctcctgggttccagtgattccctgcctcagcctccctagtagctgggattacaggctgtgccaccatgcctggttaatgttttttaaatgtttttagtagagaagggtttcaccatgttggccaggaggtctcagcctcccaaagtgctgggattacgggcgagagccaatgcgcccggcccagtgcaataattaaatacacaatctatgtcatatgtcaggtggactagcctgccctttttttgaggtcatctttggttttcagaattaaaaaaaaaaaaatcccttgagcattgacagcaagagtgacaatattcttctccccacttaccagcacataaacccacccagtccttcctggttctattcccattacctcctcttcattctgttttagccacctccaccttacccttctcttccctccctcacttatcttacttgctcctcagatgggtaggtcctctctctatccttcctcagccctgttcttcttctgtcatagtactcctcatcctacataagaatcatttatcttctgaacatcaacaagtagccactgtactcaggttccaaaatctctgctggagatgtagtggttagaatgaccaacacagcccttctcctcacaggacttccggtagaaacaagcaggggacttgaatcatcaatcatattttaatcatcagaagcatgcgaaatactataaactagaaatacagggcagtaccaaactaaatgactgctgtactgtcttcagtatcccgatcatatctacaatataagcaagtacacaaaaaaatacaaaatgttttgttttcttcaagcattgtatatacacaagatacaaaaatattcttgggaaaaccgaacacacaaatgactattatcctagagtcccctccgctaggctcatgtggaaaactgaaacagaattttacttctctacttaccctgaaaccccacaactttctcagactgtcactaaagttgatgaattttggttctcatttaagggctacttaaatgtttctttcatagagcatgaggttcttgtctttctcaaggctgtgcctcacttccttcttgcactctgtcttgaagatgagcaggaaagctcctcagagccatctaaggtagccatcatttctcctttgccaaggaaacctttctccaatctgttcttgcctggataccaggaccaactccctactaagtaactgtgtccccttggagtgttgtgcagtacagatcagtgtctgccaaacatgtatccaaatgatttcgagatcatttaaaagtgcagttggattcagtaggtctagggtggagtctgagattatgcatttctaacaaaatcctgggtgatgtcaatgttgcaggtctgcggaccacattttgagtagcaaggatgatggaaacaaagagattaatctgcatgaaaaaaattttggaaatttattggtgtcataatatctaccaaatcagggccaaatctagagatatctacaactgtgactcaacataaaggcatatatttttgagcaggaccttcagaggttctaaaagcttattctattacaaagtttcacaatatgctcctactttggatcttgtttctaactccatagcagcgcatgtcactaaagaactaatgggggcattatcaaaagagaagtctgacctctgtcccaggttagcccccaaggtcttatcacagctttttcatgtgagctcccagtaccctatggctgcggcatcccctataagaatatgttctgtgttacgaccaggtttccttctgcatcctgtaccaggattatcatgggattactccctagattcatcatcagtgaatgtgataaataccaaatggccagaaagattgcaaactacctgtgtgaaaagaggtcaaaggtttcaagggaaggggagttcagttatcatcaggcagctttttaaaagctcattaaagcacaatcatacagggttataacagtctaattctaaagaacagaggagaaactattgaccaataaactttgacttaaaatcatatcaattaaatgggggaatccctagtgacagcccaattctaattgaagtttgctcaacaaaatccttatctggcccttattccctttattacctcttatcatttttcgttcttttcattttgaattctatgaagacaaagagatgttgagcaccagctcaccacaggaccttccctttgtgacagacccagtgggccctgccacatttctcttagttattctgtttgttatgttacctgcttgccgctgggacgcatacactatccccatcatgccctcccaaaaatgcccattacaaatttatgaaataggggcaaggacacaagggctgcaaaaatgagccacagtcactagtttgtgaaaaaaaaattagtgttgatgccaactaatctttctctttacctatgagacaggaaaatggccttttgtcccctttttttctcagctcaggtacttggctattgctttgcagtctctactcgttaaatagagatacctactagaatttttcatcctccttcaaagtgttatgagaaacagagataatggcctagaaagtcatttgaaatgttgaaaatcttgattcaatgtgagacagctgtttaaatcatagtttatgaataagaaaacaacaatgtagcaggtttccagcatactaaaaatagtaaagtttagtttccctaggaaaagtttctacacagtttttccttcaagggatatgtataattttgatgcgctttggaatatcctagtcccaagctttttaaaatcagctttacttaagagcacttagctttacgagaacctagcatagcacagacatggtttctttatttttcagaggatggtcggcagagagtatccgaattattgctccatgctgcgagatccctgttcctaggaaagccgaggtctgccttccaatgtgcaattctagcttaatagggaagttatatcactgttgacagtcttgtcctttcttaataaatcttaggagttatcccataaggaatattcattttccttcagacatgaagtgaccattaagatgcgccagtaaagaatccatggctttcagtgtctggccctatttcttctagttcaagaattttaagaaaaaatattgcaataaaaggtatatttttattagctacaaagtggatacatttcttgtttctcaaaaaaaaaaatgtgttattctgaaaatgttcaaatagccaggatttatattttgctaaagttagattttaaataaaagattcctgcttaattataaagagagaatatttactgatagaaaatgtctctataaatggaaacatgttttcatgctgcccctgacacccgtcgggggtggcaagagagtggagagtggagattgctcaacaccaaaggtgaagctgggtcatcaaagggcaggaagaattatgatggctgaaaataacaacagaggggacccacagcaaagtccaaccttagcctccaccaataaataaatgtaccaccaatagataaattaaaaaagtgaccttctctgtgtctgagggttattgactatccattttattttttttctgccacttattaatacctgtttgcatagagagatacttgcattttatgcaatcaggaatagaaagcagttccctttgaaaatattacaagagaaggttgataagcatatatgtgtatggagaggcatgaaatcaacatttattgatacctaccatgtgctggaatctgagctaagatgcttttgtatgtgttttcctaactaaataattatatccctaccatttaaagatctatgatactaagaagttaattaacttgctccagatgagatagctgccaaatatgaaaaacagtcccaatgtcctgttgtgatgttcaagtcacatcacactatattttctcacttatacaatagaccagcactttccaatcacaagtttcgcaatgatgggaatgttctatatcgatgctgctcaaaatggcactagcctcatgtgactattggacctttgaaatttggctactgtgagtgagaaactgaattttacatttaattttattttaattaattaaaataaaatttctgtcacccaggctggagtgcagtgccatgattatggctcactgcaactttaaactcttgggttcaagtgatccttctgcttcagcctcccaagtggctgggactataggtttgcaccaccagactccactatttttttttaattttgtagaaatgaggtctggctatgtttggccaggcaggtcttgaactcctggcctcaagtgatcctactgctcagcctccaaaagtgctaggattacaggcatgagctactgtacccaccctaaattatatttaagcaaacacacgtggctactatatgagataacaaatgtctagccagaaactttgttttaatgagaattgtaaaggttctttcaactcttatttttctccccagtctggcatcactgtttctccccaactcttgtttatctctcaaaatgcaatccttagatatcagcaataaagacatctgcaaagtatatcttccatgaaagcaataagaatagctcaacaaattgcatgtaggatcactcaaagagatctatttctagatattacaattaaattgttgaaagccaaagaccatcttgaaggcagaaagggagaagttatggatcgtatgcaagggatgctcaataagattaacatatgtctcatcagaaaccgtggaggccagcaggcagtagcatggcatgttcaaagtgctgaaatacagactgccaatcaataattttatagcctgcaaaactatcctttaaaaatgaaaaaaaaaattaagatactcccgggtaaacaacaactgagacaatctgttgccaatagacttactcaaaagaaattttaaaaggaacctgaaagaaggctgaaatgaaagaacactagactgtaacgcaaatccacctgaaaattcaaggagcaccagtaaagttaaatacagaggtaaatataaagcacagtatacatgtatattttttctactatcttatttttaaaacaactttctaaaacaataattatgaatcattattgatggatgcccagtatagaaagatgtaatatgtataacaatacaacaaaggagaaaagattaaatggaggtaagtaagagcaaagctagtacttactatggaaattagattggccttaatctgatccagatagtcataagctatgacattaattgtaactctcagggtaaccactatgaaaataactcaaaaatacatagttaaagaaatgacaagagaagtaaattgctaccgtagaaaaatttatttaacatataacagacagcaacagaggaaggcggggaaatatgtagaaaatatgtagaaatatgtagaaaacaaatagaaacatcatggaaataaatgttacattaccagcagttatattacaggtacatttattaaacattcctaaaatggcagagaatagataaagaattaaaaagaaaacatgatccaactatatgccatctgcaagagacacacattagaatcaaagacacaaatgaattgaaagtaaaaggatgtaaaaagagatattatgcaaatagtgaccaaaagagagccagattagctatattaataccagccaaaataaactatcatctactttgtggtagatagaatcatgaaagagagaaatattcaattcaacagtaatggttggaaattttaatataccatcttcaatgatgagtgagtcaactagacagaaaataagagaaaatcaaatacttgaacaacaatataaaccaacaaagcctcacatatctatagaacattccattcaacagcagcagaatgaatattcttctccagtgcattcttcatatagaccatatgctcggccataaaatatatttcagcaaatttaaaaggcttcaaattacagaaagtatattctctgaacgtacggaataaaactaaaagtaaataacagaagcaaattttggaaattcatcaacatggcaatttcaccacacattccctaataactaatgcacaaagaagaaatcacaaggacatttagaaaaatgctttgacagaaagaaaaaggaaagcacaatacataaaaatttttgagatgcaatttaaggaatacataaagaaaaatatatgactataaacacctatattaaaatgagaataatatcagtaatctaaccttctaccttaagaaactagaaaaagaaatgcaaattaagtacaaatcaggcaaaataaagtaaataataaggattaaggcagaaaaaaattagatgatataattgccacaaagaaaatctacaaaaccaaaaggcagatctttaaaaatgtcaataaaattgacaaaactctagctagactgaccgagttaaaaatggagaagactcagattattaggatgaaaaaagaagaggaatattattattcaccttgcacaaataaagaggattataatagaatactatgagcaattacatgcaacaaattggataacctaaataaaacagaaaatgtctaaaaatacataaactaccaaaatcgaccaaaaaagaaataaaaacacaaatagatcaataatgagtatactgttaatcaaacacttttcaaaaagaaaagacaggaaccaaagcttcaactggtaaattctgccaagcatttgagaagaattaatacccgttctacatcaactctgtcaaaacatagaagagcgaacaactttcacaattcattttatgaggacaataatcaccaagactaaaaccagacaaataacaaacaagaaaatcacagattactttgcctatgaatatagtttttaaaactctttaaaaagtacaaccctaaatccatcaaaatacaaaaaagaattatacattatgaccaagggggatttatttgaggaatgcaaggttggtttaacatgcattcaacaaaccatattaattgaacaagagataaaaactatatgatcatttccatagatccagaacaagcatttaataaaacataacactttttcatgatttctttttcaaaaatcaacaaactgggaatagaagaaaaatgtcttaatctgttaaagggcatctacgaaaaatgtacaggtggcatcatatttaatggtgaaagactaaatgttttacctctaacataaggaaataaagggatagcccctcatcccacttccattcagcattgcactggaggttctatccatggcaattaggcaagaaaaagaaatagaagtcatccaaaatgtaaataaagaattaaactgtgtctatttgcagaagacatggtcttgttgtatcagttttccaactgccatgacgaagtaccacaaactggttgcctccaaatatataattttattgtcttgcagtgctagagactagaaatccaaaatcatggtgtcagcaagatgtgttctttctgaaggttttgagaaaagaatctgttccaggtatctatccttggcttttagataatcatctcctcctatgtatctttatattgtgtttcttccatggtgactctgtgtctaactttctcaatttttattaagacaccagtcatactgaattagtgcccaacctaataacctgattttaacttgatatctccagtaaaaaccctgtctccaaataaagtcatattctgaggtagtgggaattagaatttcaatttattatatgattgggcagggtactgaagcacaaatcaactcataacatttaaatatagaaaatactaaaaaatccacttaaatagattaaatgagtttcagaggagttataagacaaatgattaatatacaaaacttaactgtaaaaatagtctcaaaatactgtagcaatgaaaagggaaatgagaatccactggaataatgaaggacaccccagatctgagggaggagaaggtgagcaaacagcccccgcaatgatgtctggctgataaaagtgagtgaaaccccagtacacaagaggggaaaatagtctccctctgtgactcacctttccactggggatctgtgcaaccaaggccaagggagagcactttgtttctcccaagccctggagctaacttgggagggtcttagagatgctgagaacgaaagaccccagaaaaagctgcaggtattttcctagacctgggaccaaaagcaggacatcatttttaatctaggtgcatacaaagtcagtcattgttaggtgacctggcagcatggccatgctggctttttagtctcaggccaaagagcagagcacttgcactgaggagatgtagatgcctccacaagcagaactgtgaaaagcacaccagcaataggcactgaaattgtgctctaccccttcacaggtctgggacaggaggggaattgctgcagctacattgtctcctgggcaatgagactgcagccaggaacagctcggtgacttggaaccagtctgcatatgtcactgctaggtgatccagccagctccccagagattaaggtgcataatctccctgctccatgccgaggcagatctccaggcattcagagcacccattcgcaaggatcagcagcctgagttgtcccaccctccctttgctgagatgctcatgcatgggtggggggccctctctgctccaggccctgacagacttctgggcatttggagcactgactcccctagatcagcagcctgggcagccacacttatcctatgcagagataatggtgcagcagggtcacctccactccacacctgggcagatcctcaggcattcagaacactcattcacctacatcagcagtctgagccaccccatgcttcctgtgcatagatcatggcgcagggaggccctcttcactgtacgtccaggtctatttgcaggcagtttgagcacccattcaactaaatgggtggcagcctgaatcaccctaagtttcttgtacagagatctgggtgcagggggtgctgagggagatctctgggcattgagaacacctgctcatctggatcagcagcctgaaccaccttatccttcctgtgcagaggctgtgatggagcagggcctactctgctgcatgcccagaccagaccttcagggatacagaacaccagcttgcctgggtaacagcctgagtcaccctcaccgtttttgtgcagagattttgttgcacctgggccctctgcattccatatccagacagatctccaagcatctggaacactcacttctcctgtattaggtatttaggccaacccttctccctgtgcagagaacttgggaccaaagaagtttcttaacttcgtgcgtaggcactcctctgggtacttggtaactgcccactggattataactttgtgctggtgtttgtgcctgcctagtctgacaccacccatcttggtctttctctcaccccccgacgatgcacttcacagatctacccattgcctgaggcaacacagagcttctcccagtaaataaagagctacattggctgcagccagctcttacccataagcaccatctaatagcttgtaggtcaagccccaaacctagaataaaaatgggctatagaagcaaagccaaagactctatcttacattctttacagtcacagcccctagagagggggagaaagataaagaataaaataatattatatggaaaaaaagaaaaaaatcctatccacatgaaaataattacaaaaattagaagtggctgcattttcagatgagaaagcaccagtgcaaatgttacagcaccatgaaaaatctgaatgttgtgacacactagctctctagtaatgctccttaaacaaaatggaaactcagaaatgaaagataaagaattcaaagcatggatcagagaagttcagtgagatcaagacaagttgaaaatcaacacaaagaaacttctaaaggaatccagtaaatgaagaaagagataaacagcttaaaaataaatcagtcagagcttttggaatagacaaactcacttaagaaattatgaaatgcaattaaaatatttatcaatagactggaccaagcaattctgaaagaatttcagaacttgaagaccaatcttttgaactaacccagtcagacaaaaataaagaaaaaagaatttttaaaactgaacaaagcgtttagaaatataggagtatgtaaagcaagaaaatctacaaattattggcattcctgaaagggaaaaagaaaaagaaaacaacccgaaaaacacatttgaaaaaataattcaagaaaattttactaatcttgctagagaagtaactatccagatgttagaaatccagagaacacctgccggatactataccaaatgaacaacaccaagacctataggcaccagcttgtgcaaagtcaatgctaagcaaaaaccttaaaggcagccacagaaaaatgttagatcatgtacaaaggaaccccatctggctaacagcagacttcttagcagaaaccttacaagccaggagagattgggagtctatctttagcattcttaatgaaagaaaattctaaccaagaatttcataccccactaaactaagcttcatgtgaaggagaaatgaagtcttctctagacaagcaattactaagggaatttattaccagtagactaatttcacaagagatccttaagggagtttgaaacatgaaaacaaaagaataatatctgctactacaaaaacacatttaagtatatagcccagagaccctatgaaacaactatacacctaacagctaacaacttcacaatttgccactctgttccttttaagtggggcctttagaccatttacattcaagattaatattcatatcacatattaaaaaaacaagacccaacctcctgctgtcttcaagagatttatctcacatgtaatgatagccataggctcaagtaaagcgttggagaaagacctatcatgcaaatggaaaacaaaaaaaaagaggggtaactattcttaaattagttaaaatagactttacaccaacaatggcataaaaggacaaataaaggaactacatactgatgaaggatgcaattcaatgagaagacttaactattctaaatatatacataccaaacactggagcatttagagtcataaaacaagtgcttctagacctataaaaagacagccacacaataatggtggaggaacccaatacctcactgacagcactagacagatcaccaaggcagaaaactaacaaagaaattctggacttaaattcaatacttgatcaacttgattaattgaaccaaagagatatctatagaacattccacccatcaaccacagcttatacattcttcctatctgcttctggaaaatactctgagatcaatcacattctcagccatgaagaaaatctcaataaaataaaaaaaaataaaaatcatatcaatcatactcctggaacacaatggaaccaaaatagaagtcaattccaataagatctctcaaaccacacaattaagttgaaattaagaaagttgccccggatgacttttgagtaaacaaagaaattaagacaaaaataagaaaaattatttgaagtaaattaaaaaagaggtagaacacttcaaaatctctgagatgcagcaaaagtgtgttaagaggagagttagtagcactcaatatcgatttcaataaaatagaaacataccaaattaatgatctaacattaatgatcacatctagatgaactagaaaaataaagacaagctaaccccaaagctatcagaagaaaaggcatgttaaaatcagagcaaaactaaatgaagttgagatccaaaaatccataaaaagtataagaccaaaaggtggttttttgaaaggatacccaaaattgatagactgctacctacattaacaaagaaaaaaaagggagaagatccaaaaaagaactgtcataaacaacaagtgtgacattaaaactaatcccacagaaatacaaaagatccttagaaacttttatgaacacctctatgcacacaaacttgaaaatctagaggaaatggataaattcatgggaccacaaaatctagtaagattgaatcaggaagaaattgataccctgaacagaccaatatttggtttaaaaattgaatcaataatgacaaactgaccaaccaaaagaagtcttgaactagatgaatttacagctgaattctactagatgtacaaaaaataactggtaccaattctgctaaaactattctaaaaccttgagacagaaggactcctccctaactcattctatgaagccaatatcatcctgataccaaaacctggcaaaaacgtaatgaataaataaaacttcaggccaatatctctaataaacatagatacaaaaatcctcaataaaatattagcaaactgaatctagcagtacatcaaaaagcttatccaccacaatgaagtaggctttattcctaagatgcaaggttggttcaacacacacaaatcaataaatgcaactgaccacataaggacacttaaaaacaaaaaccatatgatcatctcaataggtgcagaaaaagcttttgataaaatccaactttccttcatgataaaaccagacattgaaggaacatacctcaaaataataaaagtcacctatgataaatccacaaccaacatcatagtgaatgggcaaaaactggaaccattcaccttaagaagaggaacaagtcaaggatgtccactctcacaactcttattcaacatagtaccaaaagtcctagccagagcaataaggcaagaagaaataaaagacatccaaatagaaaaagaagaagtcaaattatctctctttgctgctgatgattctatactttaaacatgctaaagactctgccaaaaggctcctggaactgataaacagcttcagtaaaatattaggatacaaaatcaattcacaaacatcagtaccatttttatacaccaataacatttcagctgagagccaaatcaagaacacaatgccatttacaatagcacccatccctcccaaaaatacttagaaatacatctaaccaaagagctgaaagatctccacaaggagcactacaaaacaatgctaaaaaaattatagataacacaaacaaatggaaaaacattccatgctcatgaattggaagagtcaatattgtgaaaatggacacactgcccaaagcaatctataaattcaatgctattcttatcaaactacaaacatcatgtttcccagaatagaaaaaactagtctaaaattcagatggaaccaaaaaatagcccaaatagccaaagcaatgctaagcaaaaagaataaagctgaagccatcttattacctgacttcaaactatactatgaggatatagtaaccaaaccagcatggtactgatacaaaagcatacacatagaccaatggaacaggttagagaaccgagaaagaaagccacacacctacaaccatctggtctttgataaacttgacaacaattagcaatggagaaattacttcctattaagtaaatggtgctgggatgactgactagccataaacagaagactgaaactggaccctttctttcaccatataaaaaagtaaataaaatgaattaaatatttaaatataagacctcaaactataaaaatcctagacataaacctaggacgtaccattctggacacaggccttatcaaaatatttatgggtaagtgctcaaaagcaattgcaacaaaaacacaaattgacaagtgggatctagaacttctgcaaaacaaagaaaccgtcaacagagtaaacatacaacagaattggagaaaatatttgcaaacaatgcacctgacaaaggcctaatatacagaatccataaagaacctaatgcaacaagcaaaaacaaataacttcattaaaaagtaggcaaagaacatgaaccgacacttatcagaaggcctacaagcagccaacaaacatgaaaaaagttcatcatcactaatgaaatgtgaatcaaaaccacaattagatgcccccttgcaccaaccaggtggaattgttattttaaaaagtcaataaataggccaggcgtgggggctcatgcctataatcccagcactttgggaggctgaggcgggcagatcacttgaggtcaggagtttgagaccagcctggccaacttggtgaaaccccatctctactaaaaatacaaaaattaattgggtgtggtggcaggtgcctgtaatcccaactacttgggagattgaggtgggagagtcacttgaacctggaaggcagaggttgcagtgagctgaaattacatcattgcactccaacataggtgacaagagcgagactttgtctcaaaaaaaaaaaaaatcaataaataacagatgctggcaaggctgcggagaaaatgcaacattttacactgttagtgggaataaaaattattgcagcaactgcagaaagcagtgtagacatttctcaaagaacttagaactacctttccacccagcaatcccattattgggtacatacctgaaagaaaataagtctttctaccaaaaagacacatgcacttgtatgttcattgcagcactattcacagtagcaaaggcataaaatcaacataggatacccatcaacagtggattggataaagaaaatgtaatacatatacaccgtggaataccatacaaccataaaaaagaatgaaagtatgtcttttgcacaacaaggatgcaactacaggtcattgtcctaagcaaattaaacccaggaacagaaaaccaaatactgcatgttctcacttacaagtgggagctataaattgggtacacatggacataaagatgggaacaatagacactggggactactacaagggggagagtggaagttggggggcaagggctgacaaactacctattgggtattatgctcactacttgagtgtcgggatcattcataccccaaacctctatgtcacacaatacaggcatgtagcaaatctgcacgtgcacctccgagtctaaaatttaaaaaggaaatatatttatattttacattaagatgaaaaaagatctgtacagtaaaaaccacaaagctttattgaaggaaattaaagaattcctaaataaatagactttccatgtacatgagttggatgagttcatattaataagatggcaatattcttcaaattgatcaacagatttgattcagttcttacaaaaaacacaaggtagattatttgaagaaattgacaacataaccctaatatttatatggaaatgtaaaggatctagaataggcaaaatagaataataatgttggaagaatcacactcagatttaaaaattattgcacagctacagtaatcaaggcagtgttgtattggcataaggacaggcatatagatcaatggatcagaattgagagttcataaaaaaagaacaaactcatattttgggacacttaaatttttacaaagttaccaagatgattcaattacaaaataataatattttcacaaatggtgctgggacaattggatattcacatgcaaaaaaaattagtaaagttggactcctaagtactcctactctaccatacacaaaaattcaccaaaaatgaatttaagatccaaatgtaagaactaaatgtaaaaactgaatctataaaactcttagaataaaacatagccataaatctgtatgactttggaatggtaatgatttcttatgtatggcaccaaaagcacaagcaacaaaagaaaagaaataaattgtcccttatcaaaatttaaaatatttgctctttaatggataccattaagaaattgaataacagccgggcatggtgtctcatgcctgtaatcccagcactttgggaggccgaggcaggcggatcatctgaggtcaggagttcgagaccagcctggccaacatggcaaaaccccgtctctactaaaaatacaaaaaattaggcagacgtggtggcgggcgcctgtaatcgcagctactcaggaggctgaagcaggagaactgcttgaaccagggaggtggaggttgcagtgagccgagatcacgccattgcactccagcctgggtgacagagcaaaactgtgtctcaaaaaaaaaaaaaaagaaaaagaaaagaaattaaatgacaacccacaaaatgggagaaaacatttacaaatcctacatctgattaaagacttctatcaagaacatataagtaactctcacaactcgatgaaaatatgacaaataaccaattaaaaataggcaaagaatataaatagacatttctcctaagaagatgtacaaatgttcaatatgcacatataaaatggtcaacatctagacccaaagtaaatacaaataggaacctaatgcgataccaatttacacctgctaggatggctataatcaaaaagacagaaaataaaaagtgtttgtaaggacggggagaaattagaaccctcttacactgtccatggaaacgggaaatagtgcagccagtatggaaaacaatctgaaaatttttcaaaagtttaaacagaattaatgtatgattcagcaattttatccctagatacatacccaagacaaatgaaaacatagtttcacacaaaaacatatacaaatattcattgtatcattatctgtaacagccaaaagtcaaataccgaccaaatgtccattaactgatgaatgaatatatgtggcatatccatttgatgaaatatactatttcttggcaataaaaagaaaaaaaatgaagtacttatacctgctaaaacatggatgcacttggaagctacactgaaagatgccaggcacaaaaggccacagattgtatgattcaattcttatgaaatgttcagaatagggaaatccatagaaacaaggggagattcatagttgccagaagctgaggggaagaagaaatagggaataaatgctaatgagtatgaggttttatttcagggtagtaaaaatgttctaaaattgattgtggtgatggctgcaaaactctgaaatactaaaaaaatcattgaactgtatactttaaatgggtgaaatgtatggtgtgtgaattccatctcaattaagctattattgaaaagaaaaagaaagagagatgggtggagaggaaggagtttccaaacatctaaggaagatgtatccaaatctggtacctagccagcatctacatatagaagagcagaagaaaacgacttggaaatgtctttgacatgtgccatgccatcattcacagcccagctggttggaatgatgtgatcagttcacttcagtaatttcccttctgttatcttgttctgggagcgttatcccttctagaactgtgactcctgtcttaaaacagtctcctctgaggctatttcacctagaaaatagaactagatatagtcccatatgcattgagttgttaagagaattagatcagaaaaggtagaaggtgtttagcacaatgactttcatgtagtaaaggctcaacaaaagttacgtattttaaattccttaactccacccccaccatttgccccattctggcatgcatttttattgcaggtcattttaatgacctagagtcattcattgatccttcatacatttgtttttgttgttttttctttgatatgattcattttttcttttttcgttttagcaaaacccaagtatcaagttctgcactcagtactgagataattgcactacacagagatgagtgcaatatggaagctaaacacaggatgctttgaagaaaagaagaatcccttctattttgtcctgtaccttcctgtaccgcataaccatgctcagaactcaaagaacacacagcctttctcaagattatggctggatggaaaaatttctaataaagaagtgaaagcaattt

SEQ ID NO: 222 - DNA, 2866 bp, Homo sapiens
ttattactgtctgatttgatcggaggcagggggtggtctccaatcaaacagagaaaaggtcctagagaaggtaattaaatcctgtcagaggcaattatcggttccagggccatgactctggccctgaatgcagatgatctgaaactgtattcttgtagaaattcaagagggctcctggcatggttcagttaggcataaaagaagcagcaggctttctgcaaacaatgcagccctgtattttgaacctttctgcctctttttccctttacccgaagacttctgttttcactgatcaaaaatattccttttcaggccacattctaattaatttaatagacaaggtttttctttcttgtacataaataatgacaagttttacccaagaacttctgcccccaaacacgggctgtgacaaacagcctttatcaaagcaaaccaaagcatttaatggaaggacaccaatctgtagtttagaccaacggagaaagaaattttaaagactctaacatggatgttcttcctgtggtggcttttgccctgtctgtttatacattgccgtgcacatgatagagtttgctgctgtgacaaatcttgaagttctacaaggtaatctagtgatgacagcatgcatttaatggctacaggttttttttttttattaacagagaaaatctgcagcagatttcagtatgtggggtaagtgcctccccaaaatatttagtagagttaacattttaaaactgaggcctgaaaaataaaaacagcaagaaagaagtgctgtagttttaattgggaagagaaaacaaagacaaatgccataggtgtacttttgcttttaaataaatagaagacttcagttttgtgtcctgtgtgatttctcaattgctattaaataagctttgggatgttgctttgcccaagaacccaagactgtaaagtaaacctctcttcatattctgaataacagtcatttttctccatagtattaatcagtttagcatgaaaaatagttgatccagtatgaaggtgtatcatagtttctatatcctcacactactggctttaacagactttataaaatattgcactcaataaatgccaaccttacaaatggacagccttgatttcaacctttatgttttgtgagcatgagtattatttttgcaagaataagatgttcaaaacaccattaaaacaatttctgtattgtcgctgatgaaacagtttaaccactagggtttctccccggggaacagttaactttcctctaatcttggttgttttctttgttctaaaacaccatattctttaatatgcctgcctttatttgttttgttgaaacataaacagatgctctaagcgaaacatcattttaaaaaagtagtccctgctactagtccattaatcagaatgaggtaccagactgggaaagaaattggtgggagaagatgttaataataatgaaaaatgctttggacactggttggctggattaaaaaaatcacaagtccaaatctttacacatgactctgaaaatgatgtttaattcattccatattgtgtttttggaacatcaaaggcttcatcaacttccttaataaagataaaatagatatgtagaaagaagcaaaatactcatgaatctggcagcatattttagatcattagaaccaaggttcattgctagtaccaaaatatttctctttcttccatctgagtgacaactctatctgtatcatttttgagctagggtatttatttttatttgacccgtcattgtatattattgtgtggttaagttattttattttgttttgttttgttttgaattgaagtgctggctgttttaacgaagacatttcttcagaaagaaatctttatttgtgaaaaaaaggaaccgtccttgtaagaaaacaaacaaacaaaaattgatatgttttcccctgatatttaagatcagtgcttctaaaagagaaaaaacaaaaagaaaaagaagaaaaaacgctgaatgatctgaaactatattctggtggtaattcaggagggctcctggcatggttcacttagacataaaactatacctagcttactgaagagtcctctgtattccagtcaacatcattttatttgccctggttgcatctttcaagagtcttcactgtattgagagctacttaagggtagaaatggtatactattccatcgggtatacccaggaaaccaataagtagaagactgcatcaattccacagacctttatgggcacccatgtaagccccatgacatagacctacccccaagttggaatcctggaaatcagcagtaactacattgcaacttgattcaatcagagagggattaactaaaatatcttataaaggagtggaccctggtgtggctgctattacccgtgtcaaagtctaatttgctctctaaataaatataggagcttctttatgctattacttaattctgtgagcattcaagtcctaagtatcagaactgccttaatgcaaaatatctgaggtcatttgaattatgaaggtgggctgtctaaatgatgtgtctttaaatggtttgtaaacagaactctccaggggacattatgttcattcagtattaaaatgtattttaaaatttacagtgtttatgcaaaacatagaaaacaattcacatttatctccttatgttcagttgctttggtcagcattattgaaatgggaagagaggatttgccttttaattggtcttttccagatttctggtgagactcctagcaccaccaactgcaggaatacacatcccaaacaaagcccactggggtacattctcaggatggtgcatatgggaacaataatttatgaac

SEQ ID NO: 223 - DNA, 46378 bp, Homo sapiens
aacttgtctccagcactgcggacacccgggtgacacattctttcggagagggagggcaagacttttctccggagcctctggcaactcgtggagtctatataaggtggggcggtggggggcgcggaattctctactttggattggtttgtttgttttaaatctagggtggtgggcagttgcgcgaggcggggtggggggtgctttatgaactacacacacacacacacacacacacacacacacacaccacatacactcgccctgcccttctaggctcacggctggctcttcccggctacaacttccccttccttcctgaaacaccagcgccttactcgctcagtcccccgttgccacctccgtcacctcctcggccgccgctcctgctggcactgctggcgctagcgctggcggccccgggctccgctggacgcctatcttttttctctccctcttccctagctctggattgattgatgaccaccggcggccaatggctctgacaccacgccatcctcggtcgggcatcacagccccacgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctcttctgacatcttttttcacttaaacttttgtttgtcccacccccccgacctgtttgtgtttgtttgcagcatctcaaatcaattatacatttttcatgacccgcatttgcacttaatttggggtgtgtgtgtgagaggggggtggtgatgtactattataaatcaacttcactggggcatccttaatttattttcttgctgacggattccaaccggctcctgagcctctagaaaaatgcccccttcacctcctaggccgcaaaaccccggaattcaaaggctttacaaagataaccttgttatacgtaaatagcaaagaaactcctgcctctgtagagaagaaatccggcggcaacggttacttttcctcggtactcgtcccccgtcgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagtaaacagctcgctgagccctcgtccccacccccatccccgccgcccggcttccccagcttctcgccgataccccctcctctcctcctaagaaatcctggcggaggagggagcgaagaggtggggacccccagaggtcgggggactgatggctggagggggtggagaagagaagaggcgcaggatggggagtcggagggaagacacctcctaaaaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgcaggctggggctgggggccagggggcgcggcgctagagggaggcggggggagaaaggacccgagcagcctcgatctggggagagagcgagcgagggggcgaggagagggagcgagggcgcggcgagccggagggagagcgagcggtgcagtgacagggactgccactggggtcaaaggagcacagctccaggaagcagggcggccgaggcgccgctccgtgcgcgctccccggcgggaccccgcgcccctgcacgcccctcccgcagtccctgcccactcggacccccaccggtgccccgaagccccagggtttcgagaggaggagggagccgagggcgaggcccggtagcctgctggtgctcccgggtcaagcaggcggcaggaagctgagctgcaagttcatcatcatgagtgcgatctgcgtaaaaaatgataggggaaggaaggcgggctacggtgccccaggaaaagaagggagctttctcccaaatggtgttcttctgcaaagagaacacccagctccccgccacccaccgacctgccaggctctgtcaggagtcctggcaccgttccaggacgcagggctcaccgcaggggtaaggggagcggctgggacacttcgctcagacctaggaaggcgaccctaggttccctcccatctgctgatctgaggctttcctgggggagagctgtgctcctttttccccaagcctttcaacacgacagacacacacacacacacacacgctcactcactcactcacacactcacctctttctctctgcaatgttgctgagaaagaaaaggccaacccagctgatcattttttttacctccatgaattaaggcagattcaggacaggaaggtgaggagaggcaaagactctaattgtttccattttcgtcttttggataaaattttccccaaaagataagcatgtcaaaagcattttaaaaatcaaacttagtccagttttgtctgctactttggaaaatggaagaaaaggttttcagaattttgtacaaacaacacaaggaaaggaaatgccgctgaaatgctggaagacagaaaacaagggagagaaggcttttagaaaacttggttggcagggttgtctgtgaaagatgaggtggccctgtgatgttatgccattgtcattgctgaaagattgggacagcaaccagatctaattcctttctaggagtcagactgaaagatctgtgcattctctgaagggaaatccaatgtatatatatgtgtgtgagagagaagtgtgctaagtatactatgtgacaactgactagacatcctggctgaaattataccccctaaaaataaaaaggagccattgcaacctggtctgtggcctctgtgctgagactaattggtttccagggtctggggaggaagggagagaggcttgtaggagcccctataaaaaaagatcaaacggaattcacttgaaaatatttcccttttacaatgggctttcctggcacttgaattttaagtaacccatctcttatgcctaggctgaaatgaaaagggaaatggtcttactaatgtatttattttattttacagcatgcccagagtgtcagtgcttgtcaaatgtgctggggtggaaaggacagtgtctttccttgcccagcacaaatcagaacaagtgacattgacattaaaggatgccaaagatgggggcatagaggcacctttaaattttgttttcttttgttttctagcccatcagcgaacactgactagaatcacgtttttgaagaaatgcttggttttgtttcctttactctgtgactgagtactacattcctcatatcttaatagtttgaatttttagactgatttgggctgatttaatcagttcaaaaaaaaaaaagcatcaccagccaaataatttctgtggtttccttctttaaaaaaaattgcagtcaaacaaaacagacaaactagtttgaacatgattctgaatctaaatatgtgcacccagacagtaaataataatgctttctactttagtggtacattttacaggatacttaatgccataaaaaatcaagtgggttatccattacaaagttgatggaaatttgtataccattttactgagtggggaaaattgaggtaaaaaggcttaaaattgtaatttgtagtgctggaagaagtcaacctgctgatagatcaattatccaatagtgaccaagttatatttggattatgaaattttattttcattaggctactagcaagctggagatatgaaaatgaatttaaataataaaccaggaacaaaaagacactcacttttcaaataattctctttacgtggatttgaacatattgcattttgttaaatcatattgtctacaaatacagctacctacactaaaagcttaatttaaaattattggatgtgaaccatgtctatcccatctcccatataagctttgaaatgttacctcattatatcaaattttaaatcctataagcttcagcttttttttaaagataagtgagtctataagttccattttcgttgttgttgttaaattcaacttttattgtgtataatggaaaagaaaagaaggatgaaaatcaaatactaagtttatgattggcttcaaggaaatattacaatttttttcttttaatggaattcaaagctggaccctttccccagtgatttcattgaaggaactggtaaatatgcttcctgatagcccactgcaataccttttaaattatcttttcagaatgcatttaggaaagaaaatgagaaagaggagcgtgggagaactttgggtggaagcttggaaagaaaatgatgcttcccttgaaagctcaatactttatttggagttggctttcatcttccctatgagaacaggttttcctgtacttcagagatgtgtatgacttaaaacttggttcaatactgtggttcttcttctaaaaagcaatccattgaaattactgcatgttattgaataatttcattgaaatgatatgtaccagtctaactgcaggaacaaacagcaactattttatttctttttttctgtaagttgtaagcatttctatcattttacagcaaaggctaagatgtatattatcagaaatcagagcctcttaatagaactaccactatgatgtaattagaaaataaaactcaacaaactattttatttttctgaattctcacagttcttatgttcattcaaatgtttttattatgacccctccaagttgaataacaatgtcctatatttctttgagttctttatctttatgttggaaatagttgttaaatgactgtgtgggtcaataaatgagaaagtaaagaagagaacacaccagtgaatgaggcaaatacagaattaagaaaaatccacaccagatctgtgggagaggaagtgatgtcatgaggcagtgttgtaggataagagctaaggacttcccaaggagttaaaatagcacattttaaaggtcttgctaatgcctttagaaatatggaataatcctaagactgttttacaaattaattttcttatagagagacaagcttgttatgtatcatgtccatttaaaggcagccctctttttaaatacagcaggatgccacaataaaaagaattccaagtaaaacttgttccttaaaatgtacagaaatgtatcaagccattctcaaaagaaacttatataattaatctaattccttgattgatcctttttgaaatcctcaaaataaatatatgattttttttcaagggtggtactttgtattgaaaattttctttggttaaccagtaaaaatgtttatgggtcaaaaaaaaaaaaagaatcaggaaacactagaactgatcaaatttcatttcataaaataaatgtcatgctcattatcatcttagaaaggctaaatttaattcagttttgcctgcagcttaagtagcaagcattggggaagaatcttaaaatttagcaaaacactcacaaattcttaacatacttactagccaatatctagcatgtatcaagaaatcagatgaaaattatttatgcaataattaattttaaaagtctgaacatgatactgagtctggattcatgtgttcttagtgttagtaaccattctaacagacatccataatctctgtgttgacctaaagggaataggctatggcacaaaatataatttaaagagtttacttgagccaaagtgtgaggacaactgcctggaagattcacacccaggtaacattggatatgagcttcctttggcctttgttacaagcaaatttttaaagccaaatatgggggacagggagtaggctgacacaaagttctctgtaaagaattctcattggtttacagaaaagcattgattagtggttggctagacattgttaagctataggctgtgagttatagtttccagtgcagcattattagttaatttatagctgctagggacaataacaagctatttcaagagatgaatacatagctcaaaagctgggggttaggatggacttgctgtctcattttaatgtctttctaggcctgataatttaaaaggactcacattcctcaataaaagttcttttctcattttaaatcaattaatgcttgctgagtctttccccatgtcatggtcccaattttgggaaaatggtaaaattttgtcgtacttgggataggcttgtcatggtggaaaagagctttctcattgaagtaaactcaaaataatctctcttgaaagatgagcagtatagaaaccccattaaaacctggtaaagaaaaggtatgtgagcatttccaagtttaataattcaatttggcaatctagcataagatatctgtatttcaagaaagcaatatataatgtaactttctttctcagcaaaaataaatcaatgaatggatacaattttttaaaactgagtttgagagaccagcagaatataaaacctttttctcactatattattaatgtaatggcttgattcagtattcaacaaatatttttaagctctgctctgtgtggggcatagttcttaaaccatgcttatggtctaatgatgtaaaaaaagcagagttctttccacattattaagtatacaatctcagggggatgggagacagtgacttaaagcatcacataaatgaatgcaaattatggctgtgtaaaggagaggcccctcgtgcaaagaaaacaaagcagggaaaccttttctcctctggggttgagtgaagaccttcctagtggaggaaaggaatataaagaggtcgcaggaaaaagagaagccagtgtggccaggtactgagagtgaagatttgtatggtgcaagaagtgtctgggattcatctggatgtgtaggtagaggccagaaccacaaggtcatgccaaagatatttgaaggtcacagtaaggccctgtttaagatgtttgatattatcctgagggcaacgggaagctgtttaaaaaattcaactggaaagggtaacatgattagattagtattttgaaaagatcattcaccccattttgtaaaacggattttagggaactagactgaacacagggagacctttgggagctattgctgtcactgggttggagttgatggtagccttagccaggacagttttggagtagaagatgatacctagagagaaatgaatagaagagatttgaatacattttacataagagcaacaaagattactggaatctggaactactggctaacagcactgtggtacccagccagagaggttgagagccataatcacctaatgattttctgaagcatctaattccacacacactccagcctccctatgtctctaagccatcttcatcctatcctttacacacttcttgggattctgtgtttcacgaagaattgtggcattaaatacagcactggtataaaatgtcactaactttattcagacttacagatcctagaactcactttatcctcctttcaatgccccacacctatttttggcacacaaacaaacttgttcttatttcatatgagatgtaattgcaagaggcaagtgtatttgtgtttttccttaaagtttttgaatgctacatcacttccatatctgtcctcatcagtaccagtttaatataattgaactgcttaatattccatgtactattctaagagatccttaacaaaagtggtcgcttttttattcagatcttcaaagaaagagatatcctttcgaggcaacacaagaagccaactacaaatgagaatattattctcttggtgcagggattgttgcatgtggaccccatcagccttgaaaagtccatggtaaggatgatactccagtggctgtttccttatggatacaagctaagttactatggccctgctcagcaactcagactgctaaggaaagatgtgatagaaatatgttcagaaattttaagactaatatatgacaactatattttctgactttattcctttcttgatatttctgcattttgaaagttctatcaatttcttcttctgttctcattactccccatagtgaccaactgtaaacaaagtaaaatctacacacaagagaacagttcaatagccaagatctagggcacacgttctactagatgcataaaataaaaggaaggtttactggagagcagttgaaaaaaaaaatcacagtgctacatccaaatccctatttcatgctttagtacaaagggaactttaaaaagattttttttcttttcaaaagcactctattgattgttttgtgaaaaactggaaaatacagacaagcaaaatataaaaaaatagaaattaaccataattatgtcactcagaaatatccactgttaacattttgtaatgtagtttttcagtcaaatgtatttcacagaaatggaacaatagtggaatatcaaaagcagagaaaggtttgaatcccatctctgcctcgtagtacctgcgtgacctcggataagttacttaagccctctatgtcttggtttcctcatttgtaaaagagaaatattaaagttatctacttcatggagttgttacaaaaattaagttgatatttttaaagtacttagaataatgtctgatacatatcaattattatacagtgttataatccacttaaaaattttaatacacagtcattgtaaataaattaaatacagaagtaattaagaagtaaaagttacccctctttcttcgtcatatcccatcccctaggtagcctgtattttcaaccgaataaaacactgaacatcttcccacgttgttacacatctttttatgatttcttatgattccatctttttatgaatctaactttcatttaaaaagtgctatgaatgtcatgagttcagaataacccaacagtctatattgcatttcaggatattgcacacatgctataatcatagagattactttaaaagattcagtaattctaaagcatattaagaaaactcttctgatattcatattttggagtttgattgagttgatgtttgaaagaggaaaagcttttcatttagtttcccatgagtttagcactgattatattagttcttttcctttaaggcataaacagtgttctaaaaaacaaattgaagataatatgttttgccagctatagacagtttttatttacgctgtttaaagtcataagcaaaacaagttgaaagtttgttgaaaaatggtgactgatatttaaactttatcaacaattattgatataaaacttatttgcatgcttcagaattatctggagtttactatgggccctaatctgtggcatttgacaatgggagcttcaagacgtgacagacagaacacagaaaagttgtagaatttaagagagaagggattttagaattcttttgaacttggcagttctttggcaaattgtatggctgctgcttttccattaactgggatatgaactgtatggaagtatatacagccattgttcatcttatcataacatttgcacatcgaaactaaatagtttgccataatcctgaaacttcaccatagacccaggctaatccagttaaacaaatatggtgtgtttggttgttagggggttggcctggtgggttataaacttttcattttagaaaaggctatagtaagagaaaaatgtaatctacagcagctattatctggtatctgaattcacttgttggcaaattggtccttgcatgtctttgaggcatatggaaattgatgatgaaagtgtctagtgtaactagaaatatgatttgatgaaaactgaagcagtgaactgtgagaaactgttaaaccagtgtcatcaaacagtgcttcaaaaataatgaaacaggaatactagtcctttacgagtaatattgggtaaaaaatgagaaaagcacatggtgtgcacacaaagtttaaatatatgaggtaatgttttttaattactattattataaagaccactcaaaaattctacacccagactcctttccatttatctctaaggagacaatgacatcacgtcttctctaaattattcagactcaggggatggaattggctcattaatagggaatgccatgtttggtattggcacagtacttaaagcttctctccacgttatccccaaactgaaaagcacatttcatgggagccaaatgagttaaaaaatttttcctctagactttaagcactcagaaacacatgagaacaaaaatagaactgcaccataaggtataatcataaaacgtcatagaaggaaaaacttaagaagcaaaaaacactccagtcatctgaaggctagcagttcgtgaagtcattaaaagtcattccatacgggctgagtttgaggaaaagtcagaggttgctttgttcttgactctgagtgaaatcaaaacctacccagactctatacaaaggcaacggcagcctgcctttctcttgctgggtatatgctactaaacacacgtaaatgactagtgttcagaaaagtctgtgattctgttcatattaatccatgtcgcaggctggcaaaatgcctaagtacaatcaaagaagggggtagaagcctgccttttcaaacaggctagaaaatttgtaccaaaagatcacagggcaacagagacagctggaaaaattggagctggggctctgatttttgtgccagtgttacacctaatgcaaagggaatgcagatgatagattgagagttatgtatgttgtttagttcaccagctctgtgcttacacagaggcgaaaatgtaacttttttttaagtaatatcatagtaaacataacatttaaaacaaccttactgtagctaagaattaacacatcagaatctagcaacaagttgctaataaaacaagataaacacatgcaaagaataaagagtgaacggatagctctaaaattagtcaatataaagatgtttcactaatgtcctttaataatcatttctttggaaaagtagtccctgcaagtgttttaacacacatagaattttctgcaagatagcttaaggtgcttaggccacaaggggttttcaaatcaaaggttgttgggacatttgtgattctaaaaagaacattgatgatttttcttggcttttagtagtgattttattcataatgtataataaaaaacaagatattgggtataattctctgtattatttctctgtttgaatggaccttttcattcaaggtgttatttaatataattttgttcagacgaagtgtgtcacccacaactgaaatactgtgtataaaatggagataattgaaagttttattgagatgctgttgaaagtctctggggtccgtgctgattcaggctgcgtttgcaggcttcaacactctgtggcctttgacaggcatgaagaaaagcaagaccaaaacagttctcacaacacagctggtggtcacaaagaacagctcatggagatgtctgtcactgaaaagagtggtctctggaaaagaaccaaaagtaaaagaggtggaaatggagttagaaaaagagagattgaaagtagatgaaatataatatttgaacacttaaaggtaaaaattaaatcctgaaaaacaccagtggctagaatcataggcatatattttctttctctcttttacctccaacagtgttatcaataaaaagagtttggaagtacaggtggtcaatcaaacaattaggtttttaaaaatcttctagaacattctgatatctgaggaaaattgacttataagtcccagaaggaggaatggaatgttcctagaaacaataaacttagtccctcactccattattttatttatttatttatttatttattttcatctttaataaagcaatatcacattttacatattaattatctcatctgattttttttctaaactgtattgttgatattcatgtgcttttatgtcaaaattcttttctttttaggagaaaaggatcttttgaggatctttaggaggattttttgatgactgactgataatattttttgaaatatacattaatttaaaatacatacacacatgtcctgaagcttttttagaaagattaaaggactataaacacacacaaacatatatgtacgcacacataaacccatgcacccctaatatgtaaattcttcaaactagcctggttaagataaaatcataaactgggcttctattctaccattctctcaccactttttttttctggtattccaaataaacagcaggccctaagggctctttgaagtcactagagtgtttagtttagcaatcactggttcatgtagcttatcttttcctggtatttctatgtgatttaatagttccagcctggcccagggaatgaaaacttctgggtctgtttctggaagcaatgcactccccattgccatctgtgataaaccaaataacctttctctgcctcagctctttgcttataatcgtgcctattttgcagcaatggagtgaaacttgacaaagcagttgcagtcgttcaccagtgaagcaaagtcttcttcctagtcacgcaggtatgtctagtaattaattaattaatgaataagtaccaacctctcgatggtgatgttaatgaaatatccaacattaaagtggcaattaattgtcaagggtttaataaaacagatccttattctattagattgggattctttagttataagtaatagaatctgaccctggctaagatcagcaacagaaagtttactgaaaattaacaagattacatcaatcagaaggcttgatgtggtgggtgaaattttccaaagattatcgtactagtatatatcctgtcccacatgttcttcttacagtgtgatattgtctgtacaccattgagaggtgggtgagtttatgttctttgcccttgaacctgaatggacttctacagtacttcaattaaaagagtggtgcagaaatgacacgatataacatcagaggctgggtcattttaaaaaatgataagagtttctgtgttgatctctcttggggcacggatctttggatccctgagctgccatttaagaagtccagccaccctccagcgaccatgctggataagccatttaaaattatgagagatgctcacggggccccacctgttctggtcttcagccgttcgagtcttcccagtccaggcgccagacatttaagcaagccttcaagcccctgcctctgagccaccctatgtgaaaatgaatagaagagaaacaagctgcctctgctgagctgtccctgctaaaaccctgccccagagtgcagtcttgagcaagacagattttattattgttattgttttaaaccagtaagttgagagtggtttgttacacagccatagtaattggaacacttgggtaggaagcaggaataaaagaagaaagagtgagaaagctcggaatcaagaactagagaaatatctcatagcatttgtagtgttgttgtgctactgccaccaggttgactcaactccaaatgtctcttcaatctttgtatcacttgcttaagattcgaagtcctggacagcatatccacacaccaagctgagactgtaaatctaactcctgcttgtacctgagtgatgcagggaagagttggtagaaagagcccccagcagctccagtgactccccagtaggaaggcatgattttctagcacctggatttatcacccccactaagacaataacatggagggaaggaaattctcagaaaagaaattggagtgtttttcagaagggcagatgtaagtcagaaagtaaaaataccagtcagggtccactcagaacacattttattctacttaaataagcaattttctatagtagtagtatccttgaatacaaatgaattgcaagtaaaatgtaccatcttgtctgctaatagtcttcaagataaagtaattcactggagttagaagatattaggctgctctgtttctttttctttttttttaaaaatgatctttaataatttagtatttagcacccagtctataaaatattcacaaacataagacaagagtctgcagattataaaaatacttacagctgccttaaacctcttccagaacaaaattgaggaataaataaataataaattaataaaatactgaaaaatttctctgggtcattgtttctcaaactctagtcctttttcattagatttaacctgttatcaaatgctgtggcccaacacacacatacagaattgcctcaatcattttcaatcaaataagctgctcagcttcttgtaaatgctaataagactcactgattgctggaccacattggaggtttacagcatttgattgaattgaaaggccattgatccagtggcctcatagatagaaaatgtaaagaataatttttctttattgtcattgtgcattcaagtttgaatttgccttagttatttaacaggagacattgctcccttttaaatgatagtataagcagcagtggcaaaatgattcttcatcattgagatttctctatgatattaaacaggagaaataaagagttttaaaaaccatgatgcccttttatttgtagaaaaaacagctttagaagacttatgattttcctaagtatttcaatcagattacatacatttagatcaatatgtactgaaacaatacacccttgctaagaaagtttattattgcacatgcataggatagacttgggaatagaacaaaatgtgacgtattcatgccaatatgggaagtcttatatagtttcagactttgttagtgaaattataagatatatatatgttttaattatatatatcttataattatctctcatatgatttatatatcatgttttatatccttatatctgatatatatatatcttaacagcattaagagtgaaaagaccactatcgttggacagtctcttactgttgttctttcagtattttgtaaaagcaagatttctcaacttcagcactattgaaaatattttgttgtaggaactggcttgtgcattgtaggatatttgacctctacccactagatgctagtagcacccccccagtctttttattaaattggggtcatagatataaaatataaaattttccatttaataatttttagtatgcagttcactcagttcagtggcattaaatgcattcaaattgttgtgcaatcatcaccaccagccatctctagaacatttttatttttccaaactgaaactactctatacatgtttaaacaataacttctcatttcctcctacttgcagcccctggtaactaccatcctactttctgtcactatgaatttgatactctaggtacctcatgtaagtgaaatcatacaatattcgtcctttagtgactgatttatttcactaagcataatgttttcaaggtttattcatcttgtagcatgtgtcagaacttcctttttatagctgaataatattccattgtatatatatcccacattttgtttatccattcatctgaaaatggacacttgagttcttccaccttttggttattgtgaaaaatatggctatgaacatgggtatacaaatatctgcttgaattcctactatcaattctcttgggtatttacctagaagtgaaattgctggaagatatggtaattctctgttttctcctttgaggcatgtaaccccagtcttgacaacaaagaatatcttcagacactgccaaatgtacccttggggtcaaaatggctcccaattaagaaccagttgtctgaagtaacaaacttttgaacaatggtgttaccacaatcctggatttttggtttagaagagacatttgatgagttgagtgaatcatctctgcctactctctgaggcttgtatttgacgaccagaagtgcttgggaagtcaatcacccatagggccacctcaatcttgtcccatcaattcttcattccttaatctcttttagtctactggttcactcttatcatgctacaaacgtttgtgcctctgtatcttctaccttctagtcaccaacagacatcttaacatgctaatctataaaatttcacctcccaataatggattcttcaatcaattaacacctgaaactgctttatatatagtcacctagatttgatcacacactttcttttatctttttgtttgacctagtcatggcaggacaagtttaggagtcatgactcctagatttgagtcctggttctaccatgtgttagctgtgtaaacttacatgattacttaaactctcaggctgtctgatagaactttctgtaatgatgttctatgttttataatttgagctgaaaaatacagtagctgctgttgagcacttagaattggcctgtgtaactcagagactgaatattaaattgtatttaaattaaattaaattgaaatgttaatacccacatgtggtgatatggtttggctgtgctactacccaaatctcatcttgaattgtagttcccataatccccatatgttgtgagacggaccttgagggaggtgattagattagagagatggttcccccatgctgttctcatggtagtgagcgagttctcacgagatttgatggttttataagggacttttcctcccttcacttggcacttctccttcctgccatcatgtgaagaaggacatgtttgcttcccctcccaccatgattgtaagtttcctgaggtctctccagccttgtggaactgtgagtcaattaaacctctttcctttacaaattacccaatctccaaaatttctttatagcagtgtaagaacagactaatacatgtggctaatggttactttttggatagtgcatatctaagaatcagttttctcatctataaaataatgacaatgataatatttgcctccagggatagtttgagaattaaatgagataatgtatgtaaagtacttagtttactacttggaacagcaaaagaacctggtaaatatcagcaataaacttaactagctttataggcaacttacttcaccctctgaaactcagttgttgcttttgttttttaatctaacgctatgtaagatcctctgagtaatggtgtatctaatgatttaggtctgccataagactcatgtgtaggatgcataataagggttccataacgaggatcataggacagcttttgtttgggggatggatttttaaaatcttatttgacctcaatttcaaagctcttggagttatgaaagtttaaatgtctaagacaataaaagaaaatacagggtgaccaaaagaaactttgagtaaactaaaaatattactctataccaaaagctttctaatttggatatcaaagcaagcgtgaaggtttgttgagttgattttgtcgtgtgttaaagtttctgatattctagtctcactgtatccaatagcctgcctctttcccttaagaaaaatgagagttgccatgaactgagtgcctatgatatgcatagtactctcctggttattactgcttatctacaattttgcaaagtaggtattgttatccctattgtgaaagttgggaaactgagccttgggaaaattaaatgagttgtccaaggtcacatgactaaaagtagaaccctgccttacctggctctaaagtttgccatctgtctactacagcacattgcacctctttaggtgagtatattgaaactataatagctgcccaataattagattatccaattagtttataagtttggcttcatctgaatccacataattaatttttctgagttctttccaaagctgttgtcaagtattatgagtgtgtttatttgtatgtttgggaaagttctgctgtgaaggatagaaaacaaattactaagatacagctatcacttttatagctaacatttgttggtaattaatcaaaactaggctctaagtgcttcacctggaatatcactgttagtccttttaacccaatcccatacgtgccatttttacattaattttattgaaaagtaaactggggcacagaggacaaataattcatctcagattacccaactgcaaccaggatttggatccagatactgtgtcaccagcatccaagttcaaaactactacaccatgttacctgctggtagtactaacatgaggattgagcactggtcagtacttgtgtgtgtgcattgggcatacagatttctttagcagcatccttatcataacctttcatactctttttgttgcctcctttgtaatattcctgctattacattactgtcctctagttgactttctgttccagtctcttttatcttctgccaattttactactgggatactaggtaacattagaaagtgtagagttttttttgtcaaaaaaggaaaaaagactctttattgacaagagtaatgagctttcagagcacctggcataaaaaatgattttgtgaattaaataagtaaacaagtccaaatctcagttacttctttattttgccactatagtttgaaatggtaagagcagctacgttgtactgaagctccaatattttatgttctgttaagagagtttagttccaaaagagaatttatgtgattttttgcttttagaaaaactgcaattctcaggactacaatatttaagggtattaatgagaaatatccaagggaaacactaatcatttgaggggaaaatacattttctatgtcaagcaaaaaatattccagtgttgtcagtgagccaaattatgagaattattcagagaccttttttttatagcacttaccagagcagttaggataatctatgccctattgcatcataaggtacgttcaggatttggcatttaagtatgatacatgctaaattgaaaatatgcacttgttaaaaaaagagagtaagaggattcaatgtgtggtttttcacctgtcaggggttatcggaagctgtaattcaggaaaaaatgaaaggaaaagatataggttgcccaatagattaacactacttagtgaacttttaaccaccttcagtggggttttcatttgacaggcaaagaagtgatatactttgacgacaacaatcatggaatccaccataaaggtatttgaacagttccagaatgtgtacaggtcactaagatatgcaaaaaaaaaaaatccaaaaaaaaaaaagagctaaccttaattgtttctattctttcaatactgccaacccagaaataatagaataatgagttggatgctacatgctgaacgacatcatttttaagtttgtatgagaatttacatttatcttaacaaactgccttggggacatgctttgaggctctataaactataagtctctatgtttctgtaaactatgaggagctttcatcagggaggaaattatatataataggcaatatgaatgatatttttatctgatgtcgacattgcaagaaatgtgttgattctaatagagtgaatcatatgaaactgtcaatatttgactgtttttgatctacaaaatgtcgatttcatgtggttcaatctaatattttaaggtgtgagtaaaccacaaagcaaaaatgttatttttgggcttctaacagtaactgggattgcattggaatttgttcaagcttaaagaagctaggatgatttgaacatttttatttcaagaatgtatttcaaagtgatagactgaaaaataaatagaatttaaagtgtactctgacattcttattatatcaaatttgttcaacacagcagacactttcaaaattatcagaaacctaaacaaacaaatcataaatagataatgcaaaacatctaatgattgtattttctgtgtcagtctgaattactattatggtaaagaggagcacaggtggcttttcctttttagaaactctacagccatacaaaggatccttgcctgtgtaataacagggaaatgaacgcaggaaggaaaaaggccgctgacattaggtaatgtttaaaatcctgaccccttgatttgggcatatggtattcactttatcatttaacccatatagagacctttccaagagtgaaaataaaatgactcattaaaatgaaaattacaaaaacaaaggtcagctagttcccagaaattataattagtaaataaacaaattattccctccccattttttattttgaattattttaaaactacagaaaagttgtaaaacaatacaatgattattcacatacccctcacctagattcaccaaagtactaaccaattgttagtattttgttatctctctgtctcttcctctctctctctcttaattgttctattctgacattcataaataagcaaagatatattttaaggatttttcaatactcttcaagtcaggtgtgcatctccccctgtccaccaggttaaccaacatgtcacagattcatagaatgattctgtcattggaaagtacccagttatctcagaaacttactcctaatctagcccattctgtaccacagagttctgaagttcattctttcaagaaagaggaagcagcgatggtaattttatcatttacccacagggcatgtaggtgacagtgatatattcacttggtaccctcagtaacaaaacaaagctccaacaaatcaatttaaagggggaagggattacattatcttcctcctatcaaggcagggtctaagtttcacagcaaaaccctttagggaatttgtgtgttcttctcaccttatctcgtgcctcttctggaataacctgctaattgatttccttgcctcccatttacccctgcactctctaacttatcttgcacacagctgccagcacaatctttagtaggaaatcctacttcgatcctgtcattctcctgaccagaaatgttcaccaatgtcctatgtcaaacaggatacatttctgacttcttaatctaggagtgatgttcagctggtatgacttagtatggttataccagttgttacagtgttgaaatacttccataccacttgataaagagaaatacttaacttactgactctataaatgacctaagaatctagcctagcatcagcttcgacaaagagtaatggggcttgggaatggtgctgacatgaaggtggctggtcaatggtaattgcttagtagacaaaggtaatggaggtggtgccagtggtggtggcctgagcagatcctgacaggtccaagtcaagatatcatctttgttttaggtcttgccttcagaccatatattcagtctattaaaaataagtaaataaagctgggtgtggcggctcaagcctgtaatcctagcactttgggaggctgaggcgggatgatcacttgaggccagaagttcgagaccagcctggccaacatggtgaaaccccttctctactaaaaatgcaaaaattagctgggcatggtggtgtgcacctgtagccccagctatttgggaggctgaagcaggagaatcgcttaaacccaggaggcagaggttgcagtgagccgagattgtgccactgtgctctagcctgggcaacagaatgaaactctgtatcaagaaaaaaaaaaaagtaaataaatgagaaatctgcccatttctcaccaatagcactggtataatctagtccaggccatcatcagctcagccttcacatcagaagagcctcctcctcctctggccagccagggtgatcttaatgcttaaatcagaacacaccagggcactgctgaaagcagcagctccttgagcactgtagatgaatatccacactcccaatcatggtctacaatgccatatgggccctgcctcctctttgcgttcatcttctactcttcccttactctagtcacactggcttcatttccattcctcagttatgccaaacttgcagcccttttgggacctttagcatttggtttcccttctacttggaataaacatcataaagcttgcttcatggttgcctccttctcataagtcaggtctccattcaaagtcagttcttcatagaggcctttcctcaccagcctagacagcctttatctccccggtctctctctacctcatcaccttattttctttattatatcacaggcttattttctatcttcctccactggattctaaatttctaggagttagggttatctattttgttcattgctttatccaaacacaaagaacagcgcctggcctaacgtgtttgttgactgactgtctgattgacaaaaacactgagcacagtgcctggcacttcatatctaggtacctgttagctattttatcgtcacagtattctatgtagttataaatctggtagcctgtcctaatcttttggcttcacctctcttatatttatatcccagcaccagcacagtgcttggcactaaactgatttagtggaatctaactttttattataataaattataatcaacctgttatagaccttggacagagacttcttggagtagctttattcttttctttctcttggctttgactttgggagtagaaagaatcagattccttataaagatgtgttataaatttctcaagttatgcatgttgtctataaagcaaatgttgtaaactggcagcccagaggttcaatatattgctggatgttatttgttttgctcagtggtggattaaagttttttgagggtgcatttaaaaatcaaaagagttcacagtttttcatagaaaaaagaaatcatatttcaggtttttattttaaaggaagatctggacacagcgaactcaatttcgtgcaacaattggccaaagctgagtaacagttgctcacttcaacctgggcatcagcccctggggctgtcctagttaccacctatcctttctcattcatttgtcatctgcctggatcccaggaagaccttgagtttgtgattactattgtaaagaaagtttccataaggggcgtaatttttttttttttttttttttttttttacaccttgctgtgtggaattagaattttcccagcttttcctatccagagtcttggtttcatttgataggataggagttaaagaagaaaatttggaaaaaggcactaacttagatatgaggggaaagagagcagttaggaaaggagcaaattcaggttttatgggatgagaagcttatataattttttggatccccctttttttgtgcgtgtgtgtgtgtgtgttctcctggacttaactttaaaaaaaaaaaatggctgggtgtggtggctcaggcctgtaatcccagcactttgggaggccgaggaaggtggatcacgaagtcaggagttggagaccagcctgaccaagatgatgaaaccctgtctctactaaaaatacaaaaaataaaaaatacaaaaattagccaggcatggtggcaggcgcctgtaatcccagctacttgggaggctgaggcaggagaagcgcttgaacccaggaggtggaggttgcagtgagctgagatcacgccactgcactctagcctgggtgacagagcaagactttgtctcaaaaataaaaaaaaaaaaaggaaaaagaacatataattgtaaatttataaaaaaaattactaggatctttcccagggccttggaagagactggagcaagagaggtaccctgaggtttatgaattattagctctattgtaagtccacccccaactggagtgagaaaggagatggaaagctttataagcaatcgtttagacagtaacatctgtgctgtctgcaatgtccaacatgaaactgaagaaccgatgaagttcaataaagttgatagagatggaagcacataggctttgtgccaaagcatatgttaatttttttcttcattatccacttttttctggatgtaatcctcttcttggatctaaggattcttaaatcctctgcagtctgtttcccaggctcctatgtcagatgcctttggccaatgggagccactggctggagatgagagggtgggagagtttttatccagacctctctctctgggtggcatcttcacaagcagctgcatctcctcctgtttttaggtcttactggataaaccttttatggatctaacttccaataggagactttagcctctgggctttgttcatgggccccttccctttatctctccagcaaagtggtagtagacatttctggttgttgctaatctctgggttacctcactattcccactttgacttttctgctcctctgtcagcagaggagcaaaatgtaatcaattccctgcattacaatcctcttgttttaaatactcagagtggattatttttcttttttcttctattggactctgatgcattgattgatgttgggacaattttgtctagctttattcatacattgttctgatgcttaattctatgatcttacgattcttattaaaaactgtcatttttaatataaagtcttcatgcttttgccaccatgttctttacttcatgaagttgactgtgcttgttggcttgtttgattatttaaaagtatctttgaattacccagactatgacaaacttaggttgtatgagagtgattttcttgtacagatatgcatagagcaacccttatgaatgaaatattgaaatactaaagtatgtcccaaacactattcttataaagtatgtgaacttggtatggatctaatataaaaacatatattagatgatgatataagtagtgtttgattttatgaactttttttatggaaaatttcaaaaatatacaaagtaaatagaattgcataatgaatccataggttatcatcacccagcttcaacaattatcaatactctgttattcttatttcacctatacctccatccaatccctactccctcaccaaaatattataatttctatagttttttatagtaaaattttacacatgaaaatatacaaatatatatacatatatgtgtatatgtgtgtgtgtgtgtgtgtgtgtgtgtatatatatatttaatagagacaaggtgtcgctctgtcactcaggttagagtgcactggtgcaatcatagctcactgtaaccttgaacctctggcctcaagaaatcctcccatctcaggctcccaaagtgctgggatctgccacacccagcctaaaataaacaaaccttagttgtacaagtttgactaatggatgtccctgggtaaccatatctttaccataatacagagttttcaatctcctaagaagattgcctcctgtacccccccaggcaattcctatcctacccgtgaaggaaccacatttctgatattttttaacccttgtattagttttgcctcttttataatatatgcaaacataaaaacatacaacatgcagtgaaatcagaagtatgtacacttctgtgtctggctttatttggccagcatatctgtgatactcattcatgttgtgtgtattaacaattcactcctgttggaattgcactgtatggatatactttgatttctccagtttgcggatctggtaagtttcctggttttgtgtcttttgaataaatttttaatgaatattcttatacattttttttggtgatcatttttctcatgtctctcggataagtaggagtagaattattgggtcaagggtagatacttaacttcatactaaactactaaaacttttttataggtgaattgcctttttactttcccatcatcaatatatgagagttccagtcacgtcacaatgttgcaaatatttggtattgtcatgctttttatattttaccattctactgagtgtggagttgcacctcattgtgatttgaatttgcatatttctaagaagtaatggtattgcatacctttttcatttgcttcattctttaactagtgttttcaagtgctttgcccaatttttaaattgagttgtttgtcttttattattgagtgagtgtagaagttctttatatattcagaatatgtatcttatgaatgtattcttggtatgtgtggcttgcctgtattttattttattttgaagcaggtctcactctttcactcaggctggagtgtggtggcacaataatgactcagctcactgcagccttgaccttccgggcttgggtgactctccgacctcagcctccttagtaattgggactacaggtgcattccaccacacctcccagctagttttgttttttgtttttgtttttgttttttttgtatttttttgtagacacagggttttgccatattgcccaggctggtcttgaactcctggactcaagtgattggtccgcctcagcctcccaaagtgctgagattataagagtgagccaccacaccccgacctgtttattttaaagagtagaatttgaacagcaacaacttttaattttgatgtagtttaatttattcatattttcttttacagatattgctctgtaaataaatctttgtctactcccaagttacaaagataatctcttatattttcttcccaaagctttgtagttttacttttagatttttatctataacccagctcaaattaattttcatgtatggtatgagataacgattgtggtttattcttttccatatgtacaccagttgttccagaacaatttgctgaacagtttttctttcttcatagaattactttggagcttttctcaaaaaataacttattgcctaagtgtaggcttattgctggactccccagtctgttccattatctatttgtctgtccttagccaatatgacaagactacagtctttattatggaagttttaatgtaattatttagtataggaccttcagttgtattcttttttaaaaattgttttggctattataaatcttttgcattttaaaatacattttagtatcagtttatgaatttctataaaaatgcctgaagtgattttaaaagggactgtgttgaagttacatattatgttagggggaatttacatcttaatactattgattctacaaatccataaacatagtatatctctccatttatttagtacttctttaatgtcttggttttcacgtagaagtttttgaatctttattaaattgattcttaatttatatgttttatgccatgttaaaacattctttttcaaatatttgttgtgaatagatattcatttgttttaaaaaaactgacttcatgttgatgtgtctgttggctgcataaatgtctcttttgtgcacatgtaccctagaacttaaagtataataaaaatatgtatatattgaaaaaaaactgactttatatatgagaccttactaaactcacttattagttctattaatttgttttcatggaaacaattatgtcatctgcctacagagacaactttatttttcctttcctttattttttcctacactactatgttaaataaaggagtgaaagcagacttacttttttattttttttttaattttaggggagaaagcattctgtatgtcattagctatgactttttcatagatgtcttatatcagattgaggaagttttcttctttttatttttttatttttattttttttagagatgaggtctctctctgttgctcagactgaagtgcagtggtgtgatcatagctcactgcagcctcagactctgggcttcaagcaatattctcatctcagcctcccaagtcattgggataacaggtgggagccagctctcccagcatttttgttcctcagtttgctgagagtttttatcagtaatgagtgagaaattttgtcaaatgttttttctacatatattaaaatgactgtatgtttttcctttgttcagttgtatgtagtattgtatttattaattttcaaatgttaaatcaaccttgcattcctgggataaactctgcttggcttgatgtgttacctttctgcatttttaaaaatttcctcatatattgttatttatttcatatattttcgggagacactttgatctacaatttttcttctttctttactctttttctttccttctttcttttgtttcctctttcttccttcctctctctcactttctttctttctattgggatatcaggattactattgcttcctagaataaatttagagatgtttcttctttctctattttctgaaatagtttgtggaagataagcattatttctttcttaaatatttgatagcatttaccaatgaaaatgttgagactggagtgtttttgcttgtttatttttgtgtgtatttgaggaagattttgataacagattattttcttagatagaaatacgagtgtccaaatatcccattttatcatgtttgcttctaagttgtgtcttttcaaataattagttgattttattaaagatgtcaaatgtattcatataatattgttaatagtatgcccttattttcattttgatgtctgaatggtctatagtggaatcttttttattattgatattggtattttgtattttttcatgatcaatctttctaggtttaaatttttgtcttaatactttcaaggaactaaattgttaattttgttgattttattcattgttttcaattttattgatttcttctctttacatttgctttttcctacttcatttagattaaattttctttttcttctaacttcttaagattgaaaatatagataaataattgaagcttgtctttctttttactatgaacacttaaagctataaacttccctataagcattgttttaattgcatcttgtcatttctgatgtgctaaatttcattatcattcagttagaaacattttaaaatttccttttgatttctttctttgttgacccatgaattgttgagaactatgttatttaatttccaagtatgtgagactctccaaatatcttgttgttacttaattctactgtggtgagaaaatatactctataaactctacacttaatcttttgaaacttatttattaaaatattattagattttatattttttgacatataaaaatcggtgtgtattcaaggtatacaacttgatgagtttggggataagtatacattcatgaaaccattaccaccatgaaagtcatacacatattcatcacctcccgaagcttcctctcatgccttttattactgttatttttgtggatgtggtaacaacataacaactctttatttgtcttaacaaatttgaagtatgtaatacagtattgtcagctagctataggcactatgctgcatagtaaaccctttttttttttttgagatggagtcttgctctgtcacctgggcttgagtgcggtgacaagatctcgcctcatggcaacctccatctcgcctcccaggttcaagcgattctcctgcctcggcctcccaagtagctgtgattacaggcagctgccaccacgcatcgctaatatttttgtatttttagtagagacaggatttcactattttggcccggctggtctcgaactcctgaccttatgatccccctgcctgggcctcccaaagtgctgggattacaggcatgagccaccatgcctggccgccgcatagtaaacctttagaacttatcttgcataactgaaactttatcctttgaccatcacctccctgttttcccctcccccttacccctagcaaacactattctactctctgtttctatgagtgtgattattttaagtcccatatataaatgacatcatatagtatttttctttctgtgtctggcttatttcccttagcataatttcatccgggttcatacatattgtcacaaagggcaggatttctttcttttttaatgctgaataatattccattctatatacatatgccacattttctttattcattcatccatggacatttaggtagtttccgtatcttggctattgtcaataatgctgcaatgagcataggactgcagatatctccttgcgatcttgatttaaattattttgggtaaatatctagaagtaggattactgaatcaaatggtagttctatttttaattttctgaggactctcaatactgttttctataatggttgccccaatttacatttccatgaacagtgtaccagagttccattttctccatattcttgccaacacttactatctctttttttaaataataataactaatagacataaggtgatagctccttgtgattttaatttgcatttccctgatggttagtgatgttgagcacattttcatatatctgttggccatttgtatgtcttccttagagaaacatctgttcaggtcctttgcccatttttaagtcaggttatattgttttactgctattgagttgtatgatttccttatgtgttttagatgttaatcccttatcagagatatggtttgcaaatattttcccattccatgggttgtcttttcatttattgattgtttcctttgttgtgcaaaacctttttagtttaatttaaccccacatgtttgtttttgcttttgttgtctatgcttttggtgtcatatccaaacattcattgtcaagaccagtgtcaaggattttttttaggagttttatagcttcaagtcttatgtttaactctttaattttgagttgattttttgtgtatcacatataataaaggtccggtttcattcttttgcatgtagatataatttgaccaacaccatttattgaatgagctattctttctctattttgtattgttggcactgctgttgaagattactgaatatgctagattctaggttctgttgtattattgtaaagagtgagttttgtcttagtagatagttaatatggttgaattcaatacctaaattctgtgactcctgtgatcagcaggggtgggaatctatgctcatttatttaagcttctactaaattatcctcctgcctctatgtttttcttgttttaatataagaggacaaaaaacatgctcagaaaactctttatattgagcttgcctccttcagcgtttgagttaatgaatggagagactatggcatatacgatgctgaattcaaatgctgaagactaattcattaatattttattgaataaatatttcttaaacccgctttgtgtcaattactctgcatttttgtattctaggaatacaaaaataaagaagattttcaaggaccttatagtctagtgagtgggacaaccaatacatagattaatataaaggaatataataaatattttaatggagacacagagtgaatttgtaggagcatacaggataggtatctaacctagcctggtagtattaaaacagaaatttttgtttgtctgctttgttttctttttaacttaaggtcttgctctgtcacccaggctggagtgcatagtgccatcataacttacggcaacctcaaactcctgggctcaattgatcctcctacatcagcctcttgagtaacggggacaagtgtgtactaccatggccggatttttttttttttaatgtattgtaaagcaaggtttatgttgcccaggctggtctcaaactcctgggcttaagcaatctgcttgtctcagcctcccaaagagttggaattacaagcatgagccaccacacccagcctagaaagtgtattataaggaggtacaccctaagtaaaaacatggaaatatttagagactacaagaatgaatacaaaatctccatacatttctagcatttttgtaagatattttatttcatttcaactcaactaaaatttactaaacatttactgtgtgtctcacgttgttgcaaacactaaggaagaaaataaattcttatgaagcatctcacaatatacccaaggaaaaggaaggaaaaatggacactctttttacacaaaaaaatcttcattagccatcaccatgacttttttaaaaaatttttttcctaatttttaggtaagaaaatggaatctcagaaaaattaaataacacagataaggttatagagataataactgaaagaataaagactgaaaaccaaatccatctactccaattcatgctatttctaccaattttataagacaatattaagaacaattctaacttcatcaatttctatttcatttctagaaaataaaaatcaatatgtcacatgtacgtagttttaaaaatcaaataattctgactgttataatttaaaaatctcagaataaaaaaacaaaattctcaaccacagagaaacatctaaaatggagaattacactccaaagctcaataatttatgtaagtatttttctagtattaatatagtataatgcttgcaaaatgatgaaacatactgggtagatataaaattctgtgtaagacctaatttaagctatttgtaatgtgcctttaactttgtgttttcagggtttgccctgagattttgctagtttataatatgccattataaagatgtaaaaaaataacagaatgaagccatatggttctatatcagatatctttacaaaataaacaattagcaatatttcaaataattcttgaacacacgtctacaatttcaaggaattaacacaagcaaactagtactcactcactttcatgtcaagaaatattcagagtatatgatttgaaatgatagaacctcactactgggtttactatatgaaatatgcaggatattacaagtgtcattttatctagtagctgagttctgtgacatggaaactaagtttggaccatctgccacactcaggacaccagcaagtcatctcctgttatggctcaagagaaaaaataatacatttcagatcataatggggacacagttaagtccttggttaaaaacaaaacaaaacaaatgtattccaataagagaatagcaagagaaataatgaagtgggaaaagttaaaaatgaccaaatattccaaagtgcattgcacactactttgtgcactaccagggttctagcacacataacaatattgacacttcctaacaaatgtttatgtttcagaaatttgtttctagggcaattgtgtataatcataaacaactttctaatttaaacaaatgctaagtggtgtttcagttctaagtttaggctagagaaactcatttaatagtgaataacttgattgtaacataatgatactgtacaatataagcactattgagaacattcaagaaaacacattctattttctcccttgaaactctagaaatgtattttccttcattgaggaagtagctttagtagtccactaggggtagggagaaaagcagaacaggtttcaaattgggagaacagaggaaattgcagaaggtaagactctggtaggggcagtagaagttgaaacactggatatgactagaatttattgggtggagtttctggaaaagcactttaaagagggctaactgagctttgagaaacacactctttgctctttgcttatcctgccctgagtgcagatgtgatggctggagctggagtggatgtcttatagacatgagtggactttaagtatagaagtcatgcactaaggatgggaaataagaaaggatacacttggaaaattggtaaaagtaggaactgtttttcagcttgacactgcctgcgtttaaacttcatttatgtgagacaaaataaacatgaatcttgtttaagtcactcgtattttggatatttgttcctagcaaccaaatactagtcctaagtgatacaagggacataatgaaaatttattgagaacattctctttgccaggcaaagtgaatctgttctgaggataacagatgaaagacattactcttactttcaaagtgcttagtctatagcaagtaaaccaatgactataataatgtgtgatgagtgtttgtatgttagaggaacacttaggaggaacactcaatctcacttgtggcattcttttagttaaaaaaaaatcttgtgttatttggtcatgatcctgatttagctaaagaattttattatgttacagctgcaaaatacttgtaggattagattcttacttttcatttctcctaccccagtttttttcattttggtgaatggcacccactcacccaatttagattttcatttcacctttgattatttgtctagctgtgaagcagtttcatatatcctattggaagtagttgaggtttttgaatctgtaaattgatatctatcagcagttttgaaaaattcttagccattttctcttcaaatgtggcttctgcttcttatctctttcctgtaccctgaggctcaatcaaatgtgtattaaacctctccctgtctgctctgtgctcaattctgaattttctatccttttgtctttccctgcttaattagtgatattttcttctatttcactaattatcccttcaactacatcaaccatccattgaattcttcattttgttgttgtatttttcaattattgaatttctatttggtttctttgcccatttgtcttgtcactttttaagagtttctgagtctctgtttgaaattattaggattgaacttttcctccttgaatatagttgatttatattctgtgactgaaaattccaagatttgaagtattgattggtttatttttattcgttttacatctgctagtcatgtcttctcatgtatctaattaggtttggttttattcttggcttgatcaaatatttgtagaaaaatgtgtagagaatattatatttctctgtaaaggatttttgtctcagacaggtacctgtgcattagtaattaaagattatcctaatccagtttccatgcctgaaattttgctaggtcacccagatggctaaaagctgggtgccatccgtgcaagtgctattttgccttcagttcacctatctttcatgatatatcccaccagggtgcaaggccaaggtagagatggctcagcagagttcccactcttgccaaactttggactgacttgtatttcctacacttcttgaggatattaaaagtacaactcaacctctgggactcctctcctggatgggcaaatacagggcaaaacccctcaaatatttggctcatgtctctgaattttcatccctttttggatgttagtctattgatttctcatgtatttgttagctcttggattacctttaaaagattttgaaaaaataactctaccttccttagtagttgttatggtcttaatgtgtgccctgcaaagtcatatgttgaaacttttgatggtgaaagtgaaagtgatggtattaggaggtgtggacctttagaatgtgattgagtcatgagagcagggccctcctggatgggattatggtccttatagaaagagcttcggggaataggttttctcttttctgccatatgaggacagtgttcatcctcttttgccctttctgtctcttctgccatgtaaggacaccatctataaagaatgagccttcaccagataccaaagctgccagcaccttgaccttggacttcccaacttacagaacagtgagaaaataaatttctgctgtttgtaaattacccagcctgtgatattttattatagcagcacaaaccgactgagtcagtaattttcatcagtgatttgaataatctgccattatcaaaactagaagtccagttctatcagtatttctataaaccacatcttgagtcaatccacttctgtccacttcaatacaaaccactttgaaaaacaccattatttctacgtagaccactgggatggtcatttaatttaatttccctgtatccttggttgctttcttcattccacagtttctcaatctttgcactatggatattttgggcagaataattctttttggggatggaggcaggagatctgtcctgtgccttatagtatatttagcagcagccttggcctctacccactagatgtgagtaacaccctcccccttccttctgtagttttgagagccaaaaccatctcctagggggagacattgctaaatgtctcctggggaacaaaatcaccctccaatgagaaccgctgttctaatccatccattacacagacaaaagtaaacttaaaatatataagttataagccgtcattattgaaagtcctttaatggctctaagaaaataatttcaaccctttataaagcccttcaagggattacataagagggtttctgtttatattcctaattacatctcttaccaattttctcttcagagtttgttttgcagccacattgacttttctttctctcaaatcttttgacagctgtaggacctttgcatatgtggtccttttgcttttgcccttcatctgtcttctcatcctatagatctcagtttaattaaatcagaatgcctcaaaaccggcattctgttgaatgaaagaatgagtgaataaagcaatttcagttcttagattagatactaccttagaagaggtaccttattcaagaccttcttaacgaaacaagccaaatcaaaatgaaacaaaaccaaaatcaatcaacctccattatcctctgtatcatggcaacctatgattttctactaatttgctgagtcccagaagacagaggtccaaataacacccactgaccagtcatcaggacttttctgctatcttttttccctaatactatccctcagatggttccatgaacttatggccaaactaattgtttctaagaaaattagaaagaaaaccaagttcctctttttttttcttttatattttcctctaccctttttccatatttccacaaactgcaattttaaagcacacattgaaattatacaggcaatgtttctcaatgacagttttattaaatgtgctttagttcattttttaaaaatacaaatattaatttgacttcaaatttatttattttttcctttctaggtctggaaggatgttaactgatagaatttttatttagcctattatttcaagtttcagcatagtgatgcctctgccttaaggtagaagttagtttgattcttgaaatctcagttgaaagaattctggtgaactctattccaatcaccagacattcacattaactaactttctgatggaggagaaacagtctgcaaacgctgaatatggaaggcaggcaataatgcccattcacagtatttttccaccacttctgctataagttaagattgtaacagatagaatattaatttcaataaaagagtttgaaatgataagactgtagtagaaaatattttgaaaccatatactgtcttttcatatgtatagtttatcttcattatttatatcagactatgagaaacagatgcaagatgtccgtagttttctctagggagaaataagtaatactaatgaaatacagattatgcttaaacagataatcaagaaattaaaatttacggcattgaacaactcttggcatggaaatgatctacttgaagcttctgaagaacacgtgtacctgagaagaaatattagatgcactgtgaagagaaaaagagtacttgaattgtatgcttctgaaatgttaagatgaggccttaggaaaatcttgaaatacaaatgagtctaaaccctattttctcaatctgcgtaatatacgtggcattaatcagaatgtaactagaggaacatctgggaaattataattcatttatgaaagagtaagtcaagctctacaaagcaaagggctcgtgacaaacaaatattgtacctaatttttcagcataagaaacaaaattaaaactgacaggtgagtaggatgtggtgtaatagggaaactgcaaaaaaggagcttcagcttcaagtattttctccagttgtgtgatcttggacgagtcatttacttttatcttacttttattattttattatttcaaatgaataaattttatttttagagaagttttaagttcacaacaaaattaagcaggaagtacagagagttcctattaatatatactctctgcccttggacatgcacagacaccacccccctcgcagctgttatcaacgtccccactagagtggtatatttactataactgatgaacctacactgacacttcataatcacctgaagcccatagcttatattagggttaattcttgatgttgtacattctataggttttgacaaatgtatagtgacatatcttcgtcactgtagtatacagatatacagaatagtttcttaatcactgtagtatacagaatagtttcatggccaccaaacttctctgcattctatgtatccacccatccttccttgctctgaagtctgctctgcataaaattaatatgaaattaatatatagctaccccgcctttcttttaattagcattatcatgctacatatttgtcgatccattcacttttaatcaacatatgtctttatatttaaagtaggtttcttgtcaacaacatataattgggtcttcttttttagtccactcttacaatctctgtttttaattggtatattcagattgttgacttttaaagtgattattgatagagttaggttaatatttaccatatttgtttctggtttctacttgttgccattgctttttgtttctatttttgccttccatacttttactcccttttatggttttaattgttttttatgatttcattttctatctttccttagcatgttagttatacttctttttttttcagtggttgccctagaatttgcaatatatatttacaattaatccaaattcactttcaaatactgcttcacggatggtgcaagtatcttagaatgacaaaacattcctaattgctccctcccatcccttataccattgctttcattcatttcacttatacataaacacacacacacacacacagaggcacacataattctaattctatacattgttgatattattattttgaacaaactgttaattgttacatcaattaataatttttttaaaaagtttttattttaccttcacttaatcagtctccagtgtttgttcctcatttaagtagatctgattttctgacctgtgtcacttatctgatgaatttttaacattttttgcaaggtgtgtctaccggcaacaaatttgcctgagaaaatcttttttttttttttttttgagacggagtctcactctgtcacccaggctggagtgcagtggcgccatctcggctcactgcaagctccacctcccgggttcatgcctttctcccccgctcagcctcccgagtagcaggtggctcacgcctgtaatcccagcactttgggaggccgaggcgggcggatcccgaggtcaggagatcaagaccatcctggctaacacggtgaaaccccgtctctacgaaaaatacaaaaacaagattaactgagaaaatctttatgagttttttctttcagtttaaatattttacaccactttcttgcttgcatggtttctaagaaggttataatccttatgtttgagcctctatatgtaaagtgtttttttcctctgacttctttcaagattgtttctttatatttatttactgaactctgtacatgacatgcagaaatttactttttttttcttttgcatttgtccagcttggtgttgtttgagtttccgaaactgtggtttgctgtctgaaattaatttgggggaaattctcagtcattattccttcaaatattgcttctcatcctttctctctttcttctccttctggtattcccattgtgcataattacatcttttgtagtattctcacagttcttagctattccgtctgttttttgtttttttgttgttgttttgttttgtttttgccagttttcagtcttttttctctttgtttttcagttttggaagttgctattgttatatcctcacatgcagaaattttttttcctcagccatgtccaatcggctaatgagcccatcaaaggcattcttcatttctgttatggtgtttgatctctagcatttctttattattctttttaaatttttcatctctctgttgacattatccatctgtttttgcttgttgtctactatttgtgagggggacagaaacagtgttctacggtcctgtgatcaggtcccaatctttgggtgagccaagggccctagactgtgaacttcaccagtgcttctgggttttttttttttttttttatcctcccttaggtgggacaggatggctacagtaggctggagttgggtgtttcctttccataaggttaaaaacccagcaggttaagctctggtgaaatattcccatgagggcatttttccttaatattcactttaaggacctgttagagcttctgggtataattcacaagattattaaggccctcccaggtctgtgacccctggagttttatccctcaggcttgttcacactgaacctctggcagttcatcaattagcttagatttttcttcccaggtatttgtccctgcaaaggtttctgcttgtgggtttctgctctaacacattgagattctctgtatatgaatgtctaatgtctatctccatagttttggaggcagaggtttgccctgtgagctcacttctctcacagatctaataagagttgttgatttttcagcttgtttagtttttaacttgttattaggatggagtgaagagttctaagttccttacatgttgggccagaaactggaagtcagatcatttacgttttaaaggctcagtttcattgggtgtaaatgaatgagtctgtgccctcaatgataattaacttttgttaaaggaaagggccattcagaaaaaaatcatgttataaagacctatttgtttttcattccaaatgaaaattgctttaccgcatctcctggaaactgtgtacatttatcatttagattacctattttgttgaacagagtacttcaatgagaatattagcactgttttttgctacacttttaataactgaataaagaaaagatcagaaaatatggaggcacttttccaatcattcatgctgaaattagatcttaggtcctgtggagaatttggataggacttgttctctgagaacaatagatgctcatcaaatgactatgttcattccaggttaaaaattacataaatgctaaaatcttatgtaatcctaccacccattataaggtatttaaagcgccaggagataagattttggtgctattttagggactaggaaaattatatatgttggagttagagatagctctatagtaagatacaaccagagttttcagaaaatttagagaactgggatgatagttcagctttgtttaacactttaatcggtttctgaaaaaataagaatttgcctatggacaaaaaaactaaaatgagacgtgaatagagaaagccccgaagataccatgtaaacttcagagctcatctggtgttcattagacgtttcagaatatttcagaactgcaaaggaaccttgctttgtcaggatgagtgggcgagatgaaggcatgaatggctcctgggattttcaagaagcggggttcattcattctaagtgttgactggagcaaagggacaaggaagaaaatgatgatcacacagaagtagaacaaccaaaaggatttcctgaagatcgtgggtcaagagaataaagtagatatgagtgtttagggatttaaattgaaatcagttgttgaaaaatttgcttttcacacattgcttatctggacccagggttgcagaggtaaaatgttggcctgctaatctgatcaggccccaaagacaaggaaataagcacctaattatgcaggggaaaacagagatggagatgatgcggacatccaagtgatagggctgttgagtctttgacaacagaaatcctttatgttccccaacacttggggagtgaatattcttctccctaaggaactacctgacttttgctcattatttatttccgtaggttatattatgcccttcatgattttaatttctctatgaagcatcagttcctgaaggaaaacacacaaccccaagcagaagaagagtttcttctttatatcccaaaataccctgtgcaaatctctaccgtggctcttgaaactacatatagcagtgggctcaactttttcgtttttgagcatagaattctcagcagaacatttgaaggcattaactcatatttatcgatgtcactttgttcactgggtagacctttagccttgtgtttctgtttgagaggggacacttcacaccctgatttatacattcaggaggcatacatctgaagcttttcaataaatgcacactttctcaacagctctgcctcaacgttgcttcttttactccctatggtttttatcctgcaatacaccacattgcatgaactattctacttatttgttctcatagtttgtatcctagtttgtaataaataaagttttcaatgtgactaaattttgccacatgcctgtggaagatgcacagtacatcagagtgtcactttgctgtggttgggaaccagtgttctatcaaaattgttgagttttttttttcctatggactatggttaaatgaataaaagattgaacttggtataagatactgtaaatattaaagtctatatatttcaaatggaggaatttaagagactttttaaaaatatgcaatgccctgaaattttagtatttagtttttaaaatctcacaattcttgatttatgccaccactaattttgggaactttcacataaagattttgcagacatgcttgctctttcttccttcattatgttctccactttgtcttttgtttggcacaaactctctctgctcttccctaaaatttcagtataactcagaaggttacataaacttcagcatgagaaacttcaaaatattaaacctcttttttttttttttaaagctgaggaacgtattttatggggtctgcccaagagagttcattattgcaaagtcagttgtggcacctaaataattaacctataaccaatatatgtgtgaaattattgccttaagctcgccttggtgactgtttgccattaaattagtgggataaataatttacaccaaaatgtggacctgagataacaccattaaattgataggacttgttcattaattgtaaggaattagattagatgaaacacaattccccaagtgtgagctatcctgtggtgtaaacggtgtgttagttctatagttgcatagaggaatagatgaagaccctggaattgctcagctgatgcaatatcgaattgagtagggcatttgtaaaacattgtactaaatatacatagaagggggagtgtctgtgaagctttgaaatgactagaagcaagagaaagcacaacatttcttggctaaaaacaaaaagaaataggactatccatttttgttttcagttaatggtaattgtttttgaactctgctggtctaaaatcaccagaggtaatactccccaagaaaatctgattctgtaggtcaagggtaggacctaagaatattcttaaacaagcactgcaagtgattctgatgcaagtggtatggaccaaatttcaagtaacactattcagggtgatttgataggtttaatcaccctgtgggcaaagtccctgtcttgtacagctccagtgttaagcttggtgcctttaatccataaatattatttctccaaagagtactttgtgcctagctctgttgcaaagagtggtcaataaggcagatgaagctttgactgctcagatagagggagaggttttttaacacctcatatttcgcttttcttggcacattctctcaatgtagctcctttccaataattttaaggcaatatattgacatgcttgtgggggctatgataaaaatctgtcaaaagaaacaaatgaaaccaagagttagactgtttaatacacaatggaagcatcagtgctcacatgacgagacaggtaagaaagtgttgtgttgccttctttatgttttgcttcctcacaagccaacagggttgacctcattacctggcttatcctctccctgaaaatattctcctgttgttagaaccaggctgcaccccagcctagtgaagaaaacagcatccaacagatagttttcagtctgatgagtgttacataaaatatgctaaaggagaatacaacgtgttgctatcttaggctaggatagtccagggaaacatttctgaggaattgctgtttaagctgagaattgaaacgtcaatggaatttacctaagccaagaatatgaggggagggatagatgggggggatttcaatggaaagcaaaccgaatgtatggtgagatgacttaggaaggaagcctcctttgtaaaaacagccaaaaaaccagtaaggttggatctctagagagtgttgggaggcaggctaaaaagattcacaagggctagactagggagaactttgcaaatcactgaagttttaagcaggatgactaggcacttagtgaatattgcaattgggtagatttctgaactgtatcaagatgcaaataatctcaaagttcacagatttccttgaaatctgattctgacagaacttactaattttctatccccactcttacatgctcagagaactccagtttatttgagaccagcaacatacctagcccaggggattaatcagaatagatctaacacaatcacatctattttatttgtttgccagctacttattgccccaggctcccttgtgtctaggagtcacacatatgtagacgataactggccaatctgacatgtaggaaagtgtactcagggactcgtattagcttatcactgctgctataacaaattgcagcaaatttagaggcttaaaacacacacttgttctcttatagctctggaagccagaagtctgaaatcagtctccttgggctgaagtggaggtgtcagcaggggtcttccttcttgagactccagaaagagtcagtttcctcacctcttctagtttctggaggccacctgaattcttggctcatgagttctttctcatatcactccaacctcctgcttctacttatctctcctacttctcttcttttgtgtcaaagctctggttgtctccctcttatcaggacacttgtgattatatttaggatccactgagttatccagaataatctccccatttcaatttaatcacatctgcaaagtccttttgccatataaggtttcattcacaggttctgggtactcaaacaaggatatggtggccagtatttagtctaccacaatgcctctgggtaaatttttatttcctgataaccagagatcactctttccagtctctcccctttcttctgtctaggaatttttttgggggagataacttgatgcctggagctgctgctgcatcttatgtaaatgacaactaaggataaaaaccacacacagtaagtaaagaaagagctcagaacccaagtaattggtaacaatgttgagctgctgtaaagaatcataaggaacatgcctccaaattttctgttaggtatgatcattgattgtctttccttttaatgccacagttcattggtattatgacctgtagctgaatacagtagtccccactcacccactgtttctctttccttggtttcagttacccaaggtgcagtaaaagaagatattttgggaggaagagagaaagcaagagagagaaaccacattttcataacttttgttacagtatattgttataattggtctatttttattattattgttgttcatattttactttaatttataaattaaactt

SEQ ID NO: 224 - DNA, 8980 bp, Homo sapiens
tagggcaagtaacatggacattgatacaccaagttccttcttgtttttccttgaaagttggcttgatgaatgtattctgcagggattttaaaggtgtggaaatgaagcagacatcaaggtaatgatttcagcatatgaaacctctgtatgatgtgaaaagacagagttcataagtaaaagctgagagtttggagattaatttaaattccagaacaatatatagtctcactattgctaactctaaaatctggattcaataaacttctgctttccgggtctttaccaagattcctttcttaacttgtatttctgtcttagaagcactcggtcccaatcaaattctattgggtgaatgaatagtgaattatagtaacatagttttcaagcaaaatgtaaacagaatgttaaagaattttagtaaatgattagctttaatatctatcatttatgttgtagatttcattgtaggcttatagtggggatttctcaaacatactaatagtagtattaacctttcattttgtattaacttaatagatgatacaatatattaaaataaattttaaacttcaaattgcttcactctttccaattaaattgtcacttatatttggatagaatttggatggaattttgtgcaaaatttttaaaaggccaaaggcaggaaaaattattccattggatatcataaagtttgcatatttattcagaccttcttaaccttgcaagtctgttaaaagtggtatggaaattgttcatgaacaggcttcctcattagatttttggcacctttatattagtcccagccagaaccctgaagagcaaaggcaaaattggaacacatttatctgaatatttcagaatctccaatgagattacttctaaaagccagcaaagggtcatggggattcttttattcctgctgctgcttctataaaaatctatcattatcgaaattcattatagaaaaaaattgctacctccaaatatgctttatttgtagaaagtctgtgcacaaactttttggttgagtttcaggtctagaaaacaatcttattaaacacggcggccatccaagtgcaatttaaagatcccatggcaattttcaaaaggagcaaggattaatcccaaatcctggccaatatcaataaaactgcttctaatttccacagtcccgtttgagctactgtcaagagcacaatgggtttctccattagcatacatagtttctcactaccaatgtttaactcattactttgtaaagcactttaaagtactttaaaatactccaagtatgaaaacttctctttaaaaacagtcctgtgttgttctgctccatatcagaataacctacctaatccacctgaaataacattaatgattcctaaactcgaagctttacaaaggcgtttttctccaccaattctaaataaaatacatggcaccatgtagattactttcaacccatatctaattaacatgctatggtttatacttgttttttgaaaatggccatgagtgatctaagtcccctccttaactaccaacatcttgataacagaatccacttttgagttatctctctgagagccagtcacattgtatattttaaagtagctacttaattaatatttgggataaaaattgtcatttattgattttttcaaatatccatcccatccatctatctttcttatgtgacagtcatgagccagacactaacgataaagaggtacatttaaattttttttcttcaacgtttatttttaagttcatgggtacatgtgccagatgtggaggtttgttacataggttaatgtgtgccatggtagtttgctgcacagatcatcccatcacctagatattaagcccagcatccattagctattcttcctgatgctctccctccctccactgcgccctcaaaaaacgggttccagtgtgtgttgctgctctgcaatgtgtccatgtgttctcatcattcagctcccacttacaggggacaacatgtggtgtttgtttttctgttcctaaggatagtgacgtccaactttatccatgtccccacaaaggacatgatcttattcttttatggctgcatagtattccatgatacatatgtaccacattttctttacccagtctattattggtggacatttgggtcgattccatgtctttgctattgtaaacagtgctgcagtgaacacatatgtgtatgtgtctttataataaaatgatttatattcctttggatatatacgtagtaatgggattgctgggtcaaatggtatttctgcctctaggtctttgatgaattaccacactgtcttccacaatgattgaaccaatttacactcacaccaacagtgtaaaagtgttcctttttcaccacaacctcaccagcatctgttgttttttgagtttttaataatacccattctgactggcgtgagatggtatcttcttgtggttttgatttgcatttctctagtgattagtgatgttgagctttttttcatgtttgttggccgcatgtatgtcttcttttgagaagtgtctgtcaatgtcctttacctactttttaatgaggttggttgttttttcttgtaaattcttgtaattcttgtaagttccttgtggactctggatattagacctttgtgagatagatagacgacaaaaattttctcccattctgtaggttgtctgttcactctgatggttgtttcttttgctgtgcagaagctctttagtttaattagatcacatttgtcaatttttgcttttgttgcaattgcttttggcatcttcatcatgaaatctttggctgtgcctatgtcttgaatggtattacctagattttcttctagggttcttatagttttgagttttacatttaagtgtttaattcatcttgagttaatttttgtatatggtgtaagcaattggtccagtttcaattttctgcatatggccagccagttctcccagcaccatttattaaacagggaatctttttcccattgcttgtttttgtcaggtttgttgcagatcagatggttgtagatgtgtggtcttctttctgagttctgtattctgttacattggtctatgctctttttgtacccataccatgctgttttggttaccgtagacttgcagtatagtttgaagttgggtatcatgatgcctccagttttgttctttttgcttaggcttgtcatggctattcaggctctttacttattccatatgaattttaaaatagtttttttctaattctgtgaagaatgtcaatggtaatttaataggaatagcattgaatatacgaattacttagagcagtatggaaattttaacaatatttattcttcctatccgtgagcctggaatgtttttccatttgtttgtgtcctctctgatttctttgaacaatgttttgtagttctccttgaagaggtccttcgcttcccttgttagctgtattcctaggtactttattctttttgcagcaattgtgaatgggagttcatttatgattccgctctctgcttgtctgttgttggtgtataggaatgctaacaatttttgcacattgattttgtatcttgagaatttgttgaagttgcttatcaacttaagaagctttggggctgagatgatgagggtttctagatatagggttatgtcagctgcaaacaaaggcaatttgacttcctctcttcctatttgaatactctttatttctttctcttgcctgattgccctggtcagaaattccaatactacgttgaataacagtggtgagagagggcatccttgtcttgtgcaagttttgaaaaagaatacttccagcttttgcccattcagtataatattggctatggggttgtcatatatggcttttattattttgaggtatgtttcttcaatgcctactttatttagagtctttaatatgaaaagatgtggaattttacaaaaggccttttctgcatctattgagataatcatgtagtttttgtctttagttctgctaatgtgatggaatcacatttattgatttgtgtatgttgaaccaaccttgcatcccatggataaagcctacttggttgtggtagataagctttttgatgtgctgttggatttggtttgccagtattttattaagaatttttggcattgatgttcaagaatattggcttgaagttttctttttttgttgtatttctgccaggttttagtaaaaggataatgctggcctcaaagaatgagttagaaaggagtccctccttttcgattttctggaagggtttcagtagaaatggtaccagctcttctttgtacctctggtagaatttggctgtgaatccatttggtcctggcatttttttgattggtaggctatttattactgcctcaatttcagaacttgttattggtctattcgcaattcaatttctctgtggtttggtcttgagagggtgtatgtgttcagaaatctctgcatttcttctagattttctagtttatgtgcatagaggggtttatagtattctctgagggttgtatgtatttttgtggagtcagcagtgatatcccccttttgtggagtcagcagtgatatcccccttatcatttctgattgtgtttatttgatttttctctcttttcttttttattaatctagctagcagtctttttttttttttttttgatggagttttgctcttgtcacccaggctggagtgcaatggcacaatcttggctcactgcaacttccacctccctggttcaagtgatcctcctgcctcagcctcccgagtagcttggattacaggcacccaccactacatccatctaatttttgtatttttagtagagacgggatttcaccactttggccaggatggtctcaaactcctgaactcaggtgatcagcctgcctctgcctcccaaagtgctgggattacaggtgtgagccaccacacccagcctattttattaatttttttcaaaaaaccagctcctggatttgttgattttttgaagggtttttcacatctttatctccttcagttcagctctgatcttggttatttctcgtcttctgctagttttgggttttgtttgctcttagctctctagttattttagttgaaatgttaagctgttaagttgaaatctttctagctttttgatgtgggcatttagtgctataagtttccctctttacactgctttagcagcatcccagagattctggtacattgtctgttcttattagtttcaaagaacttactgatttctgctttaatttcattatttgcccaagagtcattcaggagcaggttgttcaatttccatgtagttgtgtggttttgaatgaatttcttaatcttgagttctaatttgattgcatcggtctgagagactgttatgatttcagttcttttgcatttgctgaggactgttttacttccaatgtgatcaattttagacttagtgccatgtggcaatgagaagaatgtatattctgttgttttgggatggagagttctgtagatatctgtgaggtcctcttgatccagaactgcgttcaggtcctgaatatctttattaattttctgtctattttctcacagtggggtgtcccattattattgtgtggtagtctaatgcctaatgtctcttcgtaggtctctaagaaaacatgctttatgaatctaggtgctcctgtattgggtacatatatatttaggatacttagctcttcttgttgaattgaccctttaccattatgtaatgtccttctttgtctttttaaatctttattggtttaaagtctgtcttctcagaaactaggattgcaacccctgcttttttctgttttccatttgcttggtaaattttcctccatccctttattttgagcttatgtgtgtctttgcacatgatggatctctgaagcaggagaattacttaaacctgggaggtggaggtggcagtgaaccgaaatcatgccactgcactccagcctgggcaatacagcaagcctctgtcttaaaaaaaacaacaaaactgaagattggccacagtctcttctggcttgtagggtttccactgagaggttttctgttagtttgatgggtttccctttgtaggtgacctggcctttctctctggctgcccttaacattttttctttcattttgaccttggagaatcttattatgttgtgtcttggggttgatcttctcatggagtatcttactggggttctctgcatttcctcaatttgaatgttggcctatcttgttaggttggggaagttctcctagatgatatcctgaagtatgttttccaacttggttctatctccccatctctttcagatatcccaatcagtagtatgtttggtctttttacataatcccatatttctcataggttttgttcattccttttcattcttttttctctattcttatctgcctgtcttatttcagaaagatagtcttcaagctctgagattctttcctctgcttggcctcttctgctattgatacctgtgattccattgtgaagttcttttgctgtgtttttcagcaccatcaggttggttatgttcttctctaacctggctattctggctatcagctcctgtattgttttatcatgatttttggtttctttgcattgggttacaacatgctcctttagctcagctaagttcatcattacccacctttcaaagcctacttctgtcagttcagccatctcggccttagctcagttctgtgcccttactggagagatgttgctgtcatttggagaagaggcactctggctttttgagttttcaggatttctgcattgattctttcttatttttgtgggcttatctacctttgatctttgaggtttgctgtcctttggggtttttgtggggtcttttttgttgatgttgttgttgttttctgtttgtttttcttttaacagttatgctattcttccataggactgctgcagtttactgggggtccactccagaccttagttgcttcagtttttccctgtacctggaggtatcgtcagtgaagcctgcaaaacagcaaagatggcagcctgctccttcctctggaagctccatcccagggatgcactgacctgttgccagaaggaacatgcctgtaggaggtggctggagacccctgctgggaggtcccacccactcgggaggaatgggatcagggacccaccccaagaagccctctggctgccctttggtagagtaggtgccaggagacccttccttgcctggaccatttgtattttccaaagttggcaggctggaatggctgagtttaccaaactgcagagatgacagctgctcttcccctgtgagcttcattccagggagagatcagaactttgtctgtagaacccttgcttgtgtggctgaagcccctgcagggaggacttgcccagtgaagaggaatagattgaggtaccgcttaaagaagcagtctggccatgatctggcaaggcagctgtgctgtgctgcagggaacctctccttgctcgaacttcttgtattcttcaaagctagcaggctgaaaccaataaatttaaatttaaataggtaaaaataagtaaataaagataaagaaaaataaattgactgatttattctgccttcaggagctcttagatgatgtaggaaaacaaataatactgtacaatcaaagtcgaaattccttaagcagagggtcttatgagaacacaaagggaaggcaactggagctttacagatgacttcctagactagagatacctgatgtgggtctttagggttaagtcattaatagcaaggccaagtagaggaagagcatatcctacagagaaaaaaagaataagcaaaggctggctgttgagagaattgcaagtgcttagtatgactatagcggtagtctcaacaggagcaggacatccttaggggatgttttgaaaaatttttgtggaattttcttggtcccagtaattagtaagcactattagccttaaaatgataaagggccactgagctagatgttctgcaatgggcaagacaattgcacacaatgaaaaattgtcccaagttcaagtttggacaagttagggatgtccctccaggcatttttgtcaatgaaaaacctctttgtaactgtcttggcatagagcctaactccatatatacatataacacaaaatatttttgcacagttttaatatacactaaattttccagggacacaattacataaattaaggaaagatcatgctttgctgtgtttggaacttatcaagagtcattcaccattctagaaaatagcatcaaagatgcaatatagctcttggtgtctgagttgccagttcagccatctgtgtcaatctgtatttgtagatattgcagtcaaggtgatattatttttaagcaaaagtgtctgacaactttattaagttccccaatgtagctgtgccatagcattttagattattttaaattgtatattactttccttttatttttcctctaatgatagatacttagggcattttttttaaaaacccaatgagaagacaggttattttatctatgagtttcatttcaggatagtaaaagtgtattacaaaatgctggttgtaacaacggggacattaggttgcaaaggacagaatgggctggtatgtcagtagcatctctttccccaaagacctcagttgtgacatgtgaaactctaattgctatgtgatgtttccagttgtaagggcctgattatggtttaatgcttgctggaaaaataaatgagcaaaatcaagttaggagaccacttatttttccctgcatgaaacattttaatgtgactttacacttatatttccctggctattttggcaacataaaaggcccagtctatatcaaggcccaagtgaa

SEQ ID NO: 225 - DNA, 9740 bp, Homo sapiens
tctcagtctaccttaaaagcctacctatttggctttcactagagttcagatacataaaacaaatatctttgctttggcttcccttgagtcatatcaatctacacctcatcaagaatatgaagtttggaagaacaaagaagcaattgagcatcctaaactcaacggttagttttggtttttgggaatgtcagtgaaaagacttaaggttgttttattaatcacgttttgttggtattttctgtggctagtaggaatttgagtagaaaaagttgtcttttctgttgtcaataagaaaaatttatacctaccaatgccaacttttaaatttagggtttttaaaattacacttttataaaagaaaacacttatccaggaaagtagatgtcaattaacattttaaaagattgatgtgtttgaatattaagaaagccaattacattttggtctgtcagttaaagagatttttctgtgtttataatataatatttcaaaacctagtttagtgatatatttgtatatggaaagattaacagcttgaaaattatatcttcatgaagaaagaaagaatagagtgctttatttaaaagttatagcttttcaaccaaatctggaaatactatatctttgtccacctctatcaagaatgaaggaaattctctgggtagaaaggccttacaaaaatttcataatctctaagttaagagtatgggcaattagagaaccaaattatcaagatggtcaccttcactatctacttgctctttatatataagtactttgatgtggtcaaaatttctacttctaaacttagtttaagatacttgtatggtcctagaacaaatttcttgtacaaaagaagcatctgtgaagcattaaaagggcaattgccgaggccccatccccagagactttgattttggtcctgaaatctgtattgttaacaagggctggtagttaagaaacagtgtcctagactggaaggggacatgaagatcatctagcctaacccacttattttacaaatgaaatggttgagatcaagacagaagtcaaagccaaaatattgttacttattcattcaaaaaatatttaaggggcacccatactcgatgcatgaggcactgagaatactgtggcaaatatgacagagtgagccttgcctttataatctcacggggagtcagggttcatggcagaagtaagataatgcaaactgaattatgtcctaaatcagagttcctgctattctaatatgcagcttttgccttagtttgggttatcattacaatccttgagaaagacatatcatcactacaacgtctgaaactgcaggcaaggggaatgtcatagaggtagattttaccatgggatggccctcacagtttacttttaatttttataaataattttacaagtaaaatatatgaattgtatattcttttaaaataattcttatccttcagatttttcccatgttcttgaaaagtctgttacatttgcaatagttataattccttactggcttccacctctgaaaagttttggggttacgttgaaatgttgacaagggggaagcacttgccccttcaccatccccaacttctaaaactcacactggggctaactcacattgtgagccctaagcactgtcaagctcaatcttttgcttatgttgcttatgatgggtaaggcaagctcatctgtggtcaagcttatgtaactttacttataaaaaatgtattgttttgttttgcatacagtagggcaagtaacatggacattgatacaccaagttccttcttgtttttccttgaaagttggcttgatgaatgtattctgcagggattttaaaggtgtggaaatgaagcagacatcaaggtaatgatttcagcatatgaaacctctgtatgatgtgaaaagacagagttcataagtaaaagctgagagtttggagattaatttaaattccagaacaatatatagtctcactattgctaactctaaaatctggattcaataaacttctgctttccgggtctttaccaagattcctttcttaacttgtatttctgtcttagaagcactcggtcccaatcaaattctattgggtgaatgaatagtgaattatagtaacatagttttcaagcaaaatgtaaacagaatgttaaagaattttagtaaatgattagctttaatatctatcatttatgttgtagatttcattgtaggcttatagtggggatttctcaaacatactaatagtagtattaacctttcattttgtattaacttaatagatgatacaatatattaaaataaattttaaacttcaaattgcttcactctttccaattaaattgtcacttatatttggatagaatttggatggaattttgtgcaaaatttttaaaaggccaaaggcaggaaaaattattccattggatatcataaagtttgcatatttattcagaccttcttaaccttgcaagtctgttaaaagtggtatggaaattgttcatgaacaggcttcctcattagatttttggcacctttatattagtcccagccagaaccctgaagagcaaaggcaaaattggaacacatttatctgaatatttcagaatctccaatgagattacttctaaaagccagcaaagggtcatggggattcttttattcctgctgctgcttctataaaaatctatcattatcgaaattcattatagaaaaaaattgctacctccaaatatgctttatttgtagaaagtctgtgcacaaactttttggttgagtttcaggtctagaaaacaatcttattaaacacggcggccatccaagtgcaatttaaagatcccatggcaattttcaaaaggagcaaggattaatcccaaatcctggccaatatcaataaaactgcttctaatttccacagtcccgtttgagctactgtcaagagcacaatgggtttctccattagcatacatagtttctcactaccaatgtttaactcattactttgtaaagcactttaaagtactttaaaatactccaagtatgaaaacttctctttaaaaacagtcctgtgttgttctgctccatatcagaataacctacctaatccacctgaaataacattaatgattcctaaactcgaagctttacaaaggcgtttttctccaccaattctaaataaaatacatggcaccatgtagattactttcaacccatatctaattaacatgctatggtttatacttgttttttgaaaatggccatgagtgatctaagtcccctccttaactaccaacatcttgataacagaatccacttttgagttatctctctgagagccagtcacattgtatattttaaagtagctacttaattaatatttgggataaaaattgtcatttattgattttttcaaatatccatcccatccatctatctttcttatgtgacagtcatgagccagacactaacgataaagaggtacatttaaattttttttcttcaacgtttatttttaagttcatgggtacatgtgccagatgtggaggtttgttacataggttaatgtgtgccatggtagtttgctgcacagatcatcccatcacctagatattaagcccagcatccattagctattcttcctgatgctctccctccctccactgcgccctcaaaaaacgggttccagtgtgtgttgctgctctgcaatgtgtccatgtgttctcatcattcagctcccacttacaggggacaacatgtggtgtttgtttttctgttcctaaggatagtgacgtccaactttatccatgtccccacaaaggacatgatcttattcttttatggctgcatagtattccatgatacatatgtaccacattttctttacccagtctattattggtggacatttgggtcgattccatgtctttgctattgtaaacagtgctgcagtgaacacatatgtgtatgtgtctttataataaaatgatttatattcctttggatatatacgtagtaatgggattgctgggtcaaatggtatttctgcctctaggtctttgatgaattaccacactgtcttccacaatgattgaaccaatttacactcacaccaacagtgtaaaagtgttcctttttcaccacaacctcaccagcatctgttgttttttgagtttttaataatacccattctgactggcgtgagatggtatcttcttgtggttttgatttgcatttctctagtgattagtgatgttgagctttttttcatgtttgttggccgcatgtatgtcttcttttgagaagtgtctgtcaatgtcctttacctactttttaatgaggttggttgttttttcttgtaaattcttgtaattcttgtaagttccttgtggactctggatattagacctttgtgagatagatagacgacaaaaattttctcccattctgtaggttgtctgttcactctgatggttgtttcttttgctgtgcagaagctctttagtttaattagatcacatttgtcaatttttgcttttgttgcaattgcttttggcatcttcatcatgaaatctttggctgtgcctatgtcttgaatggtattacctagattttcttctagggttcttatagttttgagttttacatttaagtgtttaattcatcttgagttaatttttgtatatggtgtaagcaattggtccagtttcaattttctgcatatggccagccagttctcccagcaccatttattaaacagggaatctttttcccattgcttgtttttgtcaggtttgttgcagatcagatggttgtagatgtgtggtcttctttctgagttctgtattctgttacattggtctatgctctttttgtacccataccatgctgttttggttaccgtagacttgcagtatagtttgaagttgggtatcatgatgcctccagttttgttctttttgcttaggcttgtcatggctattcaggctctttacttattccatatgaattttaaaatagtttttttctaattctgtgaagaatgtcaatggtaatttaataggaatagcattgaatatacgaattacttagagcagtatggaaattttaacaatatttattcttcctatccgtgagcctggaatgtttttccatttgtttgtgtcctctctgatttctttgaacaatgttttgtagttctccttgaagaggtccttcgcttcccttgttagctgtattcctaggtactttattctttttgcagcaattgtgaatgggagttcatttatgattccgctctctgcttgtctgttgttggtgtataggaatgctaacaatttttgcacattgattttgtatcttgagaatttgttgaagttgcttatcaacttaagaagctttggggctgagatgatgagggtttctagatatagggttatgtcagctgcaaacaaaggcaatttgacttcctctcttcctatttgaatactctttatttctttctcttgcctgattgccctggtcagaaattccaatactacgttgaataacagtggtgagagagggcatccttgtcttgtgcaagttttgaaaaagaatacttccagcttttgcccattcagtataatattggctatggggttgtcatatatggcttttattattttgaggtatgtttcttcaatgcctactttatttagagtctttaatatgaaaagatgtggaattttacaaaaggccttttctgcatctattgagataatcatgtagtttttgtctttagttctgctaatgtgatggaatcacatttattgatttgtgtatgttgaaccaaccttgcatcccatggataaagcctacttggttgtggtagataagctttttgatgtgctgttggatttggtttgccagtattttattaagaatttttggcattgatgttcaagaatattggcttgaagttttctttttttgttgtatttctgccaggttttagtaaaaggataatgctggcctcaaagaatgagttagaaaggagtccctccttttcgattttctggaagggtttcagtagaaatggtaccagctcttctttgtacctctggtagaatttggctgtgaatccatttggtcctggcatttttttgattggtaggctatttattactgcctcaatttcagaacttgttattggtctattcgcaattcaatttctctgtggtttggtcttgagagggtgtatgtgttcagaaatctctgcatttcttctagattttctagtttatgtgcatagaggggtttatagtattctctgagggttgtatgtatttttgtggagtcagcagtgatatcccccttttgtggagtcagcagtgatatcccccttatcatttctgattgtgtttatttgatttttctctcttttcttttttattaatctagctagcagtctttttttttttttttttgatggagttttgctcttgtcacccaggctggagtgcaatggcacaatcttggctcactgcaacttccacctccctggttcaagtgatcctcctgcctcagcctcccgagtagcttggattacaggcacccaccactacatccatctaatttttgtatttttagtagagacgggatttcaccactttggccaggatggtctcaaactcctgaactcaggtgatcagcctgcctctgcctcccaaagtgctgggattacaggtgtgagccaccacacccagcctattttattaatttttttcaaaaaaccagctcctggatttgttgattttttgaagggtttttcacatctttatctccttcagttcagctctgatcttggttatttctcgtcttctgctagttttgggttttgtttgctcttagctctctagttattttagttgaaatgttaagctgttaagttgaaatctttctagctttttgatgtgggcatttagtgctataagtttccctctttacactgctttagcagcatcccagagattctggtacattgtctgttcttattagtttcaaagaacttactgatttctgctttaatttcattatttgcccaagagtcattcaggagcaggttgttcaatttccatgtagttgtgtggttttgaatgaatttcttaatcttgagttctaatttgattgcatcggtctgagagactgttatgatttcagttcttttgcatttgctgaggactgttttacttccaatgtgatcaattttagacttagtgccatgtggcaatgagaagaatgtatattctgttgttttgggatggagagttctgtagatatctgtgaggtcctcttgatccagaactgcgttcaggtcctgaatatctttattaattttctgtctattttctcacagtggggtgtcccattattattgtgtggtagtctaatgcctaatgtctcttcgtaggtctctaagaaaacatgctttatgaatctaggtgctcctgtattgggtacatatatatttaggatacttagctcttcttgttgaattgaccctttaccattatgtaatgtccttctttgtctttttaaatctttattggtttaaagtctgtcttctcagaaactaggattgcaacccctgcttttttctgttttccatttgcttggtaaattttcctccatccctttattttgagcttatgtgtgtctttgcacatgatggatctctgaagcaggagaattacttaaacctgggaggtggaggtggcagtgaaccgaaatcatgccactgcactccagcctgggcaatacagcaagcctctgtcttaaaaaaaacaacaaaactgaagattggccacagtctcttctggcttgtagggtttccactgagaggttttctgttagtttgatgggtttccctttgtaggtgacctggcctttctctctggctgcccttaacattttttctttcattttgaccttggagaatcttattatgttgtgtcttggggttgatcttctcatggagtatcttactggggttctctgcatttcctcaatttgaatgttggcctatcttgttaggttggggaagttctcctagatgatatcctgaagtatgttttccaacttggttctatctccccatctctttcagatatcccaatcagtagtatgtttggtctttttacataatcccatatttctcataggttttgttcattccttttcattcttttttctctattcttatctgcctgtcttatttcagaaagatagtcttcaagctctgagattctttcctctgcttggcctcttctgctattgatacctgtgattccattgtgaagttcttttgctgtgtttttcagcaccatcaggttggttatgttcttctctaacctggctattctggctatcagctcctgtattgttttatcatgatttttggtttctttgcattgggttacaacatgctcctttagctcagctaagttcatcattacccacctttcaaagcctacttctgtcagttcagccatctcggccttagctcagttctgtgcccttactggagagatgttgctgtcatttggagaagaggcactctggctttttgagttttcaggatttctgcattgattctttcttatttttgtgggcttatctacctttgatctttgaggtttgctgtcctttggggtttttgtggggtcttttttgttgatgttgttgttgttttctgtttgtttttcttttaacagttatgctattcttccataggactgctgcagtttactgggggtccactccagaccttagttgcttcagtttttccctgtacctggaggtatcgtcagtgaagcctgcaaaacagcaaagatggcagcctgctccttcctctggaagctccatcccagggatgcactgacctgttgccagaaggaacatgcctgtaggaggtggctggagacccctgctgggaggtcccacccactcgggaggaatgggatcagggacccaccccaagaagccctctggctgccctttggtagagtaggtgccaggagacccttccttgcctggaccatttgtattttccaaagttggcaggctggaatggctgagtttaccaaactgcagagatgacagctgctcttcccctgtgagcttcattccagggagagatcagaactttgtctgtagaacccttgcttgtgtggctgaagcccctgcagggaggacttgcccagtgaagaggaatagattgaggtaccgcttaaagaagcagtctggccatgatctggcaaggcagctgtgctgtgctgcagggaacctctccttgctcgaacttcttgtattcttcaaagctagcaggctgaaaccaataaatttaaatttaaataggtaaaaataagtaaataaagataaagaaaaataaattgactgatttattctgccttcaggagctcttagatgatgtaggaaaacaaataatactgtacaatcaaagtcgaaattccttaagcagagggtcttatgagaacacaaagggaaggcaactggagctttacagatgacttcctagactagagatacctgatgtgggtctttagggttaagtcattaatagcaaggccaagtagaggaagagcatatcctacagagaaaaaaagaataagcaaaggctggctgttgagagaattgcaagtgcttagtatgactatagcggtagtctc

SEQ ID NO: 226 - DNA, 51574 bp, Homo sapiens
ttggctatgtcaagaacattctcaaacaaggtacgtttaatgtatacattttagagttggaaatgaatggagagaacatctagatctacaccctcatttttcaaatgtgaaaatcaaggctcagggaagttaaataacaaatccaacacttctagattccagtccctgatcatttccccaccctaaatataatctggggtggggagagggagagagacacttaaaccagggttacgagatttagcaaataaaactacaggaagcccagttaaatttgaatttcagtaaaataacaaatactttaaaaatataaacatgtcccatgcaatagttgggacaatgtttgcaacatatttatactaaataattattctttatctgaaattcaaatttaactgggcatcctgtatttcacctggcacctagtccaatcaaataagcaatgccaaatttctaccttctgaaaaatatttgaaagtgtcaagttagaatgtggcttaagtggaaggatagaaaaaaaaaaaaaaaaagaaagtaaagaaaaaccctgagtagacaggaagaactcaggtgaaaataatcaatgactagaaatgaagttaatgaaacccaagaagaataaggaagaaagaagaaaaggaggaaggcagaaaaaaacagaccccctagaaggtgatgctctctccttcatctgaatcagcttgacaaaataatgttcaacctactgtctttttttgcgtcccccattcgccacttgtccttcctgctccagtgttactttccctgctatatacaactaccttccttcttctctgctaaaattgtattatatttaagttgtaaattttaagtcaaagccatacatttagataatttaaaacttaaagagtactgaaaagcttaaaaagaaaagctctagtccttttccccacctctaggttcttttgaggaacctaaattagggtagccagatttggcaaataaagatacaagatgctcagttaaatttgaattgcaggtaaacaataaatacctttaaatataaacatgttccatgcaatagttgggacaatgtttacaatgtacttatactaaataatgattctttatctgaaattcaaatttaagtaggtatcctgcattttatctgtcaaacctaccctaaatcaaataagccatactaagatttctgtcttccaaaaatatttgaaaaactacttttaaacttcgtatctatttcaaaggtgaccagcagttcccttttccccagaactgaagtgtttcctgagatgggggactgttggtggtaaaaccaagacagtcttaaataaacatgtattattcgttggtcacctcatttcttatgttaaagatatttccatctcactaaacaataaaccttatttttgcttatcagtttgagacattatcgttaatttcctactttgagaagtgagtatctgttttggttatttttaaacggttggtacaaaaccgtttccacatagcacaagttcaccaatttggcctaaaagccttcagagagtagcttcagagagaatgtgttttctctaatcagagaaaacaagaattatgttgtgtgagtgtcaagttgccattttattgtcccactgaaatgctttcccccacctaggaatccttttaaattttcttaactttaattgcctttttccccccacaaagaagtcaatttaaattaaacagaatccatcactgtgataattttttaatgagtaaagataatgtactctacagaaattgaaataaggtgttcccaggatcatttgcgaagtctcacaaagtcctcctaagagtcagctgaaattaatgaatctcagtctcaggaccgtcaatgccatgtaactgagggctaggttcaatggaaaaaaaccacacacaataataatagttacactttccaatttgagcatttagctcctttcgttccaagatcctgaggaattttataaacattaattaagctcacaggtgtgatttattagattaactcactgatagacatcaaggactttttaataaagctggattaaaaagaggaataaattaacatcccaggaagatttccatgctggggtggagcccccagtattggagggaaggtcaagaaaagagatgtgctccttagctcaaatttcttgaactaactctggtctcaatacatagtgacgacagtttgatgcgtcctaatctccattgaaaaataccccctccacagcttatttgagcttctctttattgtttcatcctcattcttccactgggtttcaaagacaaacaatggcttgtgaaacaggtgaccttcagttcaacaagagaagtttctatgctttgtggaaatctgaacacatgtttggtgatgcttttagggtagaagaggtagtcgtggtactgatccaaaaactaggttttattttataggttactcaagcccttcttgggtggagggtagggtagggaaaagatttttggtcctgtattgtgggcaatatgttgtcctgatagattcctttgtcttaagaaggcaaacggctgcaaattaaaataaattctcaataatagttttcaataatagattgagtttacggagatacaaagagaatttccattatccaccctgtgaattgaagggatggattagcaaggataatacaagaacagtaaactaagtgatgttttattgtcttgttttagcaagtcctgaatcaagaggggatcaaatgtgaggagattggggaattggaaacccaacttctcataaggtatgagattctaaaatagagctagaaccctagactttaatctttttcctccaggataagcaaattcaatcccctcactatacagatgatacatttgagttctggagaattaaagtgacttgaataatttaagaaagctaattagtggcagatccaggatgtgagcccatgcctctctcctaattcctgtacctctgctataaaaccacatggacatgttggctctttccttctaacattacattggctgaaagcattttctggagtcagaaacaagaagcaagtttgcttatctgacagacataaaacaaggggaacaattagtgtagctttcttgggaaggtgacagtgattttaaaaaacagcctattaaatatgcaaagcaatggaggaaggcagccaaatgtcataggtaatccagaaggagaataattcacctttgggcaacagaatttgctattatctgtaatgtttaagccaatgttcaacatgagatatcaattcccacatttttagctatctaagaggcttagatggctatattcttagaaaaaaaaaagggtaacaggaattataatatttaaggaaacactaggttgatcttgggagaaagatggaaatagtaaaggctcatgaataataatagtaaaggctcatgaactctggatttgaagaaccctaagcagaaattccatctacaatccccctagcaaataaccatccaactacagatcaactccacaaaaatagggaacttactaatttaggtggcaggcctttccttgttaggcaggttgtatcataagcatgctcttcagtacactgagccaatatgctgctcccctatgataactgtcggtgaataactgttgttctatggttcagccctacaaatatttgaggtctcttattttccaggttgtactgaattttctctattgattccccttcctgaacacagtccatggtccattctctgccttgtacgccctagtataggttccaggaagctaaaccttacagagagaaacacaggctctcttgccacctgattctcatgtgggtttggtcgaggaaggaccaagaggaacttggaaatcagaaggaaaaagaggtagggaatttccttcttgctctttactggtgtctacatttttggttgtgtttatgtccttttgtgactatggttcctgtccaatagtccttcctccatgaatcccttaaccttgtctacacctttgtaagcagccacttcattaaagtcccttgaactatctgagctggattccgtttcctgctaagactcttgttgatatacaggttaaagaagcattctctgtttctggaacttctcctcaattaacatgtttttcggacattctcattattttggctgctttcatttggtcacagtctaattgttcaagtcctgcctaaagagtttcatccatagtgtgggccacagcatttcatatttaatctattagtgcatcactttaatctcccttgccaatgatgtcctttctctattaattcatgttgtatctttcttttcttttttttttttttttttttttttttgctatcttacacgggtgcctcacctggagcttgcattcaatgcaactcctagatcttttttttttttcatgtgatttttctattaagccaggtctctctcatcttccatattttgctccttgtcaggagactgaattatttaaaaggcctggccctggtattaacatgctggtcctgaatggtgacagagcacagggacacactattttaaaaacactgttaggaaagaacattttagtttctcttgtcctagactctgtttgttctcagacactgtgtcataaaattttcatggacattaacttcctttgacttccacggccttgtctctcctgggccctgtctcttcttgattgtcttgggttttgttaactactttttctttttctcctcctttagtttaagtatttcccaacattctctctaaggattttgccacttctttgcagaacaaagaatgcacacctaccaaagggctactttgcactcagcactgagtaagtcactttccaatcaatcatcccaaaaaccatctgaaatatttgtgttcttacttgatcgatgaggaactttaccttatgcagtgaagaatctaagaagagagaggttctacctcagagaagtgagccagaccatgtagatggtgggctctcagggcaggttggccaggggatccgtaatgacctctctgtttatatcgctacgcagtaaaaagagatgaatctaaaggaaacacgttgtacgtgtagatagtagaatggcttcccaagagggacactaagttacctttattgctattactgaccagcattgtcattttataagtagatttgtctgagcgccttaatggtaatatagctgggcaaagggttgattacttatatttcatgagaatagatgattaaacattctcaacctaaagaaatgttattatctttattacattaatattttgttaaagaaagaggattacagcattatttacagttactgatctgtggattaataggaaacactgctctttaaatatagtaataacatgttagttaccaagaaaactgaggcctgagaggtagagaaattctgatgaacataaacaaattgggtataagaatggaaagcaaatcatttttacggcaaatgcatctgagcaaacctggaataatactattttctaattgtcaataactgtcaccccttgattacagatgtttataatacataatagaaatatatactatatattgcccattaaaattggcaagcaaaatagaagctccagtatttcagaatttcttgaaaagaaaattgggggaaggggagaatacacacacatacacacacacacacagacacactcacaaaataaaacatattatgccaagcccacactgtaatttatcaactgggaaggaaattggcatgtcttttcctgctgatttattggttaattccaacaattcattgtagaaaaggccaccaatgaattacagtgtgggaaaaaaattaagcggagcatttagaaaggtgtttcagaatacagcctttagaaacaacttacatagctattttatagccagtcccaaagcaattggtgcatgtgaaatgcagtatacagttacagaaaatacaccagaaaatgccgtgcataatgcttcccatatttagaagaatatgccatgtcacatgaagattagatttctcctttatctttaagctagaatcatgtaacattagatctctcttactatttgttgtagaaatcatgttggaagggcagtaacaaacatgaactatgttagcaaagtcagtgatggacactgctttagtgatagagacattcgtcttttagtccaaaggggatagaaactttcatggggtggaacaaaatgctgaaattttgcattacaaaaatcaggatacactaccatccatcctgtgtcccagctctaaccccaaggatctaaggctaatagaagaagggaatttctccattaacaattccatttctaatttctcaaacctggtttaatcagctggttgcccctctttgttttcaaaaaggagtctctgaaatgattaaagatacgtgtgatggttaattttatgcatccgcttggctgggtcttagagcacagatatttggccaaacattattctagatgtttctctgaggtttttctttgtttttgttttttggatgaggtttatatttaagctggtagattttgaatgaagtagattacccttcatagtatgaatggacctcatccaatcagttgaaggcctgaatagaacaaaagactgacctccctgagcaagagagaattctgtggcaggctgcctttggacttcaactgcaacatcagctcttccctgggtctcccacttgacagccttcgaacttgaactgtagcatcggctcatcctgggactccaatctgccagaccacagcagattttggacttgccagcctctataatcacatgagccaattccttaaaataaatatctctctccagacacacacattttattggttctgaataatacactcttcatagtcttcttcttgttattattcttcagtgggaaaggaggataagagcaagtatatactgagtgcttactatgtgccaaacattatgtttatttatttacttgtttatttttagagacaccattggctcctcacaatatctctatgaaaaatgtattatctctaacatatagataagaaaaaggagacccaaggggattaagctactttccagtggccacatatcttgtgtggagcctctgtggagatgtctgactccaaaatctatatatattacgtttatttgagtgagtactttttctatttttatgctgttttctcatgtgacatgatagatactgctagaagcacatctatatactaaagtgctcctttgtagagtgaaaaccaccatttttttagacctactatgcactaggcactgtgccacttttcctatatcatctctaatcctcattttaaccctgtcagcgaggtaaaagcacttctatttgacacccagggccactgaggcttagagaaatcatataacagaccccaggttacacagccaagctggggttcacccctgggtttatatgattccaaaatccaccctgttaactcctacactatgcctcatgctcatttcctaaggattctgcatcagtgtgtacccctaaatcataacccttggttttcagacaaaagagcttccatgttgtcgaatttttttctcactggctcaaggaaacagcagaagggtttctatcctgcagcatgctattttctgaatggaaaagaaaaaaaaaaaccagaaatgtttccaaaagaaagtacagaatatgtgctataaattctaacatggtctttctattgacagcagagtctagggttgcctgagccacaacactctactttatgttgcagcagcagagacttcacagcaggactccttaagtctttccggtttgctcctacaaagtgatcaataagcatcctctttcccttttttttgtcccttttggttgtgtttacttggtctaaaaaacaaagaaggggaaataagccccttgttggggggttttcccttacttgccctgtttcctaatcacaccaggacgttattgtccaaagccacattcacatttagaaataaaagagaaatggaataaaacttcaagaaaaagatacgaaaatgatgctgcaataaacgtgaattcctgtggataggcaaaatgtggatactccttctggatatttgtaaatggacagagaaacctgtcttgcctcagaaactcagaagcaatgatgtgcttcttgatgtatatgcctctgtagacttcaggaaggtgagcccattttttactgagggagagtgacagaaatctatcaacctggcttatcatcccacaattacagcaatttatagtgtgcttcttgcaaggtcacctgcatctgcaaccaaacaaaagcactctctctgcctttgtttcaaagcgacctaatgtgctccctgcaacttaagttatccaggatatttttcaattaatttgcagtcacttagccttagcatcacacaagcctggcatatatcacatttttcattggctggaaataccggagtgtctcaacccccctgtttcagaagaactgcttttcctttttcttttaaagtcacttcattcagcttttttttttctcttgagttaaggaacttgttgtgagaaaaaaaaattctttgtaatttcaagaaggagttttccattctgataagctgcctatatttttctatcaccgcccgaaattgtctgaagcaattaaaagcatggctaattcttctgaaaggaggttgaaacctctgcattccgaaggagactcttctgatacagcatcgggcaccagagtctgggtcttcaacccccagtgggaatgtgtggagacaaggactgaaatttttaggtcaaaaatgcactcatggacatttattataagagaacgaactagaattcttagtagtagggcctttccttctccacccttgtctgtcttcagtgttttgctttccagaaaatctttttttatgacaactggttgcagtgcccgcctggcctccctgtgctgctggctccagtggcaggagcttctggtctgttttccaaagcgctaaactcatctgatcattttccatctcacagtgcaggttctcagagactcacaaatccatcatcctgttgcccttcagatacgaggagaaatgtgtcgttcaaacacctccttgctgagaagctttttcaatctattcgacccactggggccacaaggaaggttttactttttctcttttccaatccccaaccccaccactgtcctgccccactgttcccctgtcccccccacccatttcaactttgactcgctttctctgtgatttttttctgtcatcttctctcagcgctttgtggggcagtgtagctgtgtggtttggaggcagtatgggctataatgtcagacccatctgaatgtaaatcctggcttcgtgactgaacttctgccttctctgtctctccatttgtaactgttcctccttcacagcaaaggtgaactcggatatggaaagtgcttagtacaagacatactcacatatttttaacaaacataaatggtagaaattaatctttactcaggcacttttcctctaatctcttttcttcctctgctttttgttttatttgcgtttttgtgaaatcacaggttgcatgccctgttatttaaattaaaatacttaccactagtgaaatggatgccaaaaatctgggaaacaaagcacactgtgcaatgtatgagttttacagtggagaaaactgacacccctggacataccctcaagatcagagctaggtttcttttcctctctcctgggtcttgtcagatggaggcaataataggacagactgttttggagtgtctaggattggcagaccagctgttcctgtgaaatgtaattggtgccacagatctggatgagcaatgaatgaagtccagggagttaagtaggcagggctggggaaggtgggcagcatcatgaggtgggcagcatccggttgctgaagtaaatcttccttccctaagccaagatgagcagacctaaggatgctgattccagggagcaaaatgtttgctctcatctctgttatttcctttgggttatatgcactcctagctccatatgtgaccacagtagccagaaactttgcatatttacaagcatacacaggtctgcagacaatctatattgctagttagatccaccagaagccccatagatgacttctcagtgtctgtggatactaggttaagaactccatctaactctcaagtagttactcatttactagtttttcatagacaggttaaaatatcccaaagactttctaatgtcctttcccattaatttataccaatcacatgacctcttcttgactaatttcacttctcagagacatcaaaaagataaaaagtatattctggctgaaggagaaatgtgttgccagacagtataccaccatgccctatgcctgtgcatggcatttttccttgctgaatttggatcagactcagtaccttttccaccagctatccaggtatttttctacaaattgattggagttgtcatgtgaccatgctcacctaaatttcatttattctactattcccaacttcccatggaccaaacactaggccatatggctagttctacccaatgtataatgagtagaagtgatgtgtgtcacttttgggcaaaggcaattgaaagctgatgtgcttcccccatctactctttctttattgtgacgatcttagaggtcatgtgttccaggatgcatgacttaaaatggaagatggctgctgtttctgaaccaaacttggtctctttgcccacgtgcaacagaaagtccaacaccaaagcacgaagattttgtagaaaggcttgttgtgggttgactggcaaggagacaggagacaacacccaaatctgtcctactgagctgggtggtggggcaggttttgtaggtagagggtagtgaggcatggtctgattggatcctgcaatgaagtgatgctgggaggtgtgatctgactggatcttaccagagggtgatgccagggctcaatctgattggatcatggatcacgccagcatgtggtgttcacgtcttaactcaatccctgttccttggtccaagtacctaggttccgccagtggctgtgcacttcactcatctgggtatgctcaggttacataacttgcaacgtgggttccatggcaactgaaaaacaagtcaccattttattacacaaaattgaaccagattaggctggttctgcaggtacactgccccatgtgtgcaaatattttatatgatacacctctattgggaagcaccactgagctttaggctttgtccattggagcagaagaatcagacctaatctgacgagtaaaacacgtaagatagaccttctttgccattcctcctggttattgaaaaggtaaagcagcaagctttaattaacatggtcagctgtgggtaaacagagtcagctttctggatccagagtgccaaggactcaagtctggaggcatcctgtgtccatccatacttgaagttctgactgcttcccttgatggattcctctctttaatttcaataggactaattttcacagatgaagaaatgaggccctgtgagctaaaatggtttgcccaagtttatatagatagtggattagggggtgagctagaaccagactcctgactcctgacccaggaattcttccctctccctgttgttccatttccctgcctcctgcctccctccatattgatgatggggtagcaaagggggttccagccatagatttgcttcccttgatagtatggaataaccagcaggtaaccacagtgcacacactctaaattacaagatcattagccttaggaattatctttaaatctgcaaattctgcctcctaagaaggcctccttgttttttttaatcctaccctaaactagtcattgagtttagcaagcaaagatcctcatcgtagcatcagacatgactttccctcctccttgattgattgattaattagttatgcgtacttgggtccagcagggagcccagtgacagctgtgacatgaaaattaccagaaagttacaaaaatatgtagcagtgttgacttgctgaaatgtagaatcagggattgattagaaacagacacgtataacgatcacgtcttgaaattacctgtcactactgaggccttgagaagaatccttttggttaggatgaattattttagttcctatctaatcacctgcaaagaaactagtgaatattctctattcttattttaactttttttttttggtctggaatcctagagtttagaacaacaactcctgtagagacaaaatgatttttgaaaaactcaaaacccagtcacatcattccctgcttaaaaatcctccaatggtgtcccattgctcttagaaataagacaaactgctgaacatggtctttaagggccccatcctgttagccttcagcttcccctcagcctcatcatgtattccctttcctgccctctggccacactgatcccttcagttctcaccacagcccacactcaccacagggccttggcacatgctctttcccctttctgaaattctctcccttatcaactctttgttattcttcaggtcttatctcatgtcaccgtattgagagtgccttctcttatctcctgatagatcacatctctctattaaagactcttttggtatcatgtgcctcccttcatggcactgtcacagctataattttaccgtgtgtgtgtgtgtgtgtgtgtgtgtgtgtgtatgtatgtatgtatgtttacattcattcagagaattaaattttttcccctaattagaaagttaagttccacaaggactgtgccttgcatctgttttctgctttcaatattttccccagcagtgtgttcccctggcacagagcaggccctcaatttatatttgatgaataaatgaatgaatagttaattgactgaaaactatcgcctggtataaatgtagtagaaatcacaaccaggcatttttcttgaacactttgaaaaaagacagtgcataagcagacaagaatcttaaaagaacccaaagcttagtatgatttctaagcagcagatttcctggtgcacaaataaaacagcaactaaaagttccacccttcagatttcaccagtgtgattctcagctggtttagcaaacctgaggcattcataattcagaagaatctgaaagttgtctggtatcttgcatgttcaataaaaggatcacttttatgctcaacaattttttatggctgcaatactgctatgagcaaagggacacatatattaataatgttcagttgcatcagtcagggtcccagcaggaagcacttggctctctcaaaaggtattaactagagaacatttaatgaagaaacaatttcaatagacatgggcaggcttcagggaacgaacaaagcatggtgaagcacccaggaattagcaacaattgggagctgttactgtcccagggcccggaaaaacaagagaagggaatggcgttagagaaatatgatgaaaatgggtgctctagagaggggctgcctatctggagctgttgccatcccaactgtagccatagaagaatgcagccactacccgatccctaaagggagcagcagagacaaggaggaataaattctggaacatctgtcttttccagccctacaatctactggcaaacccaactggaagccagaggtgaggaagttggggaatgcagtctatagaggtcagtttctgtgggccccgagcaagacagagaagtatgaggatggatttatgaagggataaggagggcaaagagaaaatggccagcatgccttttatttatagaacacttactacgtgtcactgttttaaattctacgtgtattaattcaagcagtcttcactgtaacctcatggggtaagccccaatatttttcccctattatggaggaggaaactgaaacataaagaggttaactaacttgcccaaagccacacagcttgttagctggtgatgaaactaaaatttaaacccaggcattccgacaccagagccattcacttcaccagtatgtgagacttcagaagaagaattctaatttcggggtgaagatttaaggctgtgcttgtgccaggaacaaatcaccagtgcagggggcctggaagaaacagactcaaactttttctcagtactagaataaatactttagagttcgggaaaaaaaaaaccacacaatttattattatacatcaggatttttttttcagtaagttgatgtttggggttactaactactaactgtagtggccatattcaaatatataaacattcattaggcaggatgatgaaggatttaattgaagcttaactcagaaagaaaaatatctgcaagtgtgtcagcaccatctagccaaatattcatattagggatggagttaaagaattttaagtagaaggaaagaacacatccaaggtttgtaagtctcatattcatccctttgctccacgactttgatattttatccagaagtgagtaacactgctaatatctgatgtaagtttgagagttgagtctgaaaacaaaataacatcaatcatatcttgttgctatattaaataacttactgtttttaattctttttgctgtacttctagaaaatacagatacacaaaaggaaaaaaataaaaaccaactacaattgtatcacttagtgaaaaaataactgtgcggttggaatgtcatcctagtcttttttctgtttgtgtctctgtgtatttacaaagttgagatcatattgaatgtattgttttaaattttattttacctatagtgaaatgaaatttccatgtcatttttccttattactaataatgaggttttcttttatagagatagaccatattttgtctactcaaccctctaccgctggacatttaggttgctttcagtttttatggtaaacagcatgctcacaaccaaacatttgtacatataattgtagagaaaataaccatgaagttatatttactttttctatttgaacattccagacaccccttcccaaaagacagggattttctttaatatttggatgtcttacatagttagatttggaggacggcaggcctgagagaatttgatgaaattggctcggctcaccaatatacatcagaagctttaatatacgctctaaaatacggttacaaatatcaatttctttcttagttaactgaagttaatagtggataattttcttaaagaccctaaaattttgttttgaaaaagctcaggtcagaatcatctttctgctgggaaaaaaaaaaaaaaaactacacacagtagactgagcatttttagttaaggaagtgtggctaatgaaagcagacctctttgtttcatttgccacatgatgcagtagctagctgtattaggttgccaagaaggaaaaaaaaaaggctcacagacctgtaagtctataaaaagaatgtatcatgtactgtggtggcttctatctgaagtcctgaaggcatttttagatgcttgagcagttcagtcataagatgaaaggactttgatctttcccgctaacttagcatgaaaataaatttaaaaacttggccctttatgataatagcattaattctaagcaaatgcactggcaaaattcagagacactccagcattctaaattataaagtaaaatatatgggtggtggcgaaaggaggaagagatctaatttctcaatcgaagggagagacatccaattatcaaggcaaaggatactttaccatttggtataaacgctgagaaaaggtgtccctcccagatcctggtacaggtttcctgtttgtggaacagggctcaggctatctgtatgctactaattactacatttcattccatttcctcatttcaaagactctctgtcaaagtcttttagaaaagctttgcttggctagccactatttaagatacaaaatgaggagcatgtcttcctccaagaaaagtaaaataataaaaacctactgtgtgctagcttttgtatgaatcatgtccttaagcctataaggacaaaaggagaaagaattgtctgagaatcccagagctaaaaacacatcagcctggtcacacagctagaaagtggcagggctaggtttttaataaagtctatctgaccctaaagctcatgatattttgaatacactaggtataccacatagtaacatatgtagatgtacaccctattgtaatatagtattgtcgcagacatttgatcttcatttggctgtctcgcatttgatcatactcctccccaatttctttttgggtggaagtcctctttgaatgttgatttaatgggaaggcagttcttactacctcccactatagaagtctaggagatcatattccttttcagcgcccctggtacaactgggaaacagtgaccaaggtgccagtgtgattcttattctcagaactttggctgtttggtgactcagtcagagggaacgttcagaggttgtgtgcatcacagcagtaggtgtggcttgaggaccagacatttccttcgataagacatagtttcctctccagcccccagagtcacttcatgttggtgtattttctatgctaggtcctccagcctcccattgattctgtgacttgcccttccttccaataaatcctcttgctaagtagccagtgttggtttctaaggtttccaaccaagagtctcaagagatatgagttttttagactcagtaacaggccagaaaataaccatgaacctttacatggcactgaaatctataacatagtttcaagggaccctctgcaaattattgctgggatattaacagcaatatatccattcagatcaataagaagtagacaaattattagggccaagtatggtgttagtgattaccttcacactttaacccatcatattggggctgtcccccttgaccacttagaattttacaactttaagggaccccagtgatcatctagactaacaccctcatttcccttttatgaggccactccctcatcagccgtaagaaggatatcactttctctttaccctttggacttcagtattcacagtgtcacttccaaggcttccattgtcccttttgaacattagtccaaagttattaagcttaatgcacagttgcttaatgcatagagagtgacaaaatggtcacagagggaaatctatgctcctcatttattttgttttgtgagactttactttcaagtggcctttcctgctaagtctgaggaattttatttaaaaataataatgaaaggaggggaggaatatatcatcaagaaaaaaagctgagataaaatccgcaaatcatttaaatgatttagaatggcaaaagataactaactgaaaaacagagaaaacagcaacagttcataattctacctggcagcctaaggcagcctgaaatttgtgtctgacaagctgtcacagaggctgatactcttgggaacgccttattaggagtttactatgaaatgattatatgctccagttaaacagtctgcatgtgtccgcagactgcgatggcgatggcgggtgcacactcaggagccaggcatgctgggaacgggaaagccaaagtttctgttgacaacagcaaaagcgccaggactgaccaggagaggctggttgagatttggcagctggtactcataaaagcagttgtacagttcgaaacacggtgtccaaaggatattgtaagcttagaagcagcgagagaactgtttgagggaggccagagttgaaactttcaggaaggaaattgtaactgccaatgaagacagaattcttccctggatcttgagattgtagagcatgcagaaagattccactctcaggctgagggtctaagaaggggttagcaggctatcagggacccagacagtcagatgagatccaagtcagagtttttgtcctagagacagatggggtgctaaggactgtaggccattggattcaaactccatattggccactgattaggtgactggctttggtactatttaatccctttgaacatgagtgtcctcatctgtaaagtggtagtaacaacagtgcttacctcatagggttgttatgaggattaaatgaaagaagcatataagatactgagctcatagtaagtgtttaagaaatgttagctattatattagtggggaagactaaggaaaggggtataattgtaagtccttaagtctgtagtcttggaggaggaaatattataactcagaggctttaaagacttcttgggttatccctgctatgacagctaatgagcttgattgaccatataatctaattctaaagcctcaggctgtataaacttcctgctctatttctaattaacccagacaccgggaaaaacttgaggctgctgctcaggtctgtcaggaaaagcagaagagacagacaagtcaaaagtagaccccaagtcagggctctaagttgtgccactatcatttttgtctttggagataaaggtagctttgatctcattgtttcaaatggataaccacactaatacctcacctgccacaattagttctaacattttatttttgtattacaattcatatctaattttaatacatggtcatgttagacaaataaatgtcatcttccccaccaacgtgatactggtgggcaatgggttaaaatttctcatctgatttgttgactgagctgggtgaacttgatcaggcaatttgttaagagagctgaaatatagtcaggaacactcttggcttagggtttgcatttgtgttttcttttatcttttccccagtcataaatcttgaatgggaaagaaagtgaaaagggaatgagggaaaaaaaaatgaatcatgcagagggatgtctcactgcccatgcatccatcctctgagctgggcagcagagattacaaatcaatcatactgtgcaaatcaaaagtctctcacagattccacaaaggaaatcatttcagaaagatattcttaggattctgttttcctcaaacacagttggtccagcatgaatgggctctactcagattaacatggcattctggtttgggaatcaatgagacacgatggaaagtatgacaattcccatttatggtgttagatgaaaatgacagagccaggagtcagaatcctgtagaatccttagtctacctgacttgctgccactctgggcctcagcatcccgatacataaaatgaaagagtcagcatgatggacagcaaatcgtctctgaatcctttcaggctattatttcacttgatttgtatattattttacctgatttttctatgtttcccattcaaagtaggtgtgtccttttaattaaggtctaaaaagtatatagttgaatttaattctgtttagtcttaccattttggtttttaagttgtagtatttaaaacacatatgattcttgggtttatctttatttattgactgtttgtctcacttgttattttctttccccttctctttcttaacttcttttgggtaaatccaatgtttgcagtctatatcttgaagcaggctagttatactttagttagttagaaccttgttagttataccttcttttagtaacatacagccttgatttatataaaaatgaatatttttagccattcacagataaaacaagggctttggaatactttatctccatttactcactttgggcttttctgttattgttattacgtattttaattctgtgcatcttaagccccccaaagacatacttattgttttgtatgttcaatagtcatttatatttatctaactatttaacctttacttagttcttcattccttcttatattttcacagctccttctaggatcattttccatctgtccattggtgtttctttcagtctcctaatgatgagttcactcaatttttgcctgtctaaaaacatcattatttgaccttcagttttaaaaatagttttaccaaatataaaattgcgttaacatttttctttcagtttgttttactgtcttctgacttccatcatttctgttgagaaggcaactgtaaattttaatgtttctattttaaaagcaatacattaaaaaaatctctggctgcttttttgttttcttatttattttctttcggaaacattattattctgagcttaggtgagaagatttttctgctgtggtttggtgtatattttttgtttctttgtttccttggttgggttttttgcctgttgctcttttgaagttcatagggattcttgtggccgatgtatttgtcagtcttgggaaatttttacgattatcctttcaaaattttttttatttttctctgagcttttcactatgtcccatatgtctctatgatctttcctattttctatcattttagctctctgtgctttggcctggatattttctaccaatttatcttccaatttagtaatcaacttttctgctatgtctgatttgctggtaaacccatctattgagtcttaatttcaagtttcagctattatggcttaattccataacttctattttgttttcaaaataaaggccaggtatctagtgaaattctccatattaacacctgttttcttgaatgtattaagtccaactacattaaagtctatccctaataacactaagaaatgtgtcatctgcaggtctgtttctgttgtcatttttttctcttggttctgttttttgacataccgggatatattttttactaatagccatatattgctaaaataagtattagaggcacttaataatgccatattatcctacacagagttgatattatccttcggtaagcaaatagaatggtagcaggctcctttaagccacatgggcactgagctaattccaggatggattccagttttccaaaattatgtatctagtttgtccatgctcctagattgtcatcctcagggttttccaaccaatattctgacgtatctagtagggccccctccctaaagtgggtcccaagtactcgagtgtcactttttttttgtcttcccagaaccaagagaaagtagaaacacgtgctttattatatgattcttattctccttttctgtagaaccagcaaatgtcttaagggaaaacaggcagagatctgggcttacttctttcttctaatcagaatcttgcctccacctcccccaccccatcaccaaattctggctattgtggcagttccaaactctaatttttggctctgtagccctgtgagattgccaaattttccactgacttctctgccttttaacagaagctgtatgtcctggccctctgagtgaattcttggcttcccattcaaaaatcaacaaatgccctgaagaaaaaaagtggttataaaatctctctgtgatttccttctcactggcatcttagcatttcaagattatttacatcagcagtttcttgatgggctcctcttcttatttaaacaaaattaatctgatttttatggtcattctcagaaagtgtattagtctgttactgtggtggtaacacatggttgtaaatcctttttgatcccttttgagaggtgagatctttgacccctatccttaagtttgggcagacttagaactacttcaactaatggattacagcagaattcataaatggccattcaacatctgctttatgctgctggaacacttgctcttaaagccataaaacatcatcttaaaagtctacttggagactgccatactgaattgaccacagaggtggtcttgtgaacagtccaatctgagcctgttctttagagatcccttccaagttccatatatacaagagaagaagcatcatggaagtcagtccttcagcctcagctcttcttgctcttcagctgtttgagcaatcctagctgaggctcaaggagacgtcaaggagtagagaagagccatttccactgtgttttttctgaattcctgatccacagagtttatgggcattataaaatggttgcttttttatgtcactaagttttggggtgatttgtgatacaacagatacatgaagtatccctaggtattccaacagagccagacacagaagtcacataaaatttacttgatttttttttcattataagagaaactatgaaccaaacttgaacaaaagaatggaacaagaataggattgtaaatagatgcagaaaatcttttatagtcatatctggtttaacctgagaaattagaaaaaaaatggatttttttttctttttgcatgccatcctctttgatgtactaattttcccactgcttccatatcagattagcccttcatcaagacttatactctttgtgaattacacaggtctttaacttcccctcccttcatttcactatacggtctagtgaaaatataccacctttgctcccatcgcttcagaactgtattctctgcttgccagctgttaaaccaaccatgaattagaggaatctatgaatcacggaatcttcagtagaaataaatacgatctagtctaactgccaaccctacgcagatattcccatccctgagaggttgttacctagctcatgccaagcaatatatttcttttagcaaatttaaattagggaatttcaagaaaatgaaagccaatcagcaaaggatgtcacaagagtgattcagtaatatctaccatgaaaaaggtgttggaaaataaagtcgaataaaacacagtcattggcctcaggagcataacaatttttcaggaaataaacataccactaactattctataatgttatgtgagattaaaatgcaccaagaacaatgcattgaaaaggaggaaattattctagttaagtatatggggatattctgggaaagtcccacagacaaaatgacatctcagctgtgctttttcctcggttgatgtagtttccaggttcttctgcattctgattgccaccattcatctggacactatctagtttttcagtctctttggaaacacaatttccctaatattacttaaatagtctacaggtcaagggacagtcacaccccttgagctgaatgtgacacctctatttatgaaacctaagatttcatcctcatttttatcagcaaggtcatattattggatccatatactgcttaacgtgtactaaaatctctagaattttttccacatgagttattttgaaatcaggtttttatgctgttcatattttgaatctgcattctcaagactttatattaattcttcatttgaatccagtgtttcagcctctagagaattttgttgtgggggaggagacaggatgggaaggtctgatctcagattctaacaaatgagctagcttttctaggtctgtgtcagctgcaaatttaatgagcaaaccttgtgcatctttctccaaggtggtgattaaaaatgttgaccaagacacaatcatgtaatccgggcttggacaatcatatattaatgcatttctcctattaagtgacttatttgcattttaacagtggccttctggagaacagatacttttacccaaataaatgatgaagatgataggaatattaggcatcatagaagtccactttgggagattattattagacgtggggtcccttctatgcttctcaaatcagactatctgggatgccttctatttattccattttgaggcctctccttcattcttaaactttcctgcacactggaatcacctggagaggttttaaatatacagatacctgggccccactcccagagtggtgctgcctacattttgggtgtttgtgaagctacccaggtgattctactgttcagtcaacgtagaaagccactgcttttgcagaaagtcatcaactgcagaagaaagagtataaggttagaggtcaaagtgggatagaccccagctcttcgtgtaacagttttgtgatttggacaaattgcttaatctctgaattctactttcttatctgaaaattagggctaataatgatctacaatgtgtttaaaagagatcatgtacattacctctgttcatagtaggcaaatagtgactgtcatcccttccctctgtttttcctaaagtcccctaagttggtctatagaacaaggtcagcaatagctgaagagcagatttgacacacgagctctcatctctggtgttccttccaggatcagataacttcacctttgatgacctatggctgaacttttctgtctcatagaatgatttaacatcatttaaatgcacaaatgtagcttagctgggaaataaaacatatattcgactttaaattgccaaatagaaaagaaatgtttcattttcaaactgtggctacggaagaacatgcaactgctcaagtttcatcaataagcctttcaaatgtttccctgtattctcagtttctcatgtaagacaacttttcattaatataggacttttttgaggtggaactcagcaagaaaaataaatactagataatttttttagctattctttttggaaaatcctaaccaaaatactagctaggtaaaataaaagtttttaacatccgaactattaaatgattgtttaaaagaacttcttaattggaatgaggtacagtacatgtaatacaaattcatgtgttgttttccaaatgtgaaaatatatacctagaagtcagagtaaagcattgaaatatcactaaaattttaatgtcatgcaagactattgttccattttcattctgcttccagcccaaagatacaacagtaatttttaaaataatgtgaacaaacaagcttgagtttatctcatctcatctcctttccagtcttctctccatgcttctcatctcacttattgtaaaacatttattgagatgctagtgttcattaggcattacgaatatcacgacaaatgaggtaagtgatcccagactttgaggaactcacaatctagtgtaaaaaataattaaaacccaacatagttaatgacaactgaataaggtgtgtagtctagttagcagtattgtaccaacgcgagttttccagttttgattttgtatcatagtcatgtaagatgtcacattggaggaagctgagagaagggtacacgatactatttatgtaacttttggtgtaattgtaattgtttaaaaataataaagttttggccaggtgcagtagctcacgcctgtaatcccagcactttgggaggccgaggcgggcagatcacgaggtcaggagatcaagaccatcctggctaacatggtgaaaccccatctctactaaaaatacaaaaaattagccgggcgtggtggcgggcacctgtagccccagctacttgggaggctgaggcaggagaatggtgtgaacctgggaggcggaacttggagagagccgagatcgtgccactgcactccagcctggacgacagagcaagactctgtctcaaaaaatgatgataataataataataataataataataaagtttcaaagaatctaatatagtagatttttaaataatgtcctactaatgtaggacagatgtttcaaggaaactgaataaggagacattatcctgtatgagggaataagggaaggctttgcagaggaaatggcataaaatccggctctgaagaggtaattcaaaatgtccgtggtgttttagttgcccgtggcttctgtaacaagtttctacaatcttggtggcttaaaataatatgaatttattcagttacagttctggaggccagaggttcaaacactagttttactgggcttgagtcaaggcatcagtagggctggttccttctggatattctaggggagaaacagtttccttgccttttccagcttctggaggcttccacattcctcagcttgtgaccccttcttccaatcactccagcctcttgtttccattatcacatttcctacctcctcttttgtagtcaaatctccctctgcttccttgttataaagactcctgtgattacatttagggcccacctggattacctaggacgttttctccttcttaagatccttaacttggcggggcacggtggctcacacctgtaatcccagcactttgggaggccaaggcaggcggttcacctggggtcgggagttggagaccaacctgaccaacatggagaaaccccatctctactaaaaatacaaagttagccaggcatggtagtgcatacttgtaatcccagctacttgggaggctgaggcaggagaatcacttaaacccgggaggcaggaggcagaggttgtggtgagccaagattgtgccattgcactccagactgggcaacaagagcaaaactctgtctcaaaaaaaaaaaaaagaaaagaaaaagaaaaaacccttaacttattcacaactgcaaagtcccttttgccatctaggttaacactcacaggttccgataattaggacctggatatcttggagggtacctatttagcctaacatatctgccatggtagtattccctgaggtttccaattgtgaaaaacaacttgtacaattgagggatggtgaatcattggtcatatttggggtattgggaagggaagtaatgggctatacagttagcaagaacaatatatcacagactgggtggattaaacggcagaggtttatttctcacagttctggagtctacaagtccaagatcaagctgttagcgggcttatttctccacaagcctcactcctgggcttgcatatttctgtcttctctccatgtcctcgcatggccctttcttggtatatgcacgtccctggcgtctttgccttcttatatggacacgagtcatatcagataagggcccacccatatgacttcagtcaaccctatctcaacagtcacatgctgagattcctgggcttagaacttccaacatacatatttgaaggggacacaattcagtccctaataattgggattaagttttgagtaactttgtgacctggctaatgaccttgatcttgaaagttatagtaagccaaaggaggcttttaaggactggagtgacaaaaatcagatcgtttgttagttttttatatcagtaactgaaaatggaaacaaggaagtagtaacttgcagcagggagaacaggtagaagcccggtacagtacccaagcaggacatataaaaggaaaggtgaggcaaagcgtggtggctcacgcctgtaatcccagcactttgaaaggccaaggcgggcagatctcttgaggtcaggagttcaagaccagcctggccaacatggtgaaattccgtctctactaaaaatacaaaaattagccaggcgtggtggtgggctcctgtaattccagctactgggagactgaggcacaagaatcacttgaacccaggagctggaggttgcagtgagccgagatcatgccactgtactccagcctgggcaacagagtgagactccgtcccctaaaaaaaagaaaaaagaaaaaaaaaaaaaaaggaaaggtgatgtttgcagaatcctaagacaagggtaatagatatagcagacttttgcctgttttctcacaccacaaactcatggaatcttgaataaaatattataacaaactactctttttgccacatagctgaatttaaaacaaatgtccagatgccagaactgaagcaagaaatcagagccagaatgatgagaagggactgctggcaccatgtggatatcagaccagatattggacctgtggtctgggagtattgtaaagtcacgtgagagatagaaccacacctatgggcccaaggacctcaaagatctgcccagcctataaaaaggggactcgaaaaactctgacctcttattctgggaaaccacaaggaagcctgctgactatcccgaaatgtagatggggtggggatggagggggtgcacagtaatctttaagaagtgaaatcactatctttacttgaaaatacctttttaaaatctaaatttgagtcaaggaaatctcaaactgagggattaactcaaaaattgctctaggactgttgaaacccctacaccaaaaggactaagaaatgcaaataaagaaagaagaaataagaacattggatgaccaagcaacatctgactaacaggagagtaagaagagagaatggaggaacacctagcctcaaagaaataaatcaagacattttccccaatccaaagagcatgggttcccagattgaaggagtccaccatgtgcccagaataatacatttcaaacactagagaccaaaataattttttacaagttttcagaaagaaaacaacagaactcgtacatataaccagaatgggtttagagagagagtatgtgtgtgtgcttgtgtgtggtgtatatatacacacacgtgtgtcaaagagaatcttcattttccaaagttcaaagtcaataagtaatgcctaaaactgtgaagttaagaagtggcaacgtatgcatattacttagaaatatagagtaaaataccaaaagcgaagcaaacaaactcatcagaaagtatggaaagagtttgcactggggtctggaattgaggattagtgttcttgttccttactgctatttctagaccctagtcccttccttcaccctcaaaacccctggctcctttgaagcaggtgacattaaatgaccatttgttctctcctgttttgcaatctcctgtcccctggtcacttctctcaacctctgaaattttagcactggctcactgtctttccctccactgttctcctgccattattcctgagaatttcgatgcccacaccctgcccgtcattaccctgacctcattgtttcctacacactttaagtctatacctccctcccccaccttccatggtctgaccctaggactttccaaaaatcttaatgccaaatacctcacactctaaacttcaaaatcttaatgaataaatattcactttcatgttccaaattacctactctaccaaacccacttcagtctacccacttttactacctatcgccctctctggtctctcattcctcctcactcctcatccagtttagatccaccgttgatgatcataaaactttctatataacttgtctgtctcccctcccatcatgttctactggcaaatcccaaaacctatttaatatttattgctatatttcatcagttaaatagaactatagacaaaacaaagcaatacaacacaaatgcatatagactggtttcattttaaatttatgtttataatctcaagaaaatcttcagcacagcctggaaattctgcatatttcattactcaacttgcttgtctgttttctaaaataattatctcaacttgtcctctactctccaaactccaaaatattttctttcttttcactttcaactaatggtggctcttttttagttcactcaagtaaaaaaccaaaacaaaaaaacaatcaaaagaggcaggtttagttcaaatgccagttttgctactcactacctgagtgaattctctgagccagttacttattttctctggggctcagtttcctcatctgtacaaggggtagataatagcagtagtgtccagttatgaatgacacgtagtttctgctaatgtaatgttcacttaacgagggaaaccgaaaactgtctactttacactatcaaatcttctgtcctacccaggtatttgaatatatctgtgaactctgccttcctttcttgtgcatacagttgtttcaggacccccatgaatactaaaatctgaggatgctcaagttcctgacataaaatggagtagcatttgcatagaaccaatgcacatcctccatatactctaagtcatctctagattatttactttaaatcatctctggattatttaaaatataatacaatgtaaattctatgtaaacaattgttgtaccatactgtttttaatttgcattatttatatttttgttgttgcattgttattttttattgttcttccccctggatttttttgatctgtggttggttgaatccacaaatgtggaacccacagacagggaggccgactatgtccttagcccccgcctccccttctgaaacagtgggtgaactgttcctgaatctcatttcaacccctctatatgagtgttggatctccttccctctcccctattcaatgactttgttcctgcagttgttcctcttcaatcatatcctatggaatttcctctgtctactaagttataccatcagcatataaacgttatgtattatcttccatcttaaaggtccttcagtgctgtcatggcttagttcttgattccttttttaagaaaactccttgaaagagctgtttacgtttgcttttattttcccgacctctgcccccttttttgagtgaattggaatctcactctgtcacccaggctggactacagtggcataattatagctcactgcagccttgaacgcccaggcagtcctcacacctcagccccccaagtagttggaactacaggcatgtaccatcacacctagctaagagtttttatttttatttttagagatgagggtggtctcatgatgttgcccaggctggtcttgaactcctggcatcaagcaaaactcctgcctcagcctcctgagtcaatgggattacagatgtgagccaccacacctagccttttcatcactcttttgaacccattgcaatacctcttgtcaaagtttatctttccaaattctcaagtactctgcccttcttcattaaacatctcagaagcattattcttctaggcttctagacttcatttggtgtcttagccagcttgggctgccaaaacaaacacaaacaactaggtgccttacacaacagaaatttattttcttacagttctgaaggctgggaagtccaagatcaaggtggtggccaatgctttttctggattttggagcagactgctttggtttaaatctagactccgtcatttacaaactttgtgaccctgaccaagacagttaactaccagtgccttggtgtcctcatctgtaaaatggggatcatgataatatactcatttaagttaaataagttaaaatatgcaaaaagctaagaatgttgtctggtacaatttaagttcttaataaatgttagctattactttatgattcatatttgtccattttcctctttagaaaaaaaaaaaaactcccagaagacaagaactttctgccctgctgaaatacatggtatctccagtgcctagaccactgcctgatattccacatatatttgttaaaagaacaaaggtgtaaatgagtgctttcttggaaggattttaaaacgtgtggtttacagtgtcaaatgcttcagacagcttggcagataaggacgtaagccatttgtcaatcaaaaggtcattggtgatttgagtagtagtaatagccataatttactgagccaccttgctaagtgtgctaatctacacaatggtcctacaaggaagccattattatcaccattttatagatggagagcgtatctgcagctctatgggacagaagtaagactgaaaaggattgagagatgaacgggaattaaagatacactatcaactctattataactggcagcttgtttaaatatattaacctataggagaagaaataaattcaactggccagagacataatttgtcaaccactcttatcaaaaaaaccaagtatgagtgagtcaaggggaatggagtgagaaaaatataaaataaatgaaggttctcagctttatacatatttttttttctcctgggtcattttaaatgctaccttggtaatgatcttcatttaatttattcttcagatcctctgtgcttgaaaatacagagatgatatgaaaaaaaaagtcaccatctttgtaagaatcttactgaataagaaagatcttttttacaaattaaactgctgaagagatttcaactgggtttggaatccagatcaactcaatctctggcagaatattttcaggaaaaaaaaaaaccctggaacatttgagaattacagttctgtacctctgcaaagatttgtatattcttccattggtgggtgagggggcaggaggaaattctctgggtaggcttacaaaaacaagatttttaagcgcttctgatgattctgagctacatttctggactggaatttgagtgtttacgtcgctgtttcttggataattaaagaggtatgtgtctgtttcagagaatctgctctcttctaccttgctttatttgggtggtgtgaccttggctcttctgtatattcatcctgcctgtcacttttcagaaccgagtaaggcagcaccagtaatagtcactttggacacagaatatttaaaagttttgtgttttattttaaattggaggctcaaatatcattgtttattttcagggcagcaaaggaccataagcaattctccaatggtgaagatcgaccccagtcatgtaaaaacacgtacgtattcattaatgtgtacatttctttttctgtgttagttttcccaagctatttccctcctcagcccagtctccctgcttctgttttttattagcttttcatagttctattttcttactccttagtcttagctctttggctgtggataaagatggctggtagggattggcaggggccaatgagtagttagaaaatgtgatttgccaaaataagaatgataatttcattatgcatatctcacttggagtattgaaaattaaagcttaaaaataaagctaatcccctgtctttttttttttaaagcttccgtattgctgaggtgaccttttctgttctgtcctgtgctaacatcaccatatgaattttaagttctcccctgcccctgtggctatgttaggttgatagttaagccaggactctgtcctgaagcactgtgctgttctcagctccaggcagcaaagggttaacagagtctccagtgcctaccgagttgtaaaaggaactgctgaagctgatcaatgaccactgttaagacctggaaaccaattataaacctgaaatttgtgatgaacaaagccctgaaacactgggatgaaaactactgaattagtccagttcattaaaatcattaatagtcatgaaatgaaaaccaccagagtccaaaaaggcttaatgctctatccatattaattagatgggagcaaatctgaactgaaaagcagcacatgctttgtagaattagcaattggtctctacagactacacagatctctattaaaattcagtttaattaaaattgatcacgttaagaaactgatgtggttaattaactgaattcctggacttcttttcatacgtttcacaggcgccttttacactgcgtttgtgggtgacacttcatgttgcacagagcaaatccaattgcaaaggttaactctctgtgttcctggagaggatacagaccacggaggaggggtgtgtgggggagaggcagaagaaacccgctttatggagagtcaaaccccaggttaaacttgaggaaactcctttagaaaatttgtcccattcatggtggataaatgaatgtgtatctatcagtgacaaagaggttctctctcccaagctgccacctctagaggaactgagaagtattgccaaaaataagagtcactctaacttcaaaaggaggacagtaggcatttggttaagtgtggctaattctgtaccaggattgctgaaggcatcttagttttattgcctacacacctccttgttctgtttggctcagaagtcattttctgttttttccgtctgcagaatggtatactgacatttctagatttcaccaaggcctaaaataacagcaatagtccctctgccttgaggctgctctgctgctcctggccaagtctaccccccttcccaagtccaccaagcatattgctgctaacgcagccttcccaagactgcagcttatggtgtcaccggcctgctcaggactctgtaatgactgtgtgctatatacaggacaaattctaaactccatggatttaaatccagagctcttcatcatctaccccaacatactcttacttcctttgcctcttagagatgtactttgcctatgagatctatttctttgtttcagccacactggccaatttacaaactttgagtcccttatttgctttacagcctgcactcctttttcctcttagaaatttgtttcaatccagcccatccttaagaattccactggaatcccatcaccataaagtaattctgtcatcaaccctcacaaaagatctctccttcccctgccctctggtagttggtatgatctcaactgtcaattggctcttgttccccaaaatctgaaataattactcacatgtacacatcagctcctaaacattttaagttcttatcaggcagaggccatatcttatatttcactgaatctgaacatgcgccagacacaatgtgtgctccataaatgttgtttacaatgagggaataacttatcctttgatagcttctggcaatttttctcagcgagggaggtttgagcttcgtcttatgatgaactggcaaaaaaatttgaatgtgacatgctaatagcaataataataatagatgatatttattaaactcacatgtcaaacattgtgctaaagacctattgttttacaaggaaatcaccctttccctctgtttgttgtcagagttgcaagtgcctctcccagcgttttgttcatcttttgcatctaggactgtgtcttccatctcgtttctaattcttgtatatttttgttccttttttctaacataatttggcaattctttttgggttttgttgttgttgttgcttgttgttcttgttgtttttcaggtattttcaaacaaccagctttgaatatacacattctttgtttttatcttcattgactcaaatttagcttttaatttgctatttcttggcagatttcgttgcttgttgtttttctttctttctttcttttttttttttttttttgagacacagtcttggtccgtcaccaggctggagtggagtggcacaatctcggctcactgcaacctccgcctcctgcctcagccttctgagtagctgggactacaggcacctgccaccatgcccagctaattttttgtatttttagtagagacgggatttgttggccaggatggtctcgatgtcctgacctcatgatccacccacctcagcctcccagagtgctgagattacaggcatgagccactgcgcccggccgttgttttttttttctaatgccttaataagttaaaagtttcttagtaagtatttaattccattttcccccttttccctttgttggtctttcttccttaataataaaggcattaagaacatacattttatcataaacacaatttttattgtgatgcttagatttttgatgaagtatttttattttcacttatttctataaatcatttataatttcagatttgatttctttttttgatctaacgtcttttataaattattattagagactattttaaaaattacttatttttaacttcattatattttgattagagagcatgccctatatggtttctttggtcaagtatggaattaagtcttataaatattccacagatatgtacacaatgtattttcctatttaaaagttacagaattatattcttcaattattttatttatatccttattttttggtctaattcaactgtccagttctgaaatagtcatattaaagagtaccactatattgtattttaattaaactctacttatctatgcatttttgctttctgttcagctgctacgtattttgatacaaaaaggtgtaaaacaattatatcttatttttcttagaattttttaatccaaattcattatctgattttaatattatcactctttttttcttattgtttggctttgcctgctatctctttgcccattcattcactcataaatttcttttcatttttgggggtcatatttttcttcaaaatatatttgtatgtaggcttttttaaaggaaatgtatgctacttcttgttataaaagattttttgaaaacatacactatatcttgttataaaacatatttgagacaatttacaaactatatagactctcaaaaaaataaaataagatagctggaaaaattagtgctggtagaaataaaaaagaaagttctgccgggcacggtggctcatccatgtaatcccagcactttgggaggccaaggcgggtggatcatctgaggtcaggagttcaagaccagcctggccaacatggtgaaacccgtctttactaaaaatacaaaaattagccaggcgtagtggcgggcccctgtagtcccacctactcaggaggctgaggcaggagaattgcttgaactcgggaagtggaggttgcagtgagctaagatcgtgccactgcactccagcctgggcgacagagcaagactgtgtctcaaaaaaaaaaaaaagaaagttccaagccaaaatgtttgctcaactctaaaatgcaaattttatgacacacattttgtatttatttttattaattactatttccttttttcaaatcttactgtcctttgtatttcagtcattgcaaaactaaaaacaagattaattaatgactggctgtatccatatgcctctctcttttgttctttgtttctgctgatttgatcaagcgaactattccaatccctctactcccaccacatcaattaatttagaaaggcaattaactgtatttaccatttcattagtggttaatttccctttcctaaaattcctcatcaaactaatatttttctattattatatgaaaataaaatacaactcttctcttcccaacctccctcaagatttattgcctcattggtttgtctgctattacttattctttcccccatctctaccactttgacaactcaggttttgctaagacagttaaaaacttttggtttcaatccatcattaggtcttcccttgaaatatggctctttcttttaagaatacttacatagctcacatattatgctctcaggcaatttttctagctacatattttgcaagttttatggtttcttctcctcttccacttctcctgttaagatctctgttctgactcattattattttttttataaaagtcttttcctcaaaaggggcttatgggaacttgattcctcgaactttttcttatatacaaacatctttccaacctcctggtagttgagtgactttcagtccttccctatcaatcttctgcaggtgttattccatagtcagaatgattgttttcctttgtaaatcattgtcatttcctctcaaataatacttagaattaagtaaggtattttactttccagactcaagttttttttagcatagagaatttaaatattgccatctatttatttttctccttctagatcttctattactcacatttagttatcttccaagtcttctacattgtccttcatgattcccatctttttgtattttttgcaaggttttgaaatacatattccatttgatattcttggatactaatgaattctgtcattcaatttacaaattaaacttctgtttcaaacatagaatcttctaggtatttgtattactttttttgtattgttttagtaattacctgcctcttttaacagctttatttaatcaagaaccaccttttccagatgttctgagtgttctttctctggctgctaggatcccttacgtggattatagttttcctttgcctactctgcaggctcaggctgagtttatggggtactcactcttgagggtggtgaggcgcaaatatatctctgccagtgcggcgagttcagtaccagctgataggtggtagtaattacctgattgaggctctcaagggaaggggaaaaggaaatccccttgaaatatttttctgggcaccactcttcttcttggaatgccacagagttccaaaacctacgttctctccaagactatggtacactgatttttgctccaaaattctctacaactccaggctgtgtccaaagccaaaagaaaaagtctgacatcaactttctgtgtctggatccacagagcccaaagtcatattcttacccttcaatgccctgcctgcctgccagatagactcaggagaggaagactgctgttaggaattgagatttgagaacagcagggacacattcagggtgccatattcccaacattcccctaaatactttttaaatgttttaaaatgtgaaatataacactcatacagaaatgtgcataaatcataaatatcagtgtaataaatgattataaaataaatacttgtgtaactaataccaaagtcaagacatagaatattggcagcaacccagaaaatgcctgtgtcttcctcatttaacacaatactctctttgcccttctaaaggtaaatcactattctgtcttttatagtaattagttttcttgcctctttaaaaaggtcttacatttttgtatgctcaaaaaatggagtttagtttttacttttgaactttatatatatggcatcttatagtatgtactcttttgtgttttgctcctttttgaactttatatatatggtatcatacaggatgtattcttttatgtttgcttataatatttattcatctatctatagctcattcctttttattcactatagagtattccattgaatggatatgccacatgtctttgcttattctcccatcaatgaacatttgggttgtttctagtttaatgctatttcaaaatattgctactgtaaacatacacagtgtgtgctctgattcacatgtacacaagtttataacatataattaggagtagaattgatgtgatggctaataaggctgcatatctttgatgttattagataacgccaagctgtttccaaagaggttgtatcaattttatttatttatttatttatttatttttgagctggagtctcgcttggtcacccaggctggagtgcagtggcacgatcttagctcactgcaacctccgcctcctgggttcaagcgattctcctgcctcagacccccgagtagctgggactacaggtgcgtgccaccacggctggctaatttttgtgtttttagtagagatggggtttcaccatattagccatgctggtcttgaactcctgacctcgtgatccacccacctcagcctcccaaagtgctgggattacaagcgtgagccaccatgcccagcctggttgtatcaatttataacaacgagccatttatcacagtttattagcagtttattagtgttctcattttttcatgtcctttaccaatccgttgaatatgtaatgttatctcattttggttttaattcacatttccctgattagaagttaagcatcattttttataaaagaaaaaacaaacaataaagagtcatttacaaaatgagagtgaaagtaacatagctgcactcaatgtttcataaagtggtaattctcctaacaatcttgatttaggtagtctattacaatcacccccattttacagatgggggagttttagttttaatgaagacatacagctagtcaatagcaaagctgagatttgaaccaggcttgaacttctcagcactgagtcccctatgctttaagaagctaactataacagccatgtggataacagtgtagagacaggagttactaatagtagtgagagcaggcaggagcctgtagtacagtatttgatgaaaatgttcagagggtgagtgagtcacacaggtgtaactttaaagcttgttagctaaggccttaggaggaaaaaagcaaaatgtcatatgaattgagattaggcttaattatgccgtaaagatttgagtactcatggaacccaattgagaattatttttaattttaagactcaaagctatttttttttaattttttcctggtataaaaagggatatattttatctctgatataagggataaaaatcacccttaatctcactacccagagataaccactattaatattttattttatccttccagcatttttgagcctgaagagatatattatatttaaacaaagttgagatcagcgtgtatatgctgttttataacctatttgtcccaaacaaaatattgagaacaactttccttgtcattaaaatttcttttgcacatgacttttagcagtagttcattttaaagttgtatcataattactttttaagtatttcaaatactacatgataagaatatttgtagataaatctttgccacacttctgattattatttccttatgtaacatttctaaacgtgtgtgtgactgtggatcatagttcataaactcaggtttgcaaaatatatctcacctgtgtaatttccttagatcaattcaaatttgatcccaaattcccttatcttaaacccttaagattttttaagaatctgagaagcttatatggtgcctggaatgaagaggaaagatgcaatcactctaagcatctatagtcagcatggacaacagcagtggtcaaactcctgttgtccctcaaagtcatgtaactctcagcttgtataccacttgtgggacaggttgactttccaagcctgagaacctcagtgcccattatccagtctctccaaggacaccacacaactggtcctctctgagttgctgccaccaccctgagtgctcccaagataaggacatgggtcagtgaccgctgcctccctacccagtctgggagagaaaagccctgtccctacctttgcatgttctccaagagcccttttctctccatttctctctgggatgattttaggcttttatgtgagataggacacattcttgactctaagcagcttcagctttccaatgtgtaacaaacttctcttgggacaaaggaacttaaggttttgccaccttcttgaaaataaggaggagaaaatatataagaataccaccagtcaaattacctgtgatccttttctttatatgtttctaatatgtcctcctgtagtgtctaaaacacttgccaaggtgatttctgactagtgaaatagatagaaggtaaaaagttgaaagataccatataaaaggcatggatagagtctaatgagattaaaagaactcagggcatcagctcacagaggaaaaaactaaagcttgagaatgggtaaatattagacattttaagcagagaacagagggatgaacaaaggcacaaaagtgggaaatcggaagtgtgttaaaagccttgctactcaaagtttggtccatggaccagcagcactggcgtgacctagcaactcattagaaatgcagactcttaggacttgcttctgactgactgaatcagaatcttcattgtgacagaaccacagtgatttgtaggcaattacagtttgagcagctcagctttacagcagtggttctcaacatgtgattcccagatcagcagtatcacctccccctgggaacatgatcccaggagtttgagagcaacctgggaaacatacaagaccccatctctacaaaacaaattttaaaaataggcatggtggcatgtacctgtagtcccacctactctggaggctgaggcaggaggatctcttgagcccaggagttgaggtttcagtgagcgtgatagtgccgctgcactccagcataggtagcagagtgagaccctgtcttttagaaaaaagaaaaagaaatgcaaattcttgagccctatctcagacctactgaatgaatatctctggagggaaggcccagcaatgcattttaacaagtcttacaaagtgattctgacacatgtacaaagttgacaaccactgctccagagcagagttgaaaaaggcttcatggaaaagggccagatactaaatattttaagcgggctttgtgggcaataaggtctctgtcataacttctcaactctgccaatgtagcaagaaagtaccaataggcagtctgtaaaagaatgagcatggctctactccattgaaactttattcacaaaacactggaggacttgatttggtccatgggtcatatttgccaaccccttttctagagtacagattttcaaacttgcatgtgcattagaatcacttggagagcttcataaatcttgatattcggaccgtatcccacaccaattaaccagcatctctacagttggctgagggatcgatatttttaaaaactctccaagtgttttaaactctctctggaatgcacagcaagggatgagaccagatgctacagaacggaatagaaggcctgagaaagaaagatgggttgagagggtcaagggagattcagcaggaaaggtggctagaagcctgaaggtagaggcctttcaaattgggatgttccccaagcacgacaatcccgtggggatttgaatatccatacaggtcagggcacacattttcatttttttcttaaccacatgttactgcatttaaaccacaatattaaaaatgagaaacgtctgaacaaggagtaggccaaaaggcttttaattccccaacagcaaaaccctgttaataccttgccctgtgtcagcaaaataattgtggttcaaatgaatataaaacacttccattcaatcttctccctcctccctaaggcaaatgctttcttatcatggagaaacagtactcctcaaactgtcagactgcatcaggggagttaaacaagaattataaagccaggctaaatcaaggcatcagctaggagggcaaaattctcctgcaggtgcactttctttagccccttccctgaccagagccttcactaacgctgctgtggaaatgctgagagagagtgagctgagacttttgcaagaagatgaattaaatttctttggttgcaagtagcagaagcagtcactggctaagtcaagtgaaaaaaaaaaaaaagttaactgaaaagatctgtggtggcccagacaataaaaggagacgctaaagaactggtcttgggaaggatggaaccatagcggatctgagcctttgtaataggagctgtgcaaggtctcttcatggggctgccttctctatgggaactctgcctactttctgctctagagtcccaccatctaaggtgccctgtccaagaagagaacatctgattggccaagcatgggccccaagaccttaataaacagtcccaccttgattgatggttctccaaagtctatggaattttattgccacaagaaggaagaatagatgctaggaaggtaaaaatagcagatgtccattacggagaataataatcaatattttttaaacaatgttaaacaatgcatctagagactcaaacagggtttgtcacatattgatcatgggactgggcacacaatctcttacaatccccaaaggagaacgcttatctagtcataggcattgggtcaagaaaaacttaaaaatacaacccccttttttacaggggagaaaatgaaggatgagtgaataacttttccaagccttttcctattcatgtttaatgttattcatgaaaagtgtacaatcagataagagtccaagctggacccttcatccagagtattctgcctgtggttgtgaaagtcagtgttttttaatttccttgaagactctgtgcatgcatcatgtttgctcttttaaagatgagaaataacagtatttcacatttgtccaggggttcttatttaaaaagcaccactggccaggcacagtggctcacacctgtaatcccagcactttgggaggccaaggcgggcagatcacctgaggtcaggagttcgagaccagcttggccaatagtgaaaccccatctctactaaaaccccatctctactaaaccccatctctactaaaccccatctctgctaaaaaaatacaaaaatgaaaccccatctctactaaaaaaatacaaaaattagctgggcatggtgatgcacagctgtagctagactacagcaggagaattgcttaaacctgggagacggaggttgcagtgagccaagatcgcaccactgcaccccagcctgggggacagagactccatctctcaaaaaaaaaaaacaaaaacaaaaagcaccacttcctaggccccatatttcagagattctgattcaataggcctgggttaagacccaggaagctgctttttcacacaagtacctatataccattggtgtgtacaatgcattttgaacaacagtgtggtcccacgctcaagtgtttgcagagaccagagaggtcatgtgagtaaagccaggagaggataagaaaacgaaaagaagtgaggatggtgacttgggaagtacatgtactgtctaagggtacttggactccatctgttttcaagcaccctgcaggctaaagaaaaccttaccataggacaagttttattctcatagattctataggttgtgagtgctgttagcgctttcacatgaattttatcactcaatgaacttctaagatgggaaaaaaattattattatgaacacgttttcatgaataaaaagggggaggtttagaggagctcccctaaggcttcctgccatctgccaaatttgaacacaaatctaatttctaaactgaggtgctttgcaaaaccgcaagtaatgcacccctgtttatttttttaactcctctctgtcatgtggcctgcataaacaacattcctttcaaatgtgattatgtctgttcaatcataaatagggcagaaaaaaagcctagctggtaatttttttaaatatgtgaaaagcacgcaaaacaagcagaatcttcaggatttcaaatagtgatacaaagcctggcaggtcattatgtaaaattactacaagcctcttgaagattgacccagtttacatagttttcttcattttatccaataaagttaaaatatattattctcatattacagttggatgatttagaaacacaaaatatgtttggcacagattcatagttccttagtaaaacaaaagacaaagtccccgcaatagttagaaagttaattatttatcttggccaaagactctgactgttgccatgacacagattaaaacagcacttttcaaataaggtggtagttatttcatgtcaggctttgaaagtgctgggctgagtccctctttcagtaattggaaattctggacctatcttactcaacacttcaaacccttgtagtatttctatatgatgttggagtttgagaacagaattaggactaggttagaggttaactgtgtaacatcagtctttcacaaaacaaagcttagttcagggaacatgccttgacctaccttaacctaaaatctgtgtgataatgaaccaagttataacaaggctttacagtacatggaagaccttttttggacattagaaccactcaaaggaggagagagaaatacagtcccttctggttataaggggatatacttgtggttttaattgttacccaattaaatgaggttagatatttacaaaaatacattaaaataaggaaaattttataacaaaggagacagaaactaagttattgtctacaatatgtaaagagtgcttaaaaatcaataaaaattaaaaatcaaccaactacaaagatggtaaaaggatattgacaattcataaaagaagaaatcaaacacccaataaatgcataaaacacataaaaaattcttttactaagaacaaaacaaatgcacattaaaacagaaataagataaaaattgtcacctatcaaattagtaaatatttaaatattaagtattattaaatattaaattttattaaatatttaaaaatatttaaatatttttaaatgatacttaaaagtggaaagtatgcagtgaaacaaggattctgaaataatgcatgtgaaagtgaaatttcatacaataattctggaaagcaatttggcatattatatcaaaatggtaaatgtttccttacctgtataaacatattaaaagtaaaatattagaagtgcagtccaatattggtttctaataaggtatatttattatagttttattgtaattttttttgtaatagaaaattggatgatcctcaaatgtccaataagaggattggttaaacagtccagggctatttggagatagggaaaaaccaaaatgtgtttcctactctctttcacaccaaccaagcaattctgacactagatgtgtatctgttgggggtagtctctccacgcaccaacgagttctccagcaggcaccatctgggtgttctctaattcaagtcaattcttacactatctacctggagttagtaacagatcccacaagttgagggctcagtcctacaagactgtaccctgctttaggtgcccgttgcaagtagtagtagttgtcacctctgcttctgatggactggctatgaattcaaggttctaacaaaccccttcttgggtttgattaatttgctacaggtcctcaccgaacccagggaaacaatttacttgtgttgacctatttgttatgaaggatagaacagccagatggaagagatgcacaggacaaagcatatgagaagggacatgaagcttccaaccatgtacaaccagaataacaccctccaggcacctacacatattctgctatctgaaagctccctgatcctagtccttttgggatttatagaggtttcattactaggcacaattgattacatcattggccattggtgatcatctcaagcttcagccccttacttcttttcagaggttggggttaaggctgaaaatcccaactctctaatcatctcttggtcttctcagtaacaagcccccatcctgaagctatctaggggaccccagccaccagtcatcttattagcatataaaagacacttatcattccagagattttaatcattttaggagctgcatgtcaggaaacaaaaacaaagaccaaatatatattttacagtatcacaaggacatatccttatgatgaaatatcatgcattcatttcaaacatcagcttgccaagaatatttaactttttggaaaaattttaatgagtgaaaaaggaaggattcaaaatggaatctgtggaataatcttaattttatttaaaatatatgttctgtattagtctacttgggctgccataagagaatatcagagactggtggattaaacaatagacatttattttcttacagttctggaggttagaagtccaagatcaaggtgacagccacattggtttttggtgaggcctcacttcctggtttgcagatgactgccttcttgctgtgtcctcgcatgaccttttctctgtgtagggcacataccccatgtttcttccttttcttataaggacattagtcctgttgggttagggtcccatccttatgacctcatttaacttcaactacctccttgttaaatcaagtttagcctaaagttgcctccttatgtattttaagttcggcctaaaggttttcctgtacattgtgaactataataagtggaggtgtaaacaaaccatagcctacacttgtgccaatcactgagttttggccgatcaaatgtagccaactgttgggaccgtgttgaaataaggcaaaagctgagctgtaacctatccagctgtttctgaacctcatttccattttctgaatgtcactttcctttgtctgtccataaatcttcttccaccatgtggctgtgctggaatctgtgagcctgctgtggctcagaaggctgcctgacttgtgaatcattcattgctcaattaaacgcctttaaatttaacttggctgatgctttttcttttatcatccttaaaggctctacctccaaatatagtcacattggaattgggacttcaatttgggggcacacaattcagtctacagcacgtttcatatccataaaggaaagcctagaggccaggtgtggtggctcacatctgtaatcctagcatcatgggaggttgaggcgggcagattgcttgagctcaagagtttaagactagcttgggcaatgtggtgaaacctcctctctacgcaaaatacaaaataattagccaggcatggtggcgtgcacctgtagtcccaactactggggaggctgaggtaggaggatggcttgatcccgggaggcagaggttacaatgagccaagattgtgtcagtgcactccaacttagaaagaaggaaaaagaaagaaaacaaaaaaaagaaagaaggaaagaaggaaggaaggagagagagagagaagaaagaaagaaaaagaaagagaaagagagagagggagaaagaaagaaagaaagaaagaaagaaagaaagaaagaaagaaagaaagaaagaaagaaagaaaagaaaagaaaagaaaagaaagagagagaaagaaaaagaaagaaagaaaagaaagagaaggatgagaacgaaaggaaggaaggaaggagaaagaaagagaaagaagaagaaagaaagaaaggcaatagagtcttaatattgattatccctgagtaaagggaatataaaccttttaactttatggttttccttgtcctcttctctctccaccccctcctcgttttttgttttgttttatttttacagtgatcatgcattatagcagggggggaaaggtaaacaaatgggaaaaataaaacagtactcagtttcatagatgtggggaaaaatcatgaaaattaaaatcataaaactggaattcgagttacattattttggttaaaaaaggtatgtaatcttatgcttcagtttccagaagtgcaacaaagggatgaaaagaatattcatctcatgaaatcactgtgagaaacaaactagatgatatatataaaaattattttgcaacctgaacactagttttagtttttttgttttgttttgttttgttttttctatttttagtagagacagggtttcaccctgttagccaggatggtctcgatctcctgaccttgtaatccacctgcctcggcctcccaaagtgctgggattacaggcgtgagccaccgcgcccagcctagttttagtttttattacttttttttttaagacggagtctcgccctgttgcccaggctggagtgcagtgcaagatgtcggctcactgtaagctccgcctcctgggttcacgccattctcctgcctcagcctccggagtagctgggactacaggcgcccgccaccacgcccggctaagttttttgtattttttaaaagagacggggtttcaccatgttagccaggatggtctcgatctcctgacctcatgatccacccgcctcgacctcccaaagtgctgggattacaggtgtgagccaccgtgcccggcctagtttttatttcaaaagtttaattctttttttttttttgagacagagtctcgctctgtcacccaggctggagtgcagtggtgcgatctcggctcattgcgacctccagctcccgggttcaagcgattctcttgcctcagcctcctgagtagctgggactaacaggtgggtgccatcaggcctggctaatttttttctatttttagtagagacggagtttcaccatgttagccagggtggtcttgatgtcctgacctcatgatctgcccgcctcggcctcccaaagtgctgggattacaggcgtgagccaccacacccggccaagtttaattcatgttaaagacatttggagagcatttcctctgggcataagggccttctacctgtgatggggatctatatttatatctatagttatatcaatatctataccatctagatctgtttctatgtctaagctttgatttctgagagtttgcagctcattagaggtagagaataacaattaggaccacttcagggaaaagagatggggctgggagggtggcaatacaaaatcatggggatgaggagaggaggaaaatggaaaatgtgaaataaaaaaccagccaactagttatatgaaatatgagcagaacctcaggcgtgtattgtataagggtcacatgttaatttcatgtttgcttattagtctctttgcttttccagaacaagtcctcccattctgacagggccatcaattacaaagacatgacttgttaacatcagagatgggcacatgaccaactgaccaaccagaaaacctcatcccctgggagatggtaattggttgagaggtgatcaagtgacattagcagggctagagactttttgcaacactttttaataagagttcaccttaatatctccttctaagatcatgaaaattaaaaatatagtgagtgaatgatttatcatgcaaaccaggacatttttgagagtgaaaggggttgctatccatacacatgctggcatgatagatgtaaactggacttattctggacaaactgtgatatgtggtcaccctaattaaggaccgtgcaaatccagaactactcagaactgtgatgtaggagagtacatgcctgcaaatgacactgggagaaaggaaagcaaagggagagagccagagaaagagcactggtgacttgtttgtacacaatgtctgatgctgcccacttatggaattttctatttacaggaggcaacacatttcacttttgcttaagaaggatcttgcagaaagtgaagaagagcaggaatagagaagacatttgaatgacgactgatgttctcttctttggcctgaggttttagaacacattcactgcctgatcactgtggcccagaagccatggcctctgctgagagatagggaccccatgttccctctacacatcttcttccccaaagcctctctgaggctcctatgttcaaagaaacagtcctctggcaatggcctggtcctttctgccataccaaagaaagttgttttttgttttgagcaagagatcacttctgattttcctacctttgacatggaccagactaattgacaaattctagaaggacagacacttccaaacgtctcttgacatactggcttcacaaaggttaggaaagctgttatggggaggacggagcctttctcctcttcctgagaacgtttgaagaagaaaggggctactgagaagtctggtagattcagcagctagtaaatatcgtgtctaaatgggcatcttttattaaactctgaggcagggttggtgtgttaggccattctttcttgctataaagaaatatctgagactgggtaacttataaagaacagaggtttaattggctcatggttctgcaggctgcacagaaagcataatgacatcttcttctggctaggcctctggaagcttccaatgatggtggaaggcgaagagggaacttgcgcatcacatggcaaaagcaggagcaagagagaggcga

SEQ ID NO: 227 - DNA, 176 bp, Homo sapiens
gcctcaaaaggttcaaatcagaaaagattctttaaaaaccttaaatgattttcaaaaattgttaggagacattaattggattcagcccaccttaggaatttctacttatgctatgtctaatattttctaaatattgaggggagattgcaacttacaccataaaagagaattaacac

SEQ ID NO: 228 - DNA, 306 bp, Homo sapiens
aatgtgagggccatctggctgcaacatctttcaccccattgatcatcagggttgatttggctgatgtggctggctaggggggtgtccccttccctcctcaccgctccatgtgcgttgctctggaagctgtgtcctgggtctaagaggacaaccatctctagcagaagagggcgggtcttccctcaagaatataggagtagctgtgcttccctgctaggacctccaaacaagctctcaaggacaggctatcaaacaatcccatgtggtaaaaacaataaataatggctctcctggaacgttttcctt

SEQ ID NO: 229 - DNA, 2495 bp, Homo sapiens
cgctcaacagaataaacacacttgagacatcaaagaaatatcatattaagagaactgttcagaaaagtaggatacatttattgtgttgttcctatcgtgatacgcatactgaaattgttgttgttgttgtttcacatagtttgcagactgtaattacagaattataggctgtcttactcaggatggatgtctaatctcaacataaacagatcacacacagcttgtcccatcttttggccccctttaatatcaattacaatggctgttgctttgacacaattttgaaacaaaaaattataagattatatcttgttatatatcacccatggaagaaaaatttaatatttcttagctctattataatagttttttcccatctgccttcaacatttaaagccttctagggaaacgacgcatcaaagtgctaaggttctattagggcagactacaataaaacataggtgcatatcttaatgtataaattcctcatctgttaggtacatttaagattctttattataaacaaactcacacaaagctaaaccaaaaggcaattgtttagtgtaacaatatactgagtgtgggagctaaaagttaaaaaaaaaattaaactcaaggagacaaagagtgactttgcattttgccataaaattcgtgcctaggaccccaaaggaaaattggaggctttaaattttccccattctaataagattaccccaatttttagtgaaagctaaacgtgagatctctggaaagcagactccaagatagagtttatctttcttttttctttatttgagacagagtctcactctgtcacccaggctggagtgcagtggcgccacctcggctcactgcaagctccgcctcccgggttcacgccattctcctgcctcagcctccgagtagctgggactacaggcgcccgccaccacgcccggctaattttttgtatattttttagtagagacggggtttcactgtgttggccaggatggtctcgatctcctgacctcgtgatccacccgcctcggcctcccaaagtgctgggattacaggcatgagccactgcgcccagctgatagagtttataatacaagatgtttataagggagcactagttgtttcagcaggtgtggatgggaagggaaggaagcagaagtgcacagaggaaaaggtcaaactgcagtgcaggtctgacagcctcaccagaccgcaaaaatcacctgaagctaaaatggcccctcagagttgtcctgcttttgaacaaaacaaatgggcctttacacccctacctgtatcagtcagtagatgtaaaatgaccctggaagaacatgcttttagctgaaaacagttgtgcagtggagacaataacgcaacaagctgacagctgaaagctatttgctgcagcacctgaggcaacaacttatttcttgaagggagatctcggtggttcatattcctatccatatagaccccttcacaccactgagaaccacgtctgcatgtatgttcatagaactgcatcttcaggaatttagcctcacatcctgggagatatgtaagaggaaggttagtagtagatagagactgctgattgatctatcattgataatgatttttcacattcctccaccactaatctagattcccctgactctcagctactacatctgctggtctcaggtgctatttagtggcatgacccgaactcttagaccagacgaaactgggcccaagtcagcatgccattcttaggctggagttgctgtaactgatcatttacagtaataattgggcaacaggagtacattagtctgcttgggctgtgtcttagtctaatttgtactgtataacacaatacctgagacagggtaatttataaaggacaaaaatatattggctcctggctctgaaggctgggaagtccaagattgaaagcatgcatctagtgagggccttcttactgcatcataacatggtgagagagagaaagaggggaatgaaccctcttttaaaacaacccactcttgtgataacaacattaatccattcatgagagcagagcctcataacctaatccctttatataaagttcccacctctcaacattgttgcacggggggttaagtttccaacacctgaactttgggggtcatattcataccacagcaggctgtcataatagaatactacagactgggtggcttaaacaacagaaatttattttctcacagtggtgaagactggcagtccaaaatcaaggttggtgtatggtgaagcctcttctcctggctttcagatctccagcttctgtgcccttgcatggctttctttggtgtgaatgccacgaaaagagcgagtctggtatctctttctcttcttataaaaacaccagtcttatcagattagggctccctaattactggaacttataaatgttaccttctaaggaaaaagagtctttgcagatataattaaattaaagatcttta

SEQ ID NO: 230 - DNA, 128 bp, Homo sapiens
ggctataccaccctgaatgccccagatcctgtctgatctcagaagttaagtagggttgggcctggttagtagttggatgggaaaggagagtctatacgcatctgggagggaagggttaattcaggtgc

SEQ ID NO: 231 - DNA, 98 bp, Homo sapiens
gtaactattagattggtgcaaaagtaattgcggtttttgccattaaaaagtaatggttaaaactgtaattttatttttgcaccaacctaatgctatca

SEQ ID NO: 232 - DNA, 146 bp, Homo sapiens
accacacacacacatgcacgagtacacacacacatgcatgcacacatgcacacacatacatgtacatgcatgcatatgcatgcatacacacacatgcacgcacacatacactcatgcacacacacatgcatgcacacacatgcaca

SEQ ID NO: 233 - DNA, 8237 bp, Homo sapiens
cagcggaaggcaggtgagcagacttcagcaggctttggaaagaaggtttcagccacatgttccgggtgtcttcctgcaaggtgttcacctcagtgctgcagggagctgagtttgttggtagttcctacacagcttgattttcttaacactaacagcagtcttctgcccttccaacagtttgtttgtttgtttgtttgtttgtttgtttgttttatataaaagttaggcctggtgcggtggctcacacctgtaatcccagcactttgggaggccaaagtgggaggatcacctgaggtcaggagtttgagaccagcctagccaacgtgataaaaccctgtctctacaaaagtacaaaaaaaattagctgggcatgatggcgggtgcctgtaatcccagctaatctggaggctgaggcagaagaatcactccagcctgcgcaagacagcgagactccatctcaagaaaaaaaaaaaaaaaaaggccaggtgcagtggctcatgcctgtaatcccagcactttgcgaggccgaggcgggtggatcacttgaggccaggagtttgagaccagcctggccaacatggtgaaaccctgtcactagtaaaaatacaaaaattagccagacatggtggtgcatgcctgtaatcccagctacttgggaggctgagtcaggagactcactcaaacccgggaggcggaggttgcagcggccgagatcgctccactgcactccagcctggtgacagcaagactccgtctaaacaaaaaataaaaaggccgggcgcggtggctctcggctgtaatcccagcactttgggaggccgaggcgggtggatcacaaggttaggagatcgagaccgtcctggctaacacggtgaaaccctgtctctactaaaaatacaaaaaattagccgggcgtggtggcaggctcctgtagtcccagctacttgggaggctgaggcaggagaatggtgtgaacctggaaggcagagcttgtagtgagccgagattgcgccattgccctccagtttgggcgacagagcaagactctgtctcaaaaaaaataaaaataaaaaagttagttttagtttttattttaaaaataactacagatcccttatttacacggaaagactaccaacatttttttaagtaacagctttattgaaatataatatcgaaaagccacttaaagtatacaattcaatgggtttttaaaaatatattcaaggtgttgtgctgtcatcacaatgaattttagaacatttttatcacccttaaaagaaactgcaaacccataagcagcagtctctccctgttccaccccaactctgctctccccacctagccctaggcaaccagcaattcactttctgtctctatggatttgtctgttccgaacatgtcatataaatggaaacatgatatgtggccttttgtgtctgggttctttcatttagcataaggtgtttaagattcctccacattgtagcttgttatcagtactttgtttctttgtattaccaaataaagtctcattatatcacattttatttatccactcatcattggagggatatttggagtgtttccacattttggctattagaataatgctgctgtgaatatttgttgttttgtgttgtttgtttttgttttgagatgtagtcttgctctgttgcccaggctggaatgcagtggcatgatctcggctcactgcaacttctgtctcctggatttaagtggttttcatgcctcaacctcccaagtagctgggactacaggcacctgccaccaagctcagctaatttttgtatttttagtagagatggggtttcaccatgttgcccaggctggtctgaaactcctgacgtcaggtgatccacccgacttggcctcccaaagtgctgggattaaaggtgtgagccccgcacccagcaaatgctgctatgaatattcacatacaagtttttgtgtagatgtgtgtttttatttctcttggatattcacctagaagtggaattgctgtgtcatattgtaagtctgtttaaccctttgaggtgcctccaggctgttttctaaagtcgctgcaccattttacagttctaccagcagtgtatgaaaattctatttctctgtgttcttgccaatacttgttactgtctgtcttttaaattatcctagtgggtgtgaagtgatatctctttgaggttttgatttgcattttcctgatggttaatgatgtcaagcatctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgtcaagcatctttttatgtgcttattggtcattcgtgtgtgtgtgtgtgtgtgtgtgtgtgtgtattttttgttgttgttgttgttaagacagggtctgttgcccaggctagagtgcagtggcatgatcttggctcactgcagactcgacctcctgggctcaagcaatcctcccacctcagcctcccaagtagctgggactatagatacaagccaccacgcccagctaattttgttcattttttgtaagagatgagatctcactatgttgcccagagctggtctcaaactcctgggttcaagcactcctcccaccttggcctcccaaagtgctgggattacaggcgtgagccaccgcgcctggatggccatttgtagatcttatttggagagttatccattcaaatcctctgcgtttagccgggctaacttttttttattgagttgtagattttttaaaatcacatatatgacttgcaaacatgtttttccattttgtgggttgtcttttcactttcttcatggtttcctttgaaaaataaaagttttaacttttaggtgggcatggtggctcacgcctgtaatcctagcactttgggaggctgaggcgggcagattgcctgagctcaggagttcaagaccaccctgggcaacatggtgaaaccctgtctctgctaaaatacaaaaaattaggcaggcatggtgatgtgcgcctgtagtcccagctactcaggaggctgaggtatgagaatcacttgaacccgagaggcggaggttgcagtgagccgagattgccatactgcactccggcctgggtgacagagcgagactctgtctcaaaaaatatatataaaaatataaaaattaaaaataaaaataaaagttttaacttttgataatgtataatttgtctattttgttgttgcatgtgcttttgatgtcataactaagaaatcattgcctaatccaaagtcacaaagatttatgcctttttttctaaaagttttatagttttagctcttatatttgtgtatatgatccattttaagttaatttttacatatatgtatggtatggtattttgcacccaaatacataaagcaaaaatgaacagaatggaggggagaaacagaaattgaataatgatagttggagattttcatgcacatttccacagatgtatgtttcccaagtttctttgttattgatttctcatttcattccattgtggtcagaaaacatgctttacattgtttttatccttttaaatgtattaacatttgttcaatggcctaccatatggtctatcttaaagaatcgtctatgtgtatttgagaagaatatatattctgctatttctgctattgctgggtagagtattctagagatgtctgttaggtctagttgctttatagttttttgggttttgttttttgttttttgttttctttttttttgagacgaagtctcgctcttttcccccaggctggagtgcgatggcgatctcagctcactgcaacttctgcctcccgggttcaagcgactctcctgtcttggcccctctgaatagctgggatgacaggcacatgccaccacaaccagctaatttttgtacttttagtagagacagggtttcaccatgttggccaggatggtctagaactcctgacgtcaggtgatccacccgccttggcctcccaagattctgggattacaggcgtaagccactgcacctggccactttatagtattaagtcttctatttccttgttgatcttctgcctagttgttctatccactattaaaagtaagcagagtttctttctttctttcttttcttttctttctttctttttctttctttctttctttctttctctctttcttttcttccttcctttctttctttctctctctctttctttcttttcttccttccttcctttctttctttcttttttttttttttgagacggagtctcgctttgtctcccaggctggagtgcagtggcgcgatctctgctcactgcaacctccacctcccaggttcaagcgattctcctgcctcagcctcctgagtagctgggactacaggtgcccaccaccacacctggctaatttttgtatatttagtagagacggggtttcaccgtgttagccaggatgatctcgatctcctgacctcatgatctgccagcctcagcctcccaaagtgctgggattacaggtgtgagccacctcacccggcctctttcatttatgtatttatgtttgtatgtatgtattatttttgagacagagtctcgctctgtcatccaggctggagcgcagtggtgcaatctcggcccacggcaacctccgcctcccgggtttgaacaattctcctgtctcagcctcctgagtaactgggattacagacgtgagccaccacgcctggctgatttttgtattttttagtagagacagggtttcaccatgttggccaggccggtctcaaactcctggtctcaagtgatccgcctgcctcggcctcccaaagtgctgggattacaggtgtgagccaccacaactgtggtgatttcttaatgaggtgataaaaatattctaaaattgactgtggtgatggttgcactatctatgaatacactaaacatcattaaattgtacacataatttaaaaaaattacagagatgcgatctctctattttgcccaggctggactcaaactcctgggcccaagcaaacctcctgccttagcctcctcaagagcttcaactacagactctaatttgtgcattttaaatggacgaattgtatggtatgtgaattatatctcaaggaagccgttactttaaaaaagtaaaaacatagcccatgagtggtcaggcgcagtggctcacatctgtaatcccagcactttgggaggctgaggtgggtggatcacctgaagtcaggagttcgagaccagcctggccagcatggtgaaaccctgcctctactaaaaatacaaaaattagccaggtgttgtggcgcatgcctgtgatcccagctactcaggaggctgaggcaggataatcgcttgaacccgggaggtggaggttgccgtgagctgagatcatgctaccgcactccagcttgggcaacagagtgagatttcatctcaaaagacaaacaaacaaaaataacaacaaaaaaaaaacctacaatgagataccactgcacaccccctaaaatggctctgatcaaaaatgtggaaaaatgacaagttttggaaagaatgtggagaaactgaaacccccatacattgctagtggggtgcaatatggggcagcagctgtgaaaacaggcacttcctcaaaaggttaaacatagttatcctatgacccaggaattctatacctaggtagagatccaagagaaatgaagactgacatccacacaaaaactaggatatgactatttataggagcatcattcataatagtcaaaagaataataaacctaaaagtccatcagctgtagaataaacaaaatgtggcacagtatattcttatcatggaatattactcagcaataaaaaggaatgaagtcctgacacatgccccaatgtggatgaaccttgacattaacatgctaagtgagaggagcgaacgcaaaagtcacatattgtatgattctgtttatatggaatgtccaggacaggcaaatctatagagacagagggtggattggtgtttgccaggggctggagggaggtggaaaagggagggactgataatgggtatggggtttcttttgggggtgatgaaagtgatctggaattagatagtggtaatggttacacaactttgccaataaataaaaaacactgaattgtatactttaaacgggtgaatgttatggtatgtgaattatttctcaatttttaaaacgaaagttttggaacagaaacatttttggagaggattaaaatggcactgcatgaacaggacaagtggagtggggaactccaagcaggatgaccgctttcaagacagaagtgtcggctgggcgcagtggctcacgcctgtaatcccagcactttgggaggctgaggtgggtggatcacttgagctcaggagttcaagaccagcctgaccaacagggtgaaaccccgtctctactaaaaatacaaaaattagctgggcgtggtggtgggtgcctgtaatccctggtactcgggaggctgaggcaggagcatcatttgaaccggggaggcggaggttgtagtgagccgagatcacgccactgcactccagcctgggcaacagagtgaaactttgtctcaaaaaaaaaaaaaaaaaaaaaaaaacacaaatgtctccctgaccctcacgtcaagaacaagacctgacatcaagtatgcactcgcactgaataaatggttatattttcatacacttgtatgaagaaagggttatattctatggattggattaactgggggaagaaaagtttcagatgaaagagacaatatgaagaagcgctttgaggacttggagagaagagctaggcatggctgcggtataagtaacatagcaacattgctgggcgcagtggcgcccacctgaggtcccagctacttgggaggctgaggtgggaggaatgagctgaggagttcgagtcaagcctggacaatatagtgaggtcttgtctctcaaaataaaaagctttaaaaaaagttttttaaacattaaatgcatacaaggcaagaatgcaagagatgtcacaaaacttatgtggccatcaccagataaaaagcatagacaatggcatatccaaatagaggagagagaattcactgtgagcaagcaaggcctcccagaagacatctggcatccagtgggcctcaaagaatagcaaagattttcaaggctgaagcagggacagcttcctgttactagaactcctggaaccaagggtttacgcaggacaggcccaagaaaatagattgggagtttccaaactgtggctgtccagtggcccctggctaccacaggagggaagaaagagttctatctttagtccttaagatcagaactaaaactctatctcttctataacaaccagccataatccataggctttttttttttttttttttttttttgagacagggtctagctctgtcacccaggctggagtgcacgggtgaaatcatagctcattgcagccttgacctgctgggctcaagcgatccttccacctcagtctcccacacagctgtggccacaggcacatgccatcattactggctaatatttgattttttgtagagatgggatctcactgtgttgcctaggctggcctcaaactcctgagcttgtgtgatcctcccacctcagcctcccaaagtgctgggattacaagtgtgagccactgtgcctaatctataaattgctttctgatataagctactttctttttaaaagtgtttttagaaaaaataaaaagcatgtaagaacacagctttaagaccattttaaaagagaatttaatccaatggttgtgagctgaagttggtaaagcccacataatgctgggtcatgcacataccgagatactcaacaaggctttgatgaataggtgaatcaatgaatgaatgaaatgcctgaggccatcctgattccctcaatg

SEQ ID NO: 234 - DNA, 1774 bp, Homo sapiens
gaccccccactctgcccacacccttgtcaccctgcttcagttcattgagggaatcaggatggcctcaggcatttcattcattcattgattcacctattcatcaaagccttgttgagtatctcggtatgtgcatgacccagcattatgtgggctttaccaacttcagctcacaaccattggattaaattctcttttaaaatggtcttaaagctgtgttcttacatgctttttattttttctaaaaacacttttaaaaagaaagtagcttatatcagaaagcaatttatagattaggcacagtggctcacacttgtaatcccagcactttgggaggctgaggtgggaggatcacacaagctcaggagtttgaggccagcctaggcaacacagtgagatcccatctctacaaaaaatcaaatattagccagtaatgatggcatgtgcctgtggccacagctgtgtgggagactgaggtggaaggatcgcttgagcccagcaggtcaaggctgcaatgagctatgatttcacccgtgcactccagcctgggtgacagagctagaccctgtctcaaaaaaaaaaaaaaaaaaaaaaaaagcctatggattatggctggttgttatagaagagatagagttttagttctgatcttaaggactaaagatagaactctttcttccctcctgtggtagccaggggccactggacagccacagtttggaaactcccaatctattttcttgggcctgtcctgcgtaaacccttggttccaggagttctagtaacaggaagctgtccctgcttcagccttgaaaatctttgctattctttgaggcccactggatgccagatgtcttctgggaggccttgcttgctcacagtgaattctctctcctctatttggatatgccattgtctatgctttttatctggtgatggccacataagttttgtgacatctcttgcattcttgccttgtatgcatttaatgtttaaaaaactttttttaaagctttttattttgagagacaagacctcactatattgtccaggcttgactcgaactcctcagctcattcctcccacctcagcctcccaagtagctgggacctcaggtgggcgccactgcgcccagcaatgttgctatgttacttataccgcagccatgcctagctcttctctccaagtcctcaaagcgcttcttcatattgtctctttcatctgaaacttttcttcccccagttaatccaatccatagaatataaccctttcttcatacaagtgtatgaaaatataaccatttattcagtgcgagtgcatacttgatgtcaggtcttgttcttgacgtgagggtcagggagacatttgtgtttttttttttttttttttttttttgagacaaagtttcactctgttgcccaggctggagtgcagtggcgtgatctcggctcactacaacctccgcctccccggttcaaatgatgctcctgcctcagcctcccgagtaccagggattacaggcacccaccaccacgcccagctaatttttgtatttttagtagagacggggtttcaccctgttggtcaggctggtcttgaactcctgagctcaagtgatccacccacctcagcctcccaaagtgctgggattacaggcgtgagccactgcgcccagccgacacttctgtcttgaaagcggtcatcctgcttggagttccccactccacttgtcctgttcatgcagtgccattttaatcctctccaaaaatgtttctgt

SEQ ID NO: 235 - DNA, 98 bp, Homo sapiens
agaaaaatagaaaaaggctgagttctggcaatggtggagtcaccacaccaagcctagagtgcctaattccagactttttgtatgtgtgagaaaaataa

SEQ ID NO: 236 - DNA, 3084 bp, Homo sapiens
gatctacatggaacatagttttgtaggataaattgaaacatcagcaaaagaaaatgtgaactttgatgaagcctccaggtgcctggatgccaaatagacaaatacagaatataagaaaacacaataagagtcattggccccgtgcctatttggcatcattgcaagaaacctggggtagtaatagtggacgtatttagagagtgaggcataagctcacctaaacagcctagaaaatgtttactatgagagtaagaaggaagaacacaagtggatatacgaggagtccttgcaatctggcccatcagtaagtttttcatgtgtgcatcattagtcaagaaagtagatctgaaattttggggggtctttagtataatcttggtggagttgtaaagtggattaaaagtctgaattatatatatatcaaagtggcaggtctggcagtcatattgttgaacagtgtggctgatacattaataatgtatgtgtacattcgtgtatgtgtgtataaccaaggggaaggggtggtcatggtcagagatgtaagacaagaggtcggcggggggaagcttcagggagtggtaggggagggcactggggagcgagtgggtcaaggagttgactaataggaaacaactacctccaggagaaggcaataatctccattactttttattattttatttttttttttagggacaaggtcttgctctgttggctgggctggattgcagtggtgtgatcatagcttactgcatcactgaacacatgggctcaaaagattctctcacctaagcctcctgagtagctaggactacagacaccaccaactcacctggctaatttttaaaatttttgtagagatagggtatcactacgttgctcaggccggtctcaactcctggggttaagcagtcctcccatcttggcctcccaaagggctcgaataggcaaaattgagctgtttaatgagaagcagtggggataattatcccctttcataatgaggttctatataacaagtcttaatccttgaagggcctattctaacttaaattgtgccatattaactattttaaagagggatttatagggtcccattttatcaagccattttttaagtgccaaaattttaactttagtttattatttgttgtgtcagagagtctgtgtccaataagagatactttaaagcaatgggtacaaaactatgggaaattcaaccaaagcagtaaagtgagggatagttatccaaaatattttttaactttagttacctttttaagattagagggcatacaatatttaaatttaatgagaaccccaagtataatatgtatttttttgagaaggagtttcgctcttgttgcccgggctggagtgcaatgatgctatcttggctcacggcaacctccgcttcccgggttcaagtgattctcctgactcagcctcccgagtagctgggattacaggcacctgccaccatgcctggctaatttttgtatttttagtagagacagggtttcaccatgttggccaggctggttttgaactcctgacctcaggtgatccactcgcctcggcttcccaaagtgcttggattacaggtgtaagccaccacggcccactccaagtataattggagccccagtattgattgagtccatgaagtatgtcagctggtatattttagcaaatgctaaagttaatttagaccttatgttgtagagacaaaaaatctaatcaatgtccttttatctttttgtaatataaattctttggtatatacattctggatttctaattgggccaaattatggacatttgttttaatttagttacttatgttatatccatatctatatgtacacatacaatctattccttaagtctatattgaaatattatatcgaaggcctgaccagagtgtccgccatggagtcgcagaaagaggcgcgaccccgtcgcgcgaccgcctggggcctcaaggtctcagacgccaaactacaaggagcagcgggagggcggcgcagtgctggcgacggctgccctgggaacagaggcggacgacgctagtgcgggcgggctgtgggagctgcaggtggagccgaggagctgaggcctgcgtgcagccgctgcaagccggcctcagaaagtgtgtttttgtccatttctcccagcgcaccctttgcatatctctacctacttgtgcataattcagcatccagcagaggaagacaaaatgttgcggacagttcctctaccagcagcatgcctcccccaggacaagcgcaaagtgaagactggtcgtcgcttcagtgaagaaagagatcctgaactttcaactgtttgccggaagtttggtacattaatgttatatccaggggctaatataagaagctgctaatctggaagaatttatattagattctcctgtttatccttctacaatcatcgtcattgatggtacacggagccaggctaaggacattttctgtaagaattccttgttctgacacccccaaacaggtgcagttaaaaacgagcatttctagtcagtatgtaattcggatacagccaattaatagatgtctttctacactggagtgtgcacctgttgctctttccatcttggagaaaaataattacatacaagagactttgcttcgccctcttgaagctttatgctctttccagatttagcatggtgcccaaattggccccagcaagcaacgccttctgaaaaaatggattatatcctaaaccaatgccaaagaacaaacacaaactcaggaaaatggaactattaaagaatagtgttaaaatttagtacagttgttcttttggtgttagcttacctgtcttcatctaacaataccaacttaagttttcatatagtttaggtctgtaggtttttgacttgctaatgagaattgcatactaatcttgcccagaagaaggaagtaaaccaaatattcatagaaacaaacaaacgaatgaaaattcactggctcactgaaaaggaagatttcatactgtacttgtttttaaacatgtgcctctaataatacatgttttcaaacccaa

SEQ ID NO: 237 - DNA, 536 bp, Homo sapiens
gggaaaaattattttcactaactttaagactccagagacacttttctcagccatgaccagtaatgtttttaaaagattttggaaggaatagctcctcactataccaccagttcgtgattttaagggaggagacaacccctcatactgtcttatgcccaatttctgcctccaaagaaagaagtaaaatctaaaaggcagaaatgaaatccacaagcagacagcctggccccacatcctgggcctggtagttaaagattgacccatgacctaatcggttatgttatctatagattacagacattgtatagaaaagtaccatgaaaatccctgtcctgtcctgttccattctaattaccggtgcaggcagccccgagtcacgtaccccctgtttgctccatcgatcacgaccctctcatgcggacccccttagagttgtgagcccttaaagggacaggaattgctcactcggggagctcggtttttggagacatgagtcttgctgaagctcctggctgaataaagccctttcttcttta

SEQ ID NO: 238 - DNA, 2128 bp, Homo sapiens
agaagttagctaaagagaaaaaaaatgcaaaaagaaggagtcatggaacatcaggaaggaaaaagaacacagtaagtacaaaaaacagtaggctttccttctctgcttaagtcttctaaattacatttgacagttgaaacaaaaattacaacactgtctgatgtgattctacatgtttatagaggaaatacttaatatattattataaacaagtgaaaatgattaaagagacataactggaggtaagatttctatatcctactaggactggtaaaatgatgacaccagtacaccgtgaaaaattatgtatatataatgcaatatctagagcaaccactataaaaactatacaaacagatacactaaaaacataatagatacatcataatggaattctaaataatattcatacaacccacaggaagacaggaaaaagtaaagaaaaacagacagaagaaatataaatcaaaaaataaaaggggatacttaagcccaaacatataaataattacaggaagtgtaaatggtctaaatacaccaattaaaaaacaaattggtagagtatatttaaaaacacgacccaactacatgctgtctaaagaaactcacttcaaatgtatggaaattgaaagtaaatggatggaaaaagaattatgcaagcaaaggaaagcaggagtggctacactaatatcagataaagtaatatctgatattactttaagtaagattttacttttagtaaaattgccagagacagacagggacattatataatgatgaacatcagtccatcaagaagatatagtgattgtatgtgtatgtgtttcaaacaacagacctgcgaaatatgtgacacaaaaagtgttagaactgaaatgagaaatagactctacaattatagctggacactttaacacccttctatcaatacctgctagaacaagtagacaaaaaaatctgcaacaggagcctgggtaacatagcaagaccccatctctacaacaacaacaaaattagctggggaagatggtgtgcacctgcagtcctggctacttggaaggctgaagcaggaggatcacttgagcccaagaggatgaggttgcagtgagctatgattatgccactgctctccagcctgtgtgacagagtgagaacctgtctctacaaaaaaaaaaaaaaggaaaatatacaaggatatagaagaacgtaacaccaccagtcaacagcagtcaacacgatctaactgacatatacagaaatctctacctaatggcaacagaatatacattcttttcaaatgccatggaacatataccaagatagaccataacctgagccataaaagaaacctaaataaattttaaagattaaagttttaaagattaaaattaaactcaaagggtgttctatggcctaaatggaatcaaactacaaatcaataacagaaagataacaggaaactctccaaacacttaaaaactaaaaacacacttctaaataatccatagatcaaagaggaagtctcatgggaaattttaaaaatgtatttaagtgagtgaaaatggaaatacagtatatcaaaatttgtgagacataggtagtgacagtaaggagattcagtgatgaaagtgaaatttaagcactaaatgcacacattagtgtggtaggctgaattatagcccccgtaacgatgtaaatatcctaatctctagtacctgtgaatgtgttgccttaacatagtaaaagggactttctggatgtgactaaattaacacttttgtgatgagattatcttggattatccaggtggatccaatattatcacaagggtccttataagaaggactcaggagaatcagccacagaaagagaaaatatataaggatggaagcacaggatagagccaagagaaggtgctgtgcactgctggctttgaagatggaggaaggggctacaaaccaaggcacgcagtcagcctctagaagctggaaaaagcaaggaaatggattttcccctacagctccagaaggaatacaagccagccgacaccttgatttcagctcagggaaactgattttggatttctgactttcagaactgtatgataaattcatgttgttttaagctg

SEQ ID NO: 239 - DNA, 213 bp, Homo sapiens
ccaggtatggtggctatgcctgtaataccagcactttgggaggcccaggcaggcagatcacttgaggccaggagttcgagacagcctggccaacatggagaaacctcatctctactaaaaatacaaaaattagctgggtatggtggtgcacatctgtaatcccagctacttgggaggctgagacacaagaatcacttgaacccaggaggcaga

SEQ ID NO: 240 - DNA, 10185 bp, Homo sapiens
aggaaatggggcagccaggagtgctcgagaacagatggggccaggcaccatggcccacacttgtaatcccagcactttgggaggccaaggcaggcagatcacttgaggtcagcagttcgagaccagcctggccaatatggtgaaaccttgtctctattaaaaatacaaaaaaattagccaggcattgtggcgcacacatgtaatcccagctactcaggggactgaggcaggagaatcgcttaagcctgggaggttgaggttgcagtgagctgacacgccactgtactccaacctaagcgacagagcaagactccatttcaaaaaaaaaaagagaaggttctgctttagagaccacaggagatgaagcataagacagaaggggaataaaaggggagagggcagaagtgtccttcacatctcctcttctttaaggggggaccccagcaggtagctccagaggctgcctttccaccattagagggcagcagaggtccatttccgggctggggccttagggcatttctgggtgaggtgtttggggtatgcccattgacaaccctgttccttttctttccgggccctcccatatgtgatctctccaccctagatctacccctgggccttggggtgtttcttcaggtagggttccctccccgcatcagaggatgaaaaggaggggagtatcttagaaagcatgcacagactcttgaggcaaatccacccttttccagcatctgcatgttgccctgaagtttacctgtttgacaaagtgctcttgaggacagctacctttgcatctccagcatagaatcttgtacttagcaggtggtttaagtcatgttctgccattctttaaggacttggcggcagaacaatgacagcatctagtaactggggctccagacccttctaaccagagtgaccttggaggagaaagggatcgcctttgccttagtctgtttctgcatttgtaacctaaagggattcggatttaccattctaaaactccaggattaaaatgtgggtaagtctgtgcctttcagctaaatttggaagtatcacctctcagcctccccagggatatgaggcggcttgtgaggtcctctggagtcagaagatgccaccaccccagaggatgtgagcccacctgtggaggtcttgatccccaccactaggatggggcaggtgagaccagacccttccctcttccccaccagggtctccccgcaacttctgtccccactctctgttgcagaacaggcaagtggccagctccaaactagggccacgcccacagccagtgctgagcatgctgcaccagaacaggtgttcacctacctggccctgatccctttttgggagaactgggacagaaggctctgggtcctgggctgcacccaggatggaaggaggtagggaaacagcatctccaatgatgctgcggccagccaggcctgcccactcagagccttggcccagtacaccctaggcagcaggcagggaacaagcaacactcctgggtggccattctattcctgtcctcagccctcctcaagggtcatcattcctggcactctatttagccccaaggtgggtgactacatgaactccctgtggtgaggggtgagtagaagcccatggaagcctccccactgccatgcaaccccatcgcatctccactgaactccgagcagaaaacggctgcctgatgggaactgtcatttaggttcccaggctactttggtggatctgagaataaatccctcaagacaaggtccttgctctgcccttctccagggtgggacccagagttactggcccctccatcccatggagccgattctgcaaccctcacttcctaagcacaggtaaggctcacctgttctttaaagacctccaaaaagtgttctttcttggctgcaacctaactccctcctgccacacctaaggcccatttcttctggttctgccttcaaatgattcagagagattagaggcagagtcattcctagagtgacatttttactagtccacagtacaacaaaaaaattaaagacaaaggaatgtctatttgttggcataaagtccattgaccatcttttcttgggaataattgttttctttcttttttttttttcttttttttgagacaggttctcactctgtcacccaggttggagcgcagtggtgcgatgttggctcactgcaatctctgcctcccagactcaagcaatcctctcgcctcagcctcccaagtagctgggactacaggcatgcgccaccacaccaggctaattttttgtatttttggtagagacagggttttgccatgttgcccagtctggtctcgaacacctgagctcatgatccgcctgcctcggcctcccaaagggctggaattataggcacgagccaccgcgcctggctggaactaacagattcagatgatgtcactcctattttgagaattaaaatgtattttcttaggtcaggcgtggtagctcacacttgcagtctcagcactttgggaggctgaggcgagtggattgcttgagcccaggagttcgagcctggcctgggctgaagcaaaccccgccaacccccaacaaaaaatacaaaaattagctcagcatggtggtgcgtgcctgtagtcccagctattctggaggctgaggcggtaggattgcctgaacctgggaggcagaggttgcagtgagccgagatcatgccactgcactccagcctgggtgacagagccagaccctgtctcaaagaaacagaagtattttctttaatgatggtgataatagatcgtaggtatgttctccatgcccttagggagcgtaaatttaaagctgcaactctttatgggaacctggctttcacttgttttctggctttgtttttctgtcaaatccagaaatctggaaccactggttaaaaagaagtctgagagccaaaatacacacagccagctgtgagttactacctgccttacccaggaaaaggacatgagctgcccaagcacacacctctttgccatctatgccagcatttttaccttcaaggccgatgttctcatcgtgttaagtacatttgagtttagtaagtaagtatgggttctaggcagggttcaaaaccagttcagggctgggcgcggtggctcacgcctgtaaacccagtactttgggaggcccagacgggcagatcacaaggtcagagtggccagcctggccaacatggggaaaccccgtctctactaaaaaatacaaaaattagctggacgtggtggtgtgcatctgtaatcccagctactcaggaggctgaggcaaaattgcttgaacccgggaggcggaggttgcagtgaaccgagatggcacgactgcactccagcctggtgacagagcaagactccatctcaaaacaaacaaaccagtttagtcatggacttagctttgtgatctccttgtgcctcattttccccacctgtaaaatagaaacaataagacttacttcatgggattgtttgtgaggattaagtaaagcacttggaacagtgcccaacacacagagctcaacaaatgtttactataatcctaattatctccgcaggtttcacctggacaacatgtggggcgtgggcaggcagtgagaacacagatggtagccctcgaagcatcccagcctgaaaagcacatgagtcagcccttccttccacttacccactacctctcacgctggtcgtcttttttattttttctctctctctcttttttgagacggagtctggctctgtcacccgggctggagtgcagtggcgccatctcggctcactgcaacctccgcctcccaggttcaagcaagtcttgtgcctcagtttaccaagttgctggaactacaggcacgcaccaccacgcccggctaatttttgtattttcagtaggctggatttcacgatttcggccaggctggtctcgaactcctacactcaggtgatccgcctgcctcggcctctcaaagtgctgggattacaggcttacgccaccacaccaggcctccctggtcttcttaaagtcaatcaatcccaactcctgtaatccatgtaactgctttgagtgactctggagccatctttgaagcccccacaaatacctaaatgaggaacaggagccctgcaacacattcccctaaactgtgttcctaagaaccatccaactacctgtggaatcctaaggccccttcctcattctctttaccagtatcctggcaatggttgtttaagcctagttaatgacagaagctccagacagatactgttgggggtcctctacgaaaagacaccgccattcccgagggtgacgctgcagcggcccagcacttgtgcgcatagaagctaaggggaaattaccctaccctaaactccagtgaaaagccctttgcagtccgacaggcttgcattcacatcccaacagtgtggggtttggacaaattccataatctgagtctgtttcctcctctagaatgcgagtctatgaattcctgtctactgcctggaagtgccgctgtcaggactgagataatgtgtgtactttcggtgcacaggggacgctcaacacgtgcgagcttcccttgcagaaagccaagagatgaaaggctgggggccgcccctgccttaacgtggatcccacactctccgagatcatctccccagctagcgcttactcctgcccaggaaccagatcctggggcctccgggtagctcagcctaaggcgcggggagcagagggggccagcgcccccagaggaggaggttgcggcggggggaaggaggccgcgcctttccccgtcccgggcctcccccggtcttgctctccctccccggactacctcctccccccgcgcgcatccggcgacgggcacaggatgttctttcgctcccgtccccgctccgcccccgctctcactttctcttcgctcccctcccccactcccgccgcgcccggcgccggcacctagtttaactctttctctcccgcgctcggcggcgcctgcgcgcctcctaggcgggggtcccatccttcccgcccgccccctaggacgcggagcgacggggctgcccgggaaggggcgggcctgggctgagcgctgggcccaggttctcaggatctcgtggcccgcagctgttggagagggctcactgggagccggcactctctagaacccccgctagttcacccgggtgagggtgggggtggaggtgggtacccacactcgagacaactgcgcgcccgagaagggcggccaggcgggcttagttagatgctggcccggcgggaggcgagtacggtcaaaggccaccaacctcatcctccccccaggttcggatgcggaggggcccagggcaccaggagacgatggagagaggccacgcccctcgcgacgtcactgatgtcaaggcaactgggggcgggacggtgggctagagaagggcagacctcggggaattgaggctgctggtggctctgggacggggtgggggtgggggcgcagcgggggcgggcttttcaatttgcttcactcaatgatgtccaaaaaacggagtgagggtcagcttctgttcgctcgttgattcaacaggcatttattgagcgttatgcttggggctgtgcttaggcactgggatattgcgtgctatccgaaccctgccagttgttgtgaactagggtagggtggctctgcgtccctggaacggacgtaattattaacagtgccccttttcaagtttaaagtgtcccagtatgggcagtagttaaggaacaccttcctcccaatttaggaaaggctctaaccatacggggaaggaatataaactattgggtacaacagacactttcctggtgctttgtattctctgtaatttttgcccctcattctgcaaaacaagtgtcactagcgacttttacagacgaagaaactggctcagagaggttaagagacttacccagggccaaacagctaagtgttggaaccaggatccagacccaagttttatgtgccctccaaagtatttcatgcccacttctcaaaataagtaaatggtatcaaataaataaaagacactgtccctgccattaaggagcctacagcccatgggagaaagggtttaaaatactgcaggacataactaagcaataaaatatagaaaagattaggcagggcgcggtggctcacacctgtaatcccagcactttgggaggctgaggcgggtggatcacctgaggtcaggagttcaagaccagcctgaccaatatggtgaaaccctgtctctactaaaatgcaaaaattagccgggcatggtggcgttcaactgtagtcccagctactcggggagctgagacaggagaactgcttgaaccggggaggcagaggttgcagtgagccgagactgccccactgcactccagcctgggcaacagagcaagactccatctcaaaaaataaaaaaaaaaaaaggaaaagattaaaggcagctcacaggctcagagggaagccactagttacgccactctcctttccaccttctgccctcctctgtggttttgttctcttactgagcaggcatctgccctcctagcaggcatctgccctcattctactctgcacccaaggttttgcagttggtatttgccacaacctccctgatattaacttggatgtcagcctctcccttccccaccagccaccaccccccgccccccaccaaagattttggggaaatgaaaaatagtggcacttcaaacaaaagggccccagtgagcaccagtaagccaataggcttgatgggactggggagaccaaggcaggagagagaataggaaggatggaaagggaacaccaccaaatgaatgggtcacgaggaacatttgctgccctactgctgtgcaggaggcactgcactaaaccccgtggcctggacatgccatgaatgaactcaggtcccatcacagagagtacacaggttagctagtgtactcactgtgcttggttgaggagtctgaagttgataacatacacaataaatgatgtttgagaaagattattccagcagggtgtgtaggaggaaggaaaaagaaaggacagtgtggcagatgctgtgagaatttgggccaaaggtggactctatggggctggaggggaaagggtgaaggagaaaagtaatgaacaaacaatatcttttgaaataaaagcaacaaagggaagaatttgataagagatcagacataaggatggtgaaggagagaaagcagttaaaaattaatctacctttgcagtgagttttaggactgggagggtcatggtgggcaatggggaggagctggtatgaggggcatgaatatgagttcagtcacttctaggccatgtaagggcaggtgtcctgtaggtgactggacttggagatagggaagtccagaagagcagtgggctgctgtctgagagtgtccctgtcacagcctcgagcaatcactgacctgggatcacggacagatttcaagcatcaggaagaaggtgggagtagatggcagtgaaggtgcctctcgactgggagatgcagtgtgcattggctgggtaagagcctgtgtgggaagcgtgatgtgtgtatgggaagggggtccacggcccaggcctgtgttggcatctttagccacagagggtgccagagatgccaccagatggcaggaggcccaggtgaggcacttcagcagcctgaggtccctcccctaggcccactctcaaaggccctggagcccaggcctatgctgcctgccagggcctttcccggaaccactcctccccgcctgtcctggcactctccaggcacaaagcatccctcagggcactgcgcaggcaccccaggaagctgggacgtgagacaggtccccacccccaggaataaccctgctctgggctgctgtcatcctcacaatggccccacaagacgccaggagacagcatagggacagcataagtccccagtggggaccccaaatgggaccccatttcccctgcatagagggggaaggaggagctttgtggctaggtggcaggatctttattgggtctttattgtggtttgggggtgggggcagaaaagcagggtctcgggcttcaaaacaccacaccacctgcctctccctccctccgaggaggaaatcttcaggggcctagtggttttgaggggagggggcaggaagagactctgaactctgggtcagctgaggacagagataggggagatcctcttgccctatgtccctcttttctcctaggatccccttcctcggctccctactccaccactaccccagaacaaactcctacctctgtttgcaactaagagttacatcccccatgccaagaccttccgaggcgtcccagaggggtgagatttggggaaaacaggacatgtacacagcagctgtgtgcctggccacacctgtcgggtggggtgaggagagtgcttctcccaggtgggcagagcctgctgcgctcaggctgggggctgggagacgctttaatagaggggcgagaaggcagagggatgcgcaaaccggccacgtggaggtctcgcgcggcaggctggggcgcgagcagaggagcgggccgtatgcttgcccctcccgttccagggagctgccgagtgccgggtcgtcgctgaccgcaggctgcaagagcggttgatctggtgagcgagcacacccacttacccagctgctgagtcaggctgttctcgctcgcgctcgcccgcccgcccgcccgctcgggacattgtgttccagccccggcgcgctggcagcgggcccaggcgctcacaccagcctcctcgccctgtttgtgctcgcggcttgcgctcggcgcgcagcctcccggccgccgcaaccatgcgattgcacgctggggcaggggttggcgagcaacctccggggcgcgcgtgggccccgcagccctgcccactcaccggccttggagcacccagacctagccatcccccatttgcccctgcttgggtaccccaggcttgggtggcgcctggattagcacagctgggggagggagcaggtgtggggagctctacgagcagaaggagccacccaggctgccgccagcgctctccagcgctcagtccgtgcttctccagcgctcagtccggggggcgggaggaggatagctggagctcgccagccccagacttgcgagacctgggacgcagtcacgtgacaacggaagcccgtgttgagggggccaattcaagcaatccccaggaggagcctcccctttcctagccccccttccctgatccttcacagaagcctggaacacggagactccagggattcccggggctggcaaaccaagcccagcccttttggacggtttgggaaatccctggcacgacgccgggagtagggagagcccagacactggcgagtgggtgtggacgacagggtgaaagaagggcaaggccaaggaagacgaccccaaactgcccctggaatctgacccttccctgtgtttagctccaaacccctggtttattcagagccacgttttctccttacccatccttctgtggaaagacatcactaagtgctggtcctaaagatcccaccctctccaaaccaaggagggaacaaagcatttatatcgcacgtttaccgtgtggaaggctctgtattgggtcctgctaaagaatgtcaccatgaggttaagacacagtcctgaagtcctttgttctccctccttcccacctccacagtttgctgtgccatttctcatgccaggagtgcctgtcctccctgtctacccatctctgctgctccagctcataaagcttccttgaaacagtgccagccaaatctgattcctgtctcctctgaacgcccagcacactcagtttgtacctttctcacggcacagcgtgtggcctgtctcatattctagcgatctgtttactaatcctgttcttctaaccagattagaaagtccttgaggcagaaacaaagtctgcttcttctttgagccctctcctccactgcccccgcctcccaccaccattccaactcatcccccacaggccaggcttggcaccggagttcatgttcaataaatattgggtgtattgaaatg

SEQ ID NO: 241 - DNA, 3080 bp, Homo sapiens
aggaaatggggcagccaggagtgctcgagaacagatggggccaggcaccatggcccacacttgtaatcccagcactttgggaggccaaggcaggcagatcacttgaggtcagcagttcgagaccagcctggccaatatggtgaaaccttgtctctattaaaaatacaaaaaaattagccaggcattgtggcgcacacatgtaatcccagctactcaggggactgaggcaggagaatcgcttaagcctgggaggttgaggttgcagtgagctgacacgccactgtactccaacctaagcgacagagcaagactccatttcaaaaaaaaaaagagaaggttctgctttagagaccacaggagatgaagcataagacagaaggggaataaaaggggagagggcagaagtgtccttcacatctcctcttctttaaggggggaccccagcaggtagctccagaggctgcctttccaccattagagggcagcagaggtccatttccgggctggggccttagggcatttctgggtgaggtgtttggggtatgcccattgacaaccctgttccttttctttccgggccctcccatatgtgatctctccaccctagatctacccctgggccttggggtgtttcttcaggtagggttccctccccgcatcagaggatgaaaaggaggggagtatcttagaaagcatgcacagactcttgaggcaaatccacccttttccagcatctgcatgttgccctgaagtttacctgtttgacaaagtgctcttgaggacagctacctttgcatctccagcatagaatcttgtacttagcaggtggtttaagtcatgttctgccattctttaaggacttggcggcagaacaatgacagcatctagtaactggggctccagacccttctaaccagagtgaccttggaggagaaagggatcgcctttgccttagtctgtttctgcatttgtaacctaaagggattcggatttaccattctaaaactccaggattaaaatgtgggtaagtctgtgcctttcagctaaatttggaagtatcacctctcagcctccccagggatatgaggcggcttgtgaggtcctctggagtcagaagatgccaccaccccagaggatgtgagcccacctgtggaggtcttgatccccaccactaggatggggcaggtgagaccagacccttccctcttccccaccagggtctccccgcaacttctgtccccactctctgttgcagaacaggcaagtggccagctccaaactagggccacgcccacagccagtgctgagcatgctgcaccagaacaggtgttcacctacctggccctgatccctttttgggagaactgggacagaaggctctgggtcctgggctgcacccaggatggaaggaggtagggaaacagcatctccaatgatgctgcggccagccaggcctgcccactcagagccttggcccagtacaccctaggcagcaggcagggaacaagcaacactcctgggtggccattctattcctgtcctcagccctcctcaagggtcatcattcctggcactctatttagccccaaggtgggtgactacatgaactccctgtggtgaggggtgagtagaagcccatggaagcctccccactgccatgcaaccccatcgcatctccactgaactccgagcagaaaacggctgcctgatgggaactgtcatttaggttcccaggctactttggtggatctgagaataaatccctcaagacaaggtccttgctctgcccttctccagggtgggacccagagttactggcccctccatcccatggagccgattctgcaaccctcacttcctaagcacaggtaaggctcacctgttctttaaagacctccaaaaagtgttctttcttggctgcaacctaactccctcctgccacacctaaggcccatttcttctggttctgccttcaaatgattcagagagattagaggcagagtcattcctagagtgacatttttactagtccacagtacaacaaaaaaattaaagacaaaggaatgtctatttgttggcataaagtccattgaccatcttttcttgggaataattgttttctttcttttttttttttcttttttttgagacaggttctcactctgtcacccaggttggagcgcagtggtgcgatgttggctcactgcaatctctgcctcccagactcaagcaatcctctcgcctcagcctcccaagtagctgggactacaggcatgcgccaccacaccaggctaattttttgtatttttggtagagacagggttttgccatgttgcccagtctggtctcgaacacctgagctcatgatccgcctgcctcggcctcccaaagggctggaattataggcacgagccaccgcgcctggctggaactaacagattcagatgatgtcactcctattttgagaattaaaatgtattttcttaggtcaggcgtggtagctcacacttgcagtctcagcactttgggaggctgaggcgagtggattgcttgagcccaggagttcgagcctggcctgggctgaagcaaaccccgccaacccccaacaaaaaatacaaaaattagctcagcatggtggtgcgtgcctgtagtcccagctattctggaggctgaggcggtaggattgcctgaacctgggaggcagaggttgcagtgagccgagatcatgccactgcactccagcctgggtgacagagccagaccctgtctcaaagaaacagaagtattttctttaatgatggtgataatagatcgtaggtatgttctccatgcccttagggagcgtaaatttaaagctgcaactctttatgggaacctggctttcacttgttttctggctttgtttttctgtcaaatccagaaatctggaaccactggttaaaaagaagtctgagagccaaaatacacacagccagctgtgagttactacctgccttacccaggaaaaggacatgagctgcccaagcacacacctctttgccatctatgccagcatttttaccttcaaggccgatgttctc

SEQ ID NO: 242 - DNA, 485 bp, Homo sapiens
catgtgcccacacagattttaacacacatgtgcacaaacatgtacacacatgcacacacaaatgtatacacacatttgcacacacaaatacacatgcacacacaaaacgtatacacatatgtacacataaatacatataaatgcatacacatatgtgcatgcacaaatgtattcacatatgtacacctacaaatacacacatgtgcaaacaaatatacacacaactgtatgcacatatatgcacaaacaaatgcatccacacacattcacaaacatgtgcacacacacgctcacagaaatgcatatacacatgctcacacacaaatataaacatgcacacacaaatgcatacacacgtgcacacatataaacatgcacagaaatgcatgcacatacaaatataaacatgcacacttacaaatatacacacacgtgaacacgcaaatgtatatacagatgtgtgcacacacaaatgcatgcacaca

(The sequence listing continues in the following parts.)

What is claimed is:

1. A method of treating breast cancer in an animal comprising administering a therapeutically effective amount of a compound comprising a modified oligonucleotide 12 to 30 linked nucleosides in length and having a nucleobase sequence that is at least 90% complementary to a mammary tumor associated RNA (MaTAR) to the animal, thereby treating breast cancer in the animal.

2. The method of claim 1, wherein the MaTAR is selected from a group consisting of MaTAR 1-111 and 193-280.

3. The method of claim 1, wherein the animal is a human.

4. The method of claim 1, wherein the modified oligonucleotide has a nucleobase sequence that is at least 90% complementary, at least 95% complementary, or 100% complementary to an equal length portion of a nucleobase sequence selected from SEQ ID NOs: 1-111 and 193-280.

5. The method of claim 1, wherein the modified oligonucleotide is single-stranded.

6. The method of claim 1, wherein the modified oligonucleotide is double-stranded.

7. The method of claim 1, wherein the modified oligonucleotide comprises at least one modified internucleoside linkage, at least one modified sugar moiety, or at least one modified nucleobase.

8. The method of claim 7, wherein the at least one modified internucleoside linkage of the modified oligonucleotide is a phosphorothioate internucleoside linkage.

9. The method of claim 7, wherein the at least one modified sugar is a bicyclic sugar or 2'-O-methoxyethyl.

10. The method of claim 7, wherein the at least one modified nucleobase is a 5-methylcytosine.

11. The method of claim 9, wherein bicyclic sugar comprises a 4'-CH(CH$_3$)—O-2' bridge or a 4'-(CH$_2$)$_n$—O-2' bridge, wherein n is 1 or 2.

12. The method of claim 1, wherein the modified oligonucleotide comprises:
a gap segment consisting of linked deoxynucleosides;
a 5' wing segment consisting of linked nucleosides; and
a 3' wing segment consisting linked nucleosides,
wherein the gap segment is positioned immediately adjacent to and between the 5' wing segment and the 3' wing segment, and wherein each nucleoside of each wing segment comprises a modified sugar.

13. The method of claim 1, wherein the modified oligonucleotide comprises a portion of at least 8 contiguous nucleobases of a nucleobase sequence selected from SEQ ID NOs: 112-156 and 169-192.

14. The method of claim 13, wherein the modified oligonucleotide consists of 20 linked nucleosides and has a nucleobase sequence consisting of the nucleobase sequence of SEQ ID NO: 151.

15. The method of claim 14, wherein the modified oligonucleotide comprises:
a gap segment consisting of ten linked deoxynucleosides;
a 5' wing segment consisting of five linked nucleosides; and
a 3' wing segment consisting five linked nucleosides,
wherein the gap segment is positioned immediately adjacent to and between the 5' wing segment and the 3' wing segment, wherein each nucleoside of each wing segment comprises a 2'-O-methoxyethyl sugar modification, wherein each internucleoside linkage is a phosphorothioate linkage, and wherein each cytosine is 5-methylcytosine.

* * * * *